United States Patent 11,913,074 (METHODS FOR ASSESSING RISK OF DEVELOPING A VIRAL DISEASE USING A GENETIC TEST) - sequence listing, part 21

SEQ ID NO: 2164 - DNA, 54168 bp, Homo sapiens
  source 1..54168: mol_type = genomic DNA
ttcttactgcccccatccggttcggggaggtggcgggaccttggcggcgcccggagccggcgtggcgctcatcgagggacgcccggcccaagtggtaagttgaaaaatggcggaggggggaagaaggaggggctttgcagggcaggaggctgacctcccggccgggggtgggagggacacgccggggcccagtggcgcagcccgggctgggagactgacggaccgcgcccggtgtctctttgaggccctgacgtggacacacttcgggtttcacgactccgggtttctccaggggatgggccggccggtagaggcgcgtgagggagacgaagggacttccgtttccttcacctaggctggggccaagccgcagagcggagttggcatttccagattggggctcgggccgcgcctcctccgggaccctccccttggaccgagccgatcgccgcggggcagttcgggccggctgtcctggcgcggtgggtacagcttgtgtaggctttcccctcccccgctttccctccttcccctctcctccctcccctcttcttttcccctccacttccctcgggccggcgctgctggggagggcgggaaggccgcgccagcccatcaggggtggcccggccccggctgcttgcccgggttcctcggactgccgacggcaggcgtgggtgggtgggtgacttcaggcctgcaggattgccttcctaaaccctgtgacacctaaggtaaattgaggcaaagaactttttaaaaaaatatgatcaaagggatttcctccccatgtgataacctgtggcttgtgtggagcagggtggagtgtgtctggagagggcatatgaaactgaaagaataagggccaaagagcttccggaagaggaaattagctggtgattctttccaatctgctttcccagtcacctttccggcatgttctgtaaaacaaaatgtaatttgactttgtttcattattttaactccataacacttaaattgttttcttttcggggaggggagtgtttattctcaaactaagcagtagccctctccaccttcgaaaaaggaacaacgtcaatccaacctttgttaaaaaactccaacctatcagattttaataatctagtagtttgctttcaaatataattatgtcgctagttctgtcacaactatactttgatagtttaatgactcacagaaatttgtaagactggaggttgcagtagtgtttctttcttattcttttttttccccataatatttattatagtcaatgaacagtgttacagacggccatcttagaattataacattttagagttggaagggatcttagtcaaaccctgtccttttacaaaaccagaaaccacggcttaggaagatttcatagcttgctaaaggctatccaactagttagattagaacccatgttatctggcttcttgcccaccactcttactgcgcaattgctccatatcgcctccaagcatgaaaattaaatgtattcaattcaacacacatttctgaagagtataatactttgtaccagtgactgtggtaccactttctatgtatttcaatgtatttaacatgcttatggagtacttgagattcccccccacccccacattcaagaagtggcaacagtttagatttatacacacaccttcacatgtacgtgtgtatacttgcatttgctcagatagtttcttgaaggatacacaataaaaatgttaatagtaatgacttatggaggagaagagagatagaagactttttactttgtacttcacatgatctaatgtacggtttgaatttgttataaattcgtattgatttcataattgaaaagttttaaagttcacaccttcccacacaaatatatatatcaacataagcaagtatataccaatggtatgtacacatttatgtgcatatatgtatttatacatatcagtggtttgtactgtaaaatccggtatgattcaggtcaactcagctgacaaagcagacctcattattggatactcatgtttcgttttcttgtattgctctctcctaatgtaagatagtaaaaataatatgttactagtcgtcatatatttttagaaattgtcctaagcttcttgattatcaaataatgtagcaaacttttaacacatttaaaatatcaaatctgggtacttgcttcagtggtagcacatatactaaaattcgaacaattcaaagaagattagcatggtgtttttttttatcaattaattaattaatttttttttttgagacggagtcttactctgtcatccaggctggagtgcagtggccctatcttgactcactgcagcctccgcctcctgggttcaagctactcagcctccccagtagctaggactacaggcatgcgccaccacgcctggctaatttttgtatttttagtagacaccgggtttccccatgttggccaggctgatctcgaactcctgacctcaggtgatgcacccgcctcggcctcccaaagtgctgggattaaaggtatgagccacctcgcctggccagtccattttttttttttttgagacagagtttcgcttttgtttcccaggctggagtgcaatggcaccatctcagctcactgcaacctccgcctcccaggttcaagtgattcttctgcctcagcctcccaagtagctgggattacaggtgcccaccaccacacctggctaattaggtcccttttttttaataaaccacaagaaaaatttgacacctgacgctgtggctcatgtctgtaatcccagcactttgggacgccaaggcgggcagatcacctgaggtcaggagttggagtccagactggccaacatggtgaaaccccacctctactaaaaaaactagccgggtgtggtggcgtgcacctgtagtaccagctacatgggaggctgaagcaggagaactgcttgaacccaggaggcagaggctgcagtgagccgagattgcaccactgtactccagcctgggtgacaacagtgcacctttgtcccgaaaaaaaaaaaaattgacacaaggaaaatatctgcagcctgggcaacatggcgcagccctctctctaataaaaatacaaaaattagccgggcgtgctggcttgtgcctgtagtcctagctactttggggagctgaggcaggaggatcacctgagccttgggaggtggaggctgcagtgagccatgattgggccactgtactccagcctgggcgaaagagtgagaccctgtctcaaacaaaacaaagaaacaaaaatctgaattgtagactctttgtagataagaacatattttttaaaaaagttaagactagggccaagtgcggtggctttcacctgtaatcccagcactttgggaggctgaggtgggcggatcacctgaggtcaggagttcaagaccagcctggctaacatggtgaaaccccatctctactaaaaatacaaaaattagctgggtgtggcggtacacccctgtagtcccagctacttgggaggctgaggcaggagaaccacttgagcccatgaggcggaggttgccgtgagctgagaacgcaacattcaactccagcctgggccacagagtgagactccacctcaaaaacaaataaaaagttaagactaaaacagtttatagtgattaggagttcagctgtctagttttgtttttgttttgagatggagtttcactcttgttgcccaggctggagtgcaatggtgcgatctcggctcacctcaacctctgcctcccaggttcaagcagtttcctgcctcagcctcccgagtagctgggattacaggcatgcgccaccacgcccggctaattttgtattttcagtggagacggggtttctccatgttggtcaggctggtctcaaactcccgacctcaggtgaaaaagtgctgggacctcaggtgaaaaagtgagtcactgcacctggcccagctgtctcgtttttagaaatagattaagactcaaaaaaaatattgcccaccgtaatatatctgattattagcaaagcttggactagagtctaggttctagtctagtggcccttgtactatacctgtaattttattgctttctagtgcattggatgattccaactaggctgacaaagtaataatatctaaaggttagccaggaccatttcaatagttaagaattattatttttttctttggtttttattttattttgtcttccttttttttttcattttcaggaagtgagcagtttctcaaaattattataattaatggaccagctaatttgtatagtgcttaaaatattttagtaacataaattttactaaataaatttactaatttagtaaataaatgttctccttttatttcattgtaaacattaatttctttagtaaatcctgtatttatattgtaaatgtttagcgataaaataatgatatttcactgtttttgtttggtctaatatttaagtctggtaggtagtattagcagagagcaaaacctacagtttatgaaataaacattcattgagcacttaatgtgttccaggcattcattgtagtatgtggtaggattccaaggataaatatggcaaaacaaatgcctttcttctgttttttttttttttttttttttttttgagacgacggagtctggctctgttgcccaggctggagtgcagtagcgcgatcttggctcactgcaggcactgcctcccggcttcacgccattctcctgcctcagcctctcaagtagctgggactacaggcacccgccaccacacccggcttagagtgtgtgtgtgtgtgtgtgtgtgtgtgtgtgtgtgtgtgtgtgtgttttagtaaagacagggtgtcaccgtgtgtgtgtgtgttttagtaaagacagggtttcaccatgttagccaggatggtcgcattctcgtgtgtgtgtgtgtgtgtgtgtgtgtgtgtgtgtgtgtgtgtgtgtgtgttttagtaaagacagggtttcaccgtgtgtgtgtgtgtgtgtgttttagtaaagacagggtttcaccatgttagccaggatggtcgcattctcctgacctcgtgatctgcctgcgttggcctcctaaagtgctgggattacaggcgcgagccatcacaccaggccgcctttcttcttttttttttttttttgcttttttatgttcgtctgtttttattttgcttttgtgtgtttgtttgtttttccattgttcttttgaggctgggagattatcatgagctgtcaattctcaagctttatctctgtgagataatctggtaatagttttataaaatgtaacctgttagcactattaaaggacattgtgtgagtagatatgaagagacaaacagtagtgataagataaaaaatactttagaatttaacaaatactgtttctgtatcttagaggtcatgtgctacagtgtttggaaagagccctacgttgggtaccacagtacaggttattgactttgtttccaattagctgtgggattgtgcatgtcaatgaccccatctttctttacatgttcacatttttgatatgttattttaggtgttgaattcaaaacataaaaagggtattttaaggccgggcgtggtggctcacgcctgtaatcccagcactttgggagactgaggcgggcggatcacgaggtcaggagatctagaccatcctggcacccctctctgctaaaaaaaaaaaaaaatacaaaaaattagctgggcgtggtggcaggcgcctgtagtcccagctacttgggaggctgaggcaggagaatggtgtgaacccgggaggcggaccttgcagtgagccgagattgcgccactgcactccagcctgagctacagagcgagactccgactcaaaaaaaataaaagggtattttgaatattttattttatttatttgtttttgagacattgtcttgctgtgtcacccaggctggagttcagtgcatgatcccagctcactgcaacctccacctcctgggttcaagtaattctggtgactcagcctcccaagtagctgggattacaggcgtgtgctaccacacctggctaatttttttttttttggtatctctttttttcccctcggagacagagtcttgctctgtcgcccagagctggagtgcaatggctgcgatctctgttcactgcagactccgcctcctgggttcaggcaattctcctgcctcagcctcccgagtagctgggattacaggcgcacgccaccacaactggctaatttttgtatttttagtagagacggggtttcaccatgttaaccaggttggcctcgaactcctgacctcgtgatccacccacctcagcctcccaaagtgctgggattacaggtgtgagccaccacacccagccttttttgtattttaagtagagacaggatttcaccatgttgcccaggctggtcttgaactcctgacctcatgtgatctgcccgccttggcctcccaaagtgccaggattacaggcatgagccactgtgccggcctttgagtattttaagttataaaagaaatatgtgtttctatatatattatataatatatattatacatgatatataatatatatgatataaattatattatatacaatatattatatatgattaatatataatatatgatatatcatatataatatcaaaatatataatatgtatataataatgtatgatatatataatatagtatataatatattacatgtataatatattatatataatatataatacaatatatgtaaaatatatataatatataacacaatataatatgtaaaatatattacatatataatatatatatttttcagacagagtctagctctgtcacccaggctggagtgcagtggtgagatcttggctcactgaacctccgcctcccaggttcaagcgattcttctgcctcagcctcccaagtagctgggactacaggtgtgctaccacacctggcttattttattttatgtatttatttatttttctgagacggagtcttgctcctgacctcatgtgatctgcccgcctcggcctcccaatgtgctgggattccaggcatgaaccaccgtgcctggccagagatatgtgtttattatagaaaatttatgaaatagaataatgacgatcatattgtctacaggttgttttaatccccccccccccttcaacattctatagttaacatttctgtttttttttttgagacggagtctcgctctgtcgcccaggctggagtgcagtggtgcgatctcagctcactgcaacctccgcctcctgggttcatgccattctcctacctcagcctctctaagtagctgggactacaggtgcccgccaccacgcctggctaatgtttttgtatttttagtagagacggggtttcaccatggtctccatctcctgacctcgtgattagcccgcctcagcctcccaaagtgctgggattacaagtgtgagccactgcgcccagcagtcttttttttttttttggtttggtttggttttttagacagagtctcactctgtcccccaggctggagtgcagtggcacaatctcagctcactgcatctccgcctcctgggttcaagtgattctcctgcctgagcctcctgagtagctaggattatagacatgtgctaccacgcccggctaatttttgtatttttagtggaggcatggtttccccatgttggccaggctagtcttgaactcctgaccttgtgatccgcccgccttggcctcccaaagtattgggattacaggtgtgagcccccgtacctggcctttttttttttttttttttgagacggagttttgctcatgttgcccaggctggagcgcattggtgcaatctcagctcactgcaacctctgcctcctgggtttaagtgattctcctgcctcagcctcccaagtagctgggattacaggcgcacgcacaaccatgcccagttaatttttctatttttagtagagatagtgttttaccatgttggccaggctggtctcgaactcctgacctcaggtcatccacctgccttggcctcccaaagtcctgggattacaggcatgagccactgcgcccagcctgaagtctttcaaaatacattttttatttatccagtgtattattttatactgcactttcttcatctgtaaagtaacagggtcaggcatggtgactcatacctgtaagcccagcactttgggaggctgaggtgggaggattgtttgagaccagcctgggcaacatcgtgagaccccgtctctaccaataataaaaaaattagctggatgtgatggcacgcgcctgtgaagatcgcttgagcccgggaggtcaaggtggcagtgagccatgagggcaccactgcattctagcctgagtgacaagagtgaggccctgtctcaaaacaaacaaacaagcaaacaaacaaacaaaaaacccagggtggctgggcttaaggactagttgattccaacgattcaaaacccattataatagtttttaagcctgattatctgagattttgtcaaggaaaaaaattccacataacaatcccaggccaggcatggtggctcatgcctttaatcccagcactttgggaggccaagtcagggagatcccttgagtccaggagttcaagaccagcctgggcaacatggtaaaatgctatctctactaaaaatagaaaaattaactgggcatggttgtgcgtgcacctgtaatcccagctactctggaggctgaggtgggaggatcacttgagcccaggaggtggaggttgcagtgagtcaagatcagggcaccccattccagcttgggggacagagcaagaccctatctcaaaaaacaaaaacaggaatttgaggccaaatttatggattatatattttatctgctctgtatgtggttaataataggttatcctttatatgataaaaacatacttatgtccattttgcaggacttggcatgggcttttattgttttaaattgtgatacatttgtagctctgctgtttgatacattttgggatttgattttggtatgatttggtacccagtctttgttatggatacatgtgattcaccttgttatgatatagttttatgtattttcgaggatatgggtcatagtgaaaagtcacgtttacctgtacagactgagaatagcttgatctcagatggtcagatgttgaaccaagtggattaaagctgatttcttaaaccggacaaggctgctgccattgtgcattccctggtacttataaaatattatggtttgaaattttattcttatttctgtaatcatcttattcaccttaaatacagaaatacagacatctggctgggcgcagtggctcacacctgaaatcccagcactttgggtggccgaggcaggtggatcacttgaggtcaggagttcaagaccagcctgaccaacagagcaaaaccccatctctactaaaaaaatacaaaaaaaaaaaaaaaaaaaaaagctgggtcatgcctctgcaatcccagctacttaggaggctgaggcaggaaaattacttgagcctgggaggtggaggttgcagtgagctgagatcatgccactgtactccagcctggatgacagagtgagactccatctcaaaaataaagaaaagaaaaaaaaaacacagacatctcagcatatattaccatgtgacttaacctttctatggttctagctaattttttaggccttgaaagggaaggaagcctaacattttctgctacctcattggactgtcccttctgccagtaatccttgtagtaatttccttagacctatattggtcataatcactgggtgcatgacctttgatgagtaacagtcagaactactgtttcctcatatttcagatgaggcctatgatatattatgtaggttaaattagattccatatatgaaaacattctaaattgtaaagcacattacatatgttagttattatcaaaggtaacatcgtgaaagaagagaagatgagctatagaatcacacaagcccatgcttaaattttgaccttacattaaaccaaagaggattgatttttttttttaattgagacggagtctcgctctgtcgctcaggctggagtgcagtggcgcaatctcagctcactgcaacctctgccgcccaggttcaagcgattctcgtgcctcagcctccttagtagctgggactacaggcacgcgccaccacgcccagctaatttttttgtatttttagtagagacagggttttgccattttggcgaggctggtctcgaactcctgacctcaggtggtctgcccacctcaacctcccaaagtgctgggattacaggcttaagccaccatgcccagccaagattgaaaatttttagtttaaattcagcatgtttagtagagaagtacttacttgtagctaaaatgatgggatgaaggaaaatgaaaattagtttgtagatagtatttgggtacatgcggacactcatgaaatatgttgtatcgtttaaatttggtttgtagcacagtttcctttactttgtgtcatttaaaaaaattaaaacctagacagaagagaaacgtactaaatgtttgaatatagatagcactgtggctttcagatagagttaaatatttttactgaagaaagagaaaagatgtgggctcttatccataacttgtttgatcagcctgggcaatatagtgagaccttgtctctacaaaaaaaaatttaaaaattagctgagtgtgctgtcgcctgcctggagtccagctcctcaggaggctgaggtggtaggattgcttgaaaccgcaaggcaggggttgcagtgagccaagattgtgacactgcactccagtctgggcgatagagcaagaccctgtcccagaagaaaaaaaaaagttgtttaagtacttgcttgagatcctaacatgatcatggaatagaatacttcactctgaggtgagaagatcacttgaggccaggagttcaagaccagcttgagcaacatagtaagaccccatctctttttgtgtgtgcgtgtgtgtgtgtgagggagtcggagtttcactctgtcagccaggctgctggagtacattggcacgatctgggctcaatgcaacctccgcctcccaggttcaagtgattctcctgcctcagcctaccgggtagctgggattacaggcatatgccaccatgcccagctaatttttgtatttttagtaggggccgggtttcaccatgttggccagggtggtctcgaactcctgaccaagtgatccacccacctcagcctcccaaagtgctgggattacaggtgtgagccaccacacctggccatgagccaccaagcctggtcgagaccccatctcttaaagaaaaaaaaaagaatacttcgttctgagaaatgtctaggggtaggtattacctgcttatgaagtcatccatggcatttctggaaccatctgattgtatgaactgctttctaatcactctgtcagaataagttatctggacaaagtatcagagtacagtaagttccggttccatgccactaatcagctctatggccttagtcaaatcatttaccttccttatgttttagtttctttttctttctttttttttttttgagacaggatctggttctatcagcccaggctggagtggccaggctcaagtgatcctcccacctcatcctcccgagtagctgggactacaggctccagccaccatgccttagttttttggggttttttttgtttttttgttttttttagtgactgggtctacctatgtttcccaagtggattagtttctttttctgtaaagtaagagaatgatttttattatcctgtccagcaagacatagttattatgaacaatttttgctcgtgagtgtctacaaaatataataatggccgggtgcggtggctcatgcctgtaatcctagcactttgggagaatgaggcgggaggatcacgaggtcaggagatcgagaccatcttggccaacatggtgaaaccccatctctactaaaaatacaaaaattagctgggtatggtggcacgtgcctgtaatcccagctactctggaggctaaggcacgagaattgcttgaacccaggaggcggaggttgcagtgagccgagattgtgccactgcactccagcctggtgacagagcgagactccatctcatagtaataataataatgatgatgctttttagtatacttgattctgagctgctcgttttgttaaaattattttagggaagtttttgcccaaagttcgcggatacttctttcttcttaccaggccccaaagtcattgtaaatttttacaaggcagtggatgaacagttcataactccaaagatagatatcactcagaaaaatttttccacaagaagtccttttttttttttcgtcctttttttttttggcacactagtgtctcacttagcaagtccttttattttcaactcaagttaacaataagttggccgggtgtggtggctcacgcctgtaatcccagcactttgtgaggctgaggcgggcagatcacctgaagtcagaagttttgagaacagtctggccaacatgacgaaaccccgtctctactaaaaatacaaaaattagtcgggcatggtggcgcgcccctgtagtcttgctactcaagaggctaaggcaggagaatcacttgaatttgggagatggaggttgcagtgagccgagatcacgccactgcactctagcctgggtgacagagcaagactccatcacaaaaaaagaaacccaataagtagcaatcaggtatcacctgtgtttctcagcccttctcttctgctgctggtttactgccactcaagcagtggaccaaaaggcatttgtttctggccaaccaccatggacatgatctgatgactgcttttatctctgggacttgacctgtatccctctctctctcttttttttggatagcttttcattctgtctcccagggtacagtgcactggcacaatcatagctcactgcagactctgcttcccaggctcaggcagtccttccacctcagcttcctgagtagctgggactacaggcatgtgcaaccatgcccgactaatttttaattttttttttttttgagacgaaatttcgctgttgttgcccaggctggagtgcaatggcgcaatctcggctcaccgcaacctcggcctcccaggttcaagtgattctcttgcctcagccttcctgagtagctgggattacaggcatgcgccagcacgcccggctaattttgtatttttactagagacggggtttcttcatgttggtcaggctggtctcgaactcctgacctcagatgatcctcccgcctcggcctcccaaagtgctgggattacaggcgtgagccaccacacctggcctaatttttattttatttttttttgtagagatggggtctcaccatgttgcccaggctggcctcaaacacctgggctcaagcagtcctcctgccttgacctcccaaagtgctgggaatacaggcatgaaccaccatgtctggccctctctctctctcttttttgaaacctgatgatcgccaggcacggtggctcacgcctgtaatcccagcactttgggaggccaaggcgagcagatcacttgagatgaggagtttgagaccagcctggccaacatgatgaaacgctgtctctactaaaaatacaaaaatcagccaggcgtcgtggcggcacacacctgtaatcccagcactttgggagtctgaggcaggtggatcacttgaggtgaggagtttcgagcccagcctgaccaacatggtgaaaccacatctctactaaaaatagaaaaaaaaaaaattagctgggcctggtagcacacgcctgtaatcccagctacttgggaagctgaggcagaagaattgcttgaacctggaaggtggaggttgcagtgagcccaaattgcgccactgcactccagcctgggcgacacagcaagagtccgtctgaaaaaaaaaaaaaaaaacctggtgggttgctcagaggcagttacctatgtaacaagctggcagaaattctcaggataggcaaaaagataagaaccaaagaacatatccttccctttctaagtcataaaaattacttcctgtgaatgaaaagccaaaactttgcattaccaggccttgctattgatagtttacttggccagtgtattcacagagggaggaagcattgtcacatggcaaataaccagattacacccatagtctggttggcaggattgtacaagggtgcctgactaatcaagagtccacctgcttatttcttttcattagaatctaatatatttgctgtatagaatttagaaagttaagaaaagcgcaaagaaaataatctcactgctcagagataaccacagcagaattttgatatgtaatttagcctgtctttatatatctgtattttttataatttgggttatataatacaacatcattttgtaaccagctttttccacttaatacaacatcatggtgctcgctttggcagtacatatactaaaattggaatgatacagagaaggttaacatggcccctgtataatatatgcatgtttttaaaatacatcctgaacatgaatttttaatggttacctggtggcccatattaccatagtattgtcctcttttgttagatattgaattgtttttagtaaatagcactttatggaacatccttatatatacactcataatgaaatgatgggggattttttttttttttttttgagatggagtctccctctgttgcccaggcttgaatgcagtggcgcaatcttggctcactgcaacctccacctcccgaattcaaacaattctcctgcctcagtctcctgagtagctgggactacaggtgtgtgccaccacccccagctaattcttgtattttttttttttttttttttttttgtggagcctaggttttgccatgttggccaggctggtcttgaattcctgacctcaagtgatccacccaccttagcccccaaagtgctgggattacaggcatgagccactgcgcctggctgatcagggatttatttttttttttttttgagatggagtttccctcttgtttcccaggctggagtacgatggcacaatctcagcttactgcaacctctgcctcccaggttcaagtgattctcctgcctcagcgtcccgagtagctgggattacaggcgtgcaccaccatgcctggctaattttttgtatttttagtagagacggggtttcaccatggccaggctggtcttgaactcctgacctcaggtgatccgcctgccttggcctcctagaatactgggattacaggcgtgagccaccgcgcccggcctgatcagggatttatttatttttatttttttgagaatatgtttagaactagaatggatggttcaagagataatcatatatttaagacttttagaacatatattgccagattaccttccagaaaagatgtaccagtttttagttctaacaggcaaatgcctcttgcttcatactctccagccactgcgttttcgttgttggtagtaatgttgacctttgccaaataggataaaaatgttatcttttaaagtgtttatttctttgattattaatgaggtttaacattgttgcatatgtttgttgaccattaatatttcccacttgtaaatttgcctgttttctatcaacgtattaatctttttcttatagattttttttttttttgagacggagtctcgctgtgtcgcccaggctggagtacagtggcaccatctcggttcactgcaacctctgcctcccaggttcaagcgattcccctgcctcagcctcccgagtagctgggattacaggcatgtgccaccacgcctgactaatttttgtatttttagtagagacggtgtttcaccatgttggccaggctggtcttgaactcccgaaatcaagcgatccacccacctcggcctcccaaagtgttgggattacaggtgtgagccactgcacccagccttcttatagatttataagtgtattcatactactttttttgttttttaagacagtgtcttgacctgttgtataggctgaagtgcagtgacgcagtcacagctcactgtaacctggaattccttggcctacattgcccagtctggtcttaaattcctgggctgaagtgattctcccgccttaacctcccaaagtgttgggattacaggggtgagccaccgcatgtgacctcatgctgctttttttttttttccaactactttagtcagatgcttcttgagactattactagtcaaaaacaagatagattaaatggaggtagtgacaggacactgccctgtttgaggccatctattattggtgtgaaaagcaaacattacataagtaggtttagatagaaggtcattcactccagcattgttcataatagtaaaaaactagtcaaacacagtggttcacgcctataatcacaacactttgggaggccaagtcaggagtatagcttgagtccaggaattccagaccagcctgtacagcatagagaaaccacatctctaagaaaactttttaaaattagcagggcatggtggcatgtggctatagtcccagctactcaggaggctgaggtgggaggattgcttcagcccaggaggtcgaggttacagtgagctatgatcacactactgcactccaactcgggcaacagagcaaggccttgtcttttaaataaataaataaataaataaaaaggaaaataatatgagtaaactctacccatcagtggtaaataccacatatttctatcaatgttaggcagtcttcctagaataatcccattaaagaaaatccaaaatcgttgtatgaaaaaatacacaggtttgttccatgtgtaaaaatcttttaatcttggtacattttttatcaaaaacattcacactacttgaatacattaaaagagtacaaaagcattccaatgtacatatggacacacaaaacacagggaatgctttctagtgaaattaggagtaaatacaagaatgttaaaggagagagtctcatattaccagagtcagtgaattaattgcctttttttttttttttgagacagagttttgctctgtcacccaggctggagtacagtggcatgatctgggctcactgcaacccccgccttctgggttcaagtaattctcatatctcagcctcctgagtaactgggattataggcatgcaccaccacgcctgactactttttgtatttttagtagagatggggttttcgccatgttggccaggctggtttcaaactcctgacctcaagtgatccgcctgcctcggcctcccaaagtgctgggattacaggcatgagccaccacgcccggccattaactgctttttacaacacaaactatacctgtttggaattagtttttaaatatataagctacaggatgtacaaacaccaatgtgaacaactgtcagagaattttgtaattcaggaacatagcttcaagtgcttcataacatggaaagcaactcctaaaaatagtaattggcttaatttcttaaaagcattccagaaagtgatttgttacaattagcaacagaagaacaacattagaaataagaatactgggaacataagaactgaggtcctccagtaccaagagatagaatcaaactttttctcattagaatttaaagaatatagccacgcacggtggctcacacctgtaatgccaacactttgggaggctgaggcgggtggatcacgaggtcaggaggtcgagaccatcctggctaacacggtgaaaccccgtctctactaaaaatacaaaaaaattagccgggcgtggtggcgggcgcctgtagtcccagctactcgggtgactgaggcagaagaatggcgtgaacccgggaggcggagcttgcagtgagccgagatcgcgccactgcactccagcctgggagcgagactccgtctcaaagaaaaaaaaaaaaaaagaatttaaagaatatagttaaaggaaaaattcactgggctctgtgaaacaggttaaatatgtaaccacttcaaacagaaatgacttagtcctctcacctagttctgaaaatgtactaacatcccattttccatatcaaaagcacgtaatttcattagcaaaagcctctttgttttagacttaaaatcacctctgatccaccaaagtttatgcagttaccaaactactattttaataacattttgacagctttattaagataaaatttatataccataagatccatttaaagtatatagttcagtggcttttagtatatgcagagttgtgcaactatcaccacaatctaattttagaacattttcattactccagaaacaaccccagtaaccatttgtagtcacttcctatttccccctccccagccctaggcaaccactaatctactttctgtttctatttattttaataacatttcaaacttgtaatattattgttctcatgcttattctgggtcgttggctcagaggtttaaaagctcttaaactacccaaatttacaagtcctatgacatcctcattcagaaaacattcaaatgatggtttcataatgttatgatagttccatcttctaagagtttttgatctggagcatatgtttcaaattctatgtttgtactactgctaaattcacttaattagaagaagtaaaatcattctatcgagactcaagaatgagtttgttctgtttatgttaacgattccaggcttttgatggtaggaatggctttagcagtcttctgtggcacaccattatcttaaataatattgtcaccttccccactgtcttcatcctttggctcaaagtttggttcaatctgctgtggttaggcaagaaggctattatcagcagattggctggagctaccagaagtctgactgttcccagtaacattattctcctggttgctggtctcactgttaggatgaggtggctgctgtttgcactcatcatgtctgtttacttgattgagatgcttccctgaaacttatgtaccatcaacttctaaaaacttcatcattaacagttcatagttctgtgctgtgagccaggcctggaacaagccaggatataaaagatccctgggatgctctctaagccatgtggtgtctcccttaggctagaaccatcctggatatagagtcctaggggatgcttagttcctgggagaacatccacatctatgattgaagacacgggtctgaagtcttagggcatagcagtgactggatatagcctttttctgtggttgacaaaaccacagaaagagtttttttttttttttttttttgagatggagtcactctgtcacccaggctggagtgtggtggcacaatctcggctcactgcaagctccacctcctaggttcacgccattcccctgcctcagcctcccgagtagctgggactacaggcgcccgccaccatcccagctaattttttgaatgttcagtagagacggggtttcaccgtgttagctaggatgatctctatctcctgacctcgtgatccgcctgccttggcctcccaaagtgctaggattacaggcgtgagccaccgcgcctggccagaaagagaggttttaagtgacaatattattaaagacattctggagaaaaagatcacctataatcccgtcaccttaacattttctcgatttatttaatattactttccgagtcttgtctataagtatacattttcatacagtggtaatctggcgtgcattctaccttatatccttttccccattaaaataacctttattctacgtatttgaaaaccttggctgggctcagtggctcacgcctgtaatcccagcactttgggaggccgaggcgggcggatcacgaggtcaggagatcgagaccatcctggctaacacagtgaaaccccgtctttactaaaaatacaaaaaattagctgggtgtggtggcacgtgcctgtagtcccagctacttgggaggctgagacaggagactcccttgaacccgggaggcggaggttgcagtgagccgagattgcgccactgcactccagcctgggcgacagagcaagactccgtctcaaaaaagaaaaccttaaggctgggcgcggtggctcatgcctataatcccagcactttgggaggccgaggcgggcggatcacctgaggtcaggagttcaagaccagcctggccaacatagaggaaccctgtctctactaaaaatacaaaattgccgggtgtggtggtgggtgcctgtaatcccagccactcaggaggctgaggtgggagaatcacttgagctcaagaggcggaggttgtggtgaaccgaggtcgtgccattgcactccagcctgggcaacaagagtgaaactctgtctcaaaaaaaaaaaagaaagaaaaccctaataaaaaaaaaaaaagcagcctggcacagtggttcacacctgttatcccagcactttgggagttcgaggcaggtggatcacctgagatcagcagttcaattccagcctggccaacatgttgaaaccccatctcttctaaaaataaaaaaattagccaggcgtggtggcgggcgcctgtaatcccagctacttgggaggctgagacaggagaatggcttggacctgggaggcggaggttgcagtgagttgagatcacgccatttcactccagcctgggccataagagcaaaactctgtttcaaaaaaaaaaaaaaaaaaagggagaaatagaaacttttgtgtcgtatacagacaccagggttttgtatgtgcctttgtctctgtatcccccacctccacattcccacattctcgctagattagctgtcaacctcctctccttggcacctcctggtggctctctttacgcagttgactggactaaatgtatgtacatacatgtatactgtaaaaccttacatatcaccattgtagaatctcccaaacccttcatttaaacatgcaccattgcttgctggtcctttttgtcccattttttgcttccatagtgctattttcccaactactgttacccttaagattcctgacttcccagcccctttataccaaaagctttctttgacatttttctctttccgtgccttcctgcctttccacttacccagtacaaagcctgaagatgctttcacagagaagccttaaattatcccagcatactttattgcacccacaccttttcacttcaaaaacctttttgtcacccttgtctaatattcataccctattttcttctatattctcaattcatctgctccatatatacttgttttctgtggtatcattttccccacctccatttcacttagatcctatatttttttaccctatcttaccctttttgtttggtgccttcctccaaacccaaggtttctgtctttcatcagtcatccttccacctttcactcttaaactctggtaattctggttttcctccttctcaaaaagctcacactctgctaatgtgtatatattgttcacttgagtgcttctaaataaatatttacttttcaaaacagtgaaatctgaactattagcatggaaacaacctctgggaagataagatctccactcaaaagcttcaaattgagattctcctgctcatgttgaatgatggttttatctaatattttctgaaatagggtgactacttgaactacacaaaattgtgaaatgagaatatctttgattttatacttctatttttttttttttttttgagacagagtctcactctatcacccaggctggagtgcagtggcagtcttggctcattgcaccctccacctcccaggttcaggtgattctcgtcccttggcctcccaagtagctgggattataggcatgtgccaccacacccggctaatttttgtagtttttggtagagatggggtttcaccatgttggccaggctggtcttgaactcctgacctcaagtgatccacccacctcagcctcccaaagtgttgggattacaggcgtgagccactgtgcctggccacttacatctattttgattgacttgaaataaaatttaacacctcagggaaggcaattctcatgtgttttgaattatactgagcattaattcttcaggataattatagacttggaaaggtttaacccagtctcccagtccatgctgaagttcctttaagtgataggaggaactcataatctacaaggcaacccaatccatttggtgctaccatcgattgttataaagcccatccttgggttaaaatctactatttacagttgtatttaatgaccttaattctgccctcaagctatataaaatttggatctgttttctacatgataatcttttagatatcttaaggtagttagtctatcctctctacccttcccctcacagtttttccaccctttgagataaatatccttcgctattccaactatttctcatatggtatcatttttatcatcccgattgctccctaaggatgttaaactttgttaatgtcccttccaaaatgtatttggaactggaaataatatcccttggtagctgaattggatctggatgttgcacatctggacactaatgcagtctgaagttgctgtaagttttttagtcgacttgtaatgttggcttatgatgaatttgtaattaaataaaatcccaaggttttaatctggaggattgcctttaagtgatttcttcttaaactaagtctcaatcttcttttagttatgcaacagattttttttgtttgttttttgagacgctcgctctgtcgcccaggctggggtgcagtggcacgatctcagctcactgcaacctccacttcctgggttcaagcaattctcctgcctcagcctcccaagtagctgggattacaggcatccgccatcatgcctggctaattttctttctttcttttttatttttttttagtagagacggggtttctccattttggtcaggctggtctcgaactcctgacctcaggtgacccaccctcctcagcctcccagagtgctgggattacaggcgtgagccatcacgcccggccttttttgagatggagcctcgctctgtcgcccaggatggagtgcagtggcatgatcttggctcactgcaacctccgctccccgggttcaaggcattcttctgtttcagccttccgagtagctgggattacaggtacctgccaccacgcctggctaatttttgtatttttagtagaggtgggggtttcaccatgttggtcaggctggtctcgaactcctgacctcaagttatccggccaccttggcctcccaaagtgctgagattacaggcatgagtcaccgtgtccggcctatgcaccagatattttttaaaaaccagatgtaagactttatacttatccctattaaattttatctcattagcctatcaggtagccttggtttttttcttttcttttcttttctttttttttttttttttgagacagagtttcactcttgttgcccaggctggagtgcagtggcgcgatctcagctcactgcaacctctgcctcccgggttcaagcgattctcctgcctcagtctcccaagtagctgggattacaggcatgctccaccacgcccagctaattttgtgtttttagtagagacagggtttctccctgttggtcaggccggtctcaaactcccgacctcaggtgatttgcccacctcggcctcccaaagtgctgggattacaggtgtgaaccaccatgcccggctgttttttttaagactagtcaagtgcagagtgagaaggggggaaagagtagaacaaggagtttgatcagccttggtttctttgaatcttgatttttgtcatccagtttattgtgctgattcaacaaagggccttgaagctaatgttggaatgttttcagacatataggaaatgataattcatcaaaagtcatggagactatattccaaaagttttatgcagatataactcagctgttgaggtatatgagttaataccactataaattgacatggccaggaaagactgaagtccattgccagcttgctttgtgttgaacattactccaaaagagattaaattttaaggcatattgtgtcaacataaaggcaaaagagctggctaattcttctcaagaaatcaattaatggcagggcgcggtggctcacgcctgtaatcccagcattttggaaggccgaggcgggcagatcacctgaggtcaggagttcaagaccagcctgaccaacctggagaaaccccgtctctactaaaaaatacaaaattagccgggcatggtggcgcatgcctgtaatcccagctacttgagaggctgaggcaggataattgcttgaacctgggaggcggaggtcgcatgaaccagtatcacaccattgcactccagcctgggcagcaagagcaaaactccatctcaaaaaaaaaaaaaatcaattaatgcacgcataatatagagacagagtcattgttaccattctcttattttgcctttgacaagtttatattgagcatgttatcaggcaatgtgggagattctggagaaccaggtttgcctcataactagggttaccatatactctagtttgcctggggcaaccctgatttatgcctgttgtcccagtgtgattattactagtgtaatttttcactttgagaagtgtccaggtttggaggataaattatctttctaataattgatacccttctcataacctaacgggttccttttagtattttatctgggttaaaattaccagctgtaatttggcagctctaataagactgcagcaatacttatcttccatttgaacagattgttacttgaccaagggaagttaatagcaaaagtaactgcagggcacatgtatgtcatgggcaaaaaaaaaaaagtaacagcaattaaggtttgcaggtacttagaatttttcctgagccaccctctagagggcagtgttacatatatatctgtaattatccagttacaacaaaaaaagggctctcattcatgcatgaaaatcagaaatatttcatactcttaaagaacacattggaaccaatattatgattaaaacatattttgctaagcaaagagatattaaaaattaattcattaacattctgaacattttttaacttgtaaaaacaactttgatgccttgaatatataatgattcattataacaattatgcatagattttaataatctgcatattttatgctttcatgtttttcctaattaatgatttgacatggttaataattataatatattctgcatcacagtttacatatttatgtaaaataagcatttaaaaattattagttttattctgcctgcttaaatattactttcctcaaaaagagaaaacaaaaatgctagattttactttatgacttgaatgatgtggtaatgtcgaactctagtatttagaattagaatgtttcttagcggtcgtgtagttatttttatgtcataagtggataatttgttagctcctataacaaaagtctgttgcttgtgtttcacattttggatttcctaatataatgttctctttttagaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtaaactttattataaaaccaataaatagcttcccaagtatgccagggctcataaaaagtaaatagatgcccttagccccctgaactggtaaatatttaggtataacttggcatgattatatatatatctgtattattccgtgaactcttatgttgaacctgtaatgtaactactgaatttatgtgaaaaagactaccatattatgagtcatgcttctcttcatgtaattgtttttaggaagtagataacttgcaaaagatggtagacatccccaatagcaaaatgggtctaatagtaatattaaccatcatttattgagcacttactataagtgctcaatacatatacttcatgcattttctctaagcttcacaatagctttgtttgtttgtttttgagacagagtttcgctcttgttatccaggctggagtgcaatggcgtgatttaggctcaccacaacctccacctcccgggttcaagcgattctcctgcctcagcctcctgagtagctgggattacaggcatgtgccaccacgcccggctaattttgtatttttagtagacacagggtctctccctgttggtcaggctggtctcaaactcctgacctcaggtgatccacccgcctcggcctcccaaagtgctgggattacaggtgcatgcaccatgcctggctaatttttgtacttttagtagagacagggtttcaccatggccaggctggtctcgaactcctgaccttgtgatccgcccgccttggcctcccaaagtgctgggattacaggcatgagccactgcgccggccatatgagtactttcaaatggactgtggtagacatttcaggaagggccattggagtgattgcttctaaagatattttaaaaagttataccattatatatttgacccatttattttaagattgaataatgcctataaaatattggttatttcgaaagattttatttatgtaccatcatatagtaatcttgaaggtttgtttagtgtcatgtagctataaacttagagaaacttacaatttcattatgtagaactttaatgttactaatacttgaaacataacttgttttaaaatttcacagtttgaaacagtaaggacaatattggtggcccaaataacatactaaaaagaaagtatggccgggcgcggtggctcccgcctataatcccagcactttgggaggctgaggtgggtggatcacctgaagtcaggagttcaagaccagcctggccaacatggtgaaaccccgtctctactaaaaatacaaaaattagctgggcgtgatggcatgcgcctgtagtcccagctacttgggagactgaggcaggagaatcacttgaacccagaaggcagaggttgcagtgagccgtgatcgcgccattgcactccagcctgggcaacaagagtaaaactccatctcagaaaaaaataataataattaataaataaataaataaataaataaataaataaatgaaaataaagtatgccaggtacagtggcttacgcctgtaatcccaacactttggaaggccgaggcgggtggatcacttgaggtcaggagttcaagatcaggctggccaacatggtgaaaccccatctctaccaaagatataaaaaattagccgggtgtggtggcgcatgcctgtaatcccagctacttgagaggctgaggcaggagaatcgcttgaactcaggaggcaaaggttgcagtgaaccaagactgcgccattgcactccggtctggggaacagagccagactcagtctcaaaaaaagaaagaaagtaacaattttagtttttaacataaaacttgggcagttttatttttgtcttctataaaaatacctcacattgaatcagtgaatttagtgtgtatttcttcctcaaaggataaaaatcatatctgttacttagatgtgaatttgaatgtcttgttttaagctgtgagattttcatgttttttagatgtgcttaatttttaggtgttaaatgaatatttttgtgtaagcttctaattgcacaaatacatatattcctgtgtgttttcgtaggtgaaggtgataaagtaaagtgctttcactgtggaggagggctaactgattggaagcccagtgaagacccttgggaacaacatgctaaatggtatccagggtaagatatttaattgttcattgtacaggcaagttggatagcatgcagtgggagacttgaattactttttacctcaactatttttgccttcactatggcttgaaattcatgctaggtttataaaaatgagcaaggtttataagccttctctgatgaccaaaaacattcactgcttatgtgtgatatctataacattcagattatccctttttttttttgagacgaagtctcactctcttttgcaggctggagtgcagtggtgcaatcttggctcactgcaacctctgcctcccaggttcaagtgattcttgtgcctcagtctcctgagtagctgggattacaggcacccgccactgccaccatgcctggctaattttttttttttttttttgatatggagtctcactctgttgccaggctggagtgcagtggtgcgatcttggctcactgcaacctccgcctcccaggttcaagcgattctcctgcctcagcctcccgagtagctgggacaacaggcaagtgccaccacgcccagctaattttttgtatttttagtagaggcagggtttcaccatgttggccaggatggtcttgatctcctgaccttgtgatccgcccgcctcggcctcccaaagtgctgggattctggctaatttttgtattttttagtagagacagggtatcaccatgttggccaggttggtcttgaactcctgacctcaggtgatcggcccgcctcggcctcccaaagtgttggcattacaggtgtgagccactgcgcctggcctctagattatcccatttctttttttttttgagatagagttttgctcttgtcgcccatgctggagtgcaatggtgctatctcagttcactgcaatctccgcctcctgggttcaagtgattctcctgcctcagcctcctgagtagctgggattacaggtgcctgccaccacgcccagctaattttttatatttttagtagagacagggtttgaccatgttggtcaggctggtctcgaactcccaacctcaggtgatccacccacatcagcctcccaaagtgctgggattacaagcatgctccaccttgcttggcctctagattatccaatttttaaatacagattaggaaatgtgtgcttttttgttgttggaagtaggctcttttatgatcagcgtgagagcccatattgccaaggagattccttaagaagccatcatacccctaggaaatattaatgtatctcattatctctatgacatacagttgttcacatttttttttttttttttttttttttttttttttttttgagacggagtctcgctctgtcgcccaggctggagtgcagtggtgcgatctcggctcactgcaagctccgcctcccgggttcacgccattctcctgcctcagcctcccgagtagctgggactacaggcgcccgctaccacgcccggctaattttttgtatttttactagagacggggtttcaccgtgttagccaggatggtctcgatctcctgacctcgtgatccgcccgcctcggcctcccaaagtgctgggattacaggcgtgagccaccgcgcccggcccagttgttcacattttaagatctctggttggagtgtggtggctcgtgcctgtaatctcagcactttgggaggctgaggcgggtggattgctggagcccaagagtttgagaccagcctgggcaacatagtaagaccctgtctctacaaaaaatacaaaaaaaaaaattagccagtcatgatggcacacacctgtagttccagttactcatgaggctgaggtaagaggatcacttgagctggggaggcagaggttgtggtgagctgatgccactgcactcggcgccactgcactccagcctgggcgacagagtgagacactgtctcaaaaaaaaaaaaaaaaaactagccgggcatggtggcttacgcctgtaatcccagcacttcgggaggctgaggcagggagatcacttcaggtgaggagtttgagaccagcctgaccaacatggtgaaaccctgtctctactaaaaatacaaaattagccgggcgtagtggtgcatgcctgtaatcccagctactcaggaggctaaggcaggagaatcgcttgaacccggaaggctaatgttgcagtaagccaagatcgtgccactgcactccagcctgggtgacagagcgagactctgtctcaaaaaaaaaaaaaaataacaaaagtcaaggtgctaatttaataacttgttttagaaagttctcaagttgatattttttgctctactaatattagcataggtagcataacagagggaacttttttaaccttaaaatgacagtgggatagggaattgggtaacattttactttgtggctccttagaagtactgaaaagcaagttaatggaattaatagaattaatatgatggagattatatctttgcttatacttcactaatttatcagctactaaagtttaatcttttaattgtttaggtgcaaatatctgttagaacagaagggacaagaatatataaacaatattcatttaactcattcacttgaggagtgtctggtaagtctcatataatttatattttcaaattcacatttcaaattataatttatattttcattatgtagtttatattatatcatttgttttatagttatttcttcatgtgatattcacagtatagtattataaatcaatatatgtgtacattacatcaaaacacaaattttaagttaaaaacaaaataataaatgtatgatgggctttaaagatgagagctagctgggcagtgtttcacacctgtaattccaacattttgagaggccaaggtgagaggattgcttgagcccaggagtttgagatcagcctaggcaacatagtgagaccctgtctctacaaaaaattttaaaaaccaattagccagacttgtggtacatgcctgtagtcccagctacttgggcggctgaggcgggaggatcgcttgagcccagaaggtcagaggattcagtgagccaggttcattccactgtactccagcctgagtgagaaagggaaaccctatctcttaaaaaaaaaaaaaaaaaaaaagagagagcctaaaaagtgtttcttattctttacctgaagtaaatttgtcaaaagataatcaggatgaactgatttaagtatcattgtaggcaaaaatgggcttgaagaactaaaatattaaaagtcccttagccttctgaaattagatctttgtataatgtgctttgtactcataagtagttttaagtttttgcagacaatatttaaaatctcaaatatatctaaattgataggatgggcgctgggcacggtggctcacgcctgtaatcccagcactttgggaggccgaggcagatggatcacccaaggtcaggagttcgagaccagcttggccaacatgatgaaaccccgtctctactaaaaatacaaaaatttagctaggcgtaatggcgggcgcctgtaatctcagctactggggagactgaggcaggagaattgcttgaacctgggaggtggaggttgcagtgagctgagatcacgccactacactccagcctgggcaacaagtgtgacactccatctcaaaaataaataaattaaataaataaataaattgataggatgaattgaggtggccaaggcatcagtaataggtggaaagaaccctggactaaaatgggagactagagttgcccccagtgactctaccttgaagtcattcattctccctgggcctcagctttttgtttgtaaaatgaagggattagattagataatcttatgacttccttctagctccatcaggctatgcctcttgtgaatattcatatattgaattggaataaagccaatttattttaaatttatgattaatttcacttttcaaatggaaatgattgcctctaccaaaaataattctaacttacagttcctatttctgttacaggtaagaactactgagaaaacaccatcactaactagaagaattggtaaatatgcttgttaactatccttttaatttaactgccaatttatttatttatttatttatttagagacagagtctcactctgttgcccaggctggagtgcagtggtgcgatctcagctcactgcaatctctgcctcccgggttcaaccgattctcctgcctcaacctcccgagtagctgggactacaggcctgcgccaccatgcccggctaactttttatatttttagtagagacggagttttaccatattggccaggctggtctcaaactcctgatcttgtgatgcgcccgcctcggccttccaaagtgctgggattacaggcatgagccaccgcacccggcctttaactgccaatttattatagttgttatttatggggtggaaagataagcatgttcttccaaggtcaccatgatatatttatttcagatgacattactataaatttaagaatttaggcggccgggcgtggtagctcacgcctgtaatcccagccctttgggagaccgaggcaggccaatcacgaggtcaggagatcgagaccatcctggctaacatggtgaaaccccgtctctactaaaaatacaaaaaaaaaattagctggatgtggtggcgcacacctgtagtcccacgtacttgggaggctgaggcaggagaattgcctggcctgaacccaggaggtggaggttgcagtgagccgagatcatgccattgcactcaagcctggcgacagagcgagattccgtctcaaaaaacaaaaatgaaaaaaataatttaatgaagtacttataaattgcagtcagaggctgggtgcagtggctgacacctgtaatcccagcactttgggaggccgaggagctcaagaccatcctagccaacatggcgaaaccccatctctactaaaaatccaaaaattagccgggcgtgatggtgtgcgcctgtaattccagctactcgggaggccgaggcgggagaatcgcttgaacctgggcagtggagattgcagccagctgagatcgtgccagtgcactctagcctgggcaacagggcaagactccatctcaaaaagaaaataaaagaaaaaaaaatcagtcagacgtgtctgtattaaaaatgttagtaggccatcagatagtttttccaagttcaggaggaacactgataggttgcctcattgccatctctgctaaaatcacaagagaaagggtgaagtgtctttttgtacctggggttccttaagtaagccaaaattatttcagttttctactagtgtgccattaccctgataagccctaacccacctgcttctttatcccatactgtcattgtaccttccccagcttcttcacagaggtgtaagttttggtttgtttacctcctgttacctcatggagaagtagaggttttaaaactcaaaaagtgggcagagaaagatattatgctaagcaaggaaggtaattgttatccccacttttcagatgaagaaagagtcagagaggttaagtgacttgcgcacaatcacattacaaatagttagtggaactaggaccacaagcaaggtcttctgaatcctacatcacagggcagatctcattttcaacttaggcatatttcaaaagtagtagaaagtttaatttagaatatgtctagtgattccccacttcctaaactggtaccatcatctatttagtatcttaagaattacaagcggctgggtgtggtggctcacgcctataatcccagcactttgggaggccaaggcaggtggatcacctgaggtccagagttccagaccagcccggccaacatggtgaaactccgtctctactaaaaatacaaaattagctgagtgtggtgctgcacgcctgtaatcccagctacttgggaggctggggcaggagaattgcttgaacctgggaggcagaggttgcagtgagccaagaccacgccattgcactacaccctgggcaaaaaggagcaaaactctacctcaaaaaaaaaaagaaaaatacaaaaattaccagggcgtggtggcacacacctatagttccagctacttgggaggctgaggcataaaaatttcttgaacctggaaggcggaggtttctgtgagctgagatcatgctactgcactccagcctgggtgatggaccgagattctatctcaaacataaataagtaaataaataaataaataaataaataaataaataaataaaacataaattcagctccatgactgctcctgcagagcagggctacccactacgcagtgagtggcattactactatttaattgcagaacactatcattaccccaacaagaaactccatgctcacccatcaacagtcattctccattgcccaccctacccctaggccagggcaaccagtaatctactttctgtctctatggacttgcctattctggacatttaatgtaaatggaataatgtaatatgtgtcctcaaggtgtatccatgttgtagcatatatgagtacttcattcttttctattgtagaaaaagagtccattgtataaataataccacattttgtttatccatttgtcagttgacatttggcttgtttctactttttgactattatgaatgatggttctatgaacatttgtgcataagtttttgtatagacatgttatatacccagttctcttgggcatatatccagggatggaattgctgggtcatgtggttattctatatttaaccttttgataaactatcagacagatttccaaagtgactgcaccctttaacattcctaccagaagtgtatgaggatttcattttctctacattcattatctgtcttatttatcacagccattctagtggatgtgacatggtatctcattgtggttttgttttgcatttccctgatgattaatgatattgagcatcttttcatgtgcctattggccatttgtaaatctttgtagaaacgtctgttcatctcctttgacttttttttttttttttgagacggagtcttgctctgtcacctaggctggagtgcagtggtaagatcttggctgattgcaacctccgcctcctgggttcaagcgatcctcctgactcagcctccctagtagctaggattacaggtgctcaccaccatacctggctaatttttgtatttttagtagggacggggtttcgctatattagccaggctggtcttgaactcctgacctcaggtgatccacccacgttgggctcccaaagtgctgggattacaggtgtgagccaccatgcccgacccattttttattttttcttttttttgagacagggtcttgctcagtcacctgggctggagtgcaatagtacagtcatgctcactgtggcctcgacctccctggctcaagcaattctgctgcctcagtcttccgggtagctgggactacgggtgtgcgccaccacacccagttaatttttgtattttttatagagagaaggtttcgccattgttgccctggtggtctcgaacccctgggctcaaacaatctgcctcccttggcctcccaaagtgctgggattacaggtgtgatccactgtgcccagccttgaccattttttatttgggttgtcctttttctactgaacagtctagggggatgggttatctttttgttattgagttaaaagagatctttatatattacagttcttttttttggcttcttttactttctaaatgaagatgatagttatttatatataaaagttcctgtcagatttatgatttgcaagtattttctcccattctgtgggtttccttttttttttttttttcccaagacggagtcttgctctgttgcccagtctggattgcagaggcatgatctctgctcactgcaacctccgcctcccgggctcaagcaattctccttccttagcctccagagtagctgtgattacaggtgtgcaccaccatggctggctaattttttttgtatttttagtggagatggggtttcaccatgttggccaggcttgtctcaaactcctgacctcgtgatctgcccacctcagcctcccaaagtgctggaattacaggcgtgagccactgcacccggccacctttttcactttcttggtgttcttcgaagcataaacgtctttaatttttttttttttttttttttgagacggagttttgctcttgttgcccaggctggagtgcaatggtgccatctcagctcaccacaacctccgcctcccaggttcaagcaattctcctgcctctgcctccccagtagctgggattacaggcgtgcaccaccatgcctggctaattttgtatttttagtagagacggggtttctccatgttgaggctcgtctcgaactcctgacctcaggtgatccgcctgcctcggactcccaaagtgctgggattacaggcgtgagccaccgtgcccagcgaaacatctttaatttttatgacatccaatttatctatttttctgtgtgtgttgctcatgcttttaatgtcatatttaagaaaccattgcctaatccagggtcaccaaggtttatacctatgttttcttctaagagttttatggtgttatatcttacattctggtctttgatccattttgagttaatttttgtatatggtatcaggtaggggtccacgtcctttttgtttttagcaagttgagtttgagatacctgcaggacattgaagtaggaggataataaaaccttgtataaaggagagtaagatgttgctggtagggaaagtgtctggaaagactttttttttttttccggagacggagcctcgctctgtcacccaggctggagtgcagtagtgcgatcttggctcactgcaaccaccgactcccgggttcaagcgattctcctgcatcagcctccccagtagctgggactacaggcacatgccactgcgcccggctaatttttgtatttttagtagagacagggtttcgccatgttggccaggctggtcttgaactcctgacctcaggtgatccacctcagcctcccaaagtggtgggattacaggcgtgagccactgtgcccagctggaaagaccatttttcagaagggtcgatgagggaatggaagggagccaccaacatctaattaggtgggcacaagtaatggagcaacaaaacaaactgaaaataaaaacaagtcaaagataggagaagcaggaaagagcaatgtctagttgccctctggacatttccacctagaatgcatctctaaaaaccactcagactgaatctaatcctgcacttttttctcctgtattggttaatagtaccacagttcacaaggttgcccagtaatttatgttgttcctaagctctttgctctctgtaatccttttacatttaattaatcatcaaatttgatggattccacctttttaatgttgcttcagactttcccacttattctgctctagttcaggcccttccttgtttttcaactggacaattgtagtagtctcctaactggtcttttgtctgtattataacctgccaacagagtttttctttttgtttgtttgtttttgtttgttttgtttttttgtttttctgagacggagtctcgctccgtcaccgaggctggagtgcagtggcgcgatctcggctcaccgcaacctccacctccgggggtcacgccattctcctgcctcagcctcctgagtagccgggactacaggcgcccaccactatgcccgggtaatttttttttttattttttggtattttttgcagagacggggttttgaactcctaggctcaagcgatctgcccgtcttagcctcccgaaatgctgggactacagacgtgggccaccatgcccagccttatcttttatttttattttttaatatagatagggtcacactttgttgaccagggtggtttcaaactccaggcctcaaggaatcccccttggcctccccaaagtgctgggattacaggtgtgagccactgcacccagcctcctctctttcaaaaaacatttattgagctataatatacatacagtagccgggcgcagtggctcacgcctgtaatcccagcactttgggaagttgaggcaggtggatcacgaggtcaggagttcgagagcagcctggccaatatagtgaaaccccatctctactaaatatacaaaaaaattagccaggcgtggtggtgcatgcctgtaatcccagctactcgagaggctgaggcaagagaattgcttgaacctgggaggtggaggttgcagtgagccgagacgcgccattacactccggcctgggtgacagagcgagactacgtctcaaaaaaaaaaaaaaaaaaaaaaaaaatatatatatatatatatatatgattttatatatatatgattttatatatatatgattgtgtatatatatatgattttgtatatatatatgattttgtatatatatatgattttgtatatatatgattttgtatatatatatgattttgtatatatatacacacgcacacatacacacataaagtgcttaaagtaccctaatcgtaagttttctacttgatgaattttaacatatatatgttaaaatatatattaaatatgtgttaaatatatattaaaatgtatatgttaaaatatatatatttatctgtgtgactatcccccagattaagatatagaacattcccacaaccctagaaagttctttcatgctccttccccatcagtacccacccccaagttatattctggcttctattaccatagattaattttgtttattaccatagattagttttgaagttcttataaatggactcatgcagtaggtactcttttgtgtcataatgatgaattatgattatgttttgctcattatatctatgagatccatccatattgtctgtggcaatagttttttttttttttcttgctgtgtagcgtatgaatataccacaatttatgtatctgttcacctgatgatggacatttgagttgtttccagtttggggctattataaataacactactatgaatactcttgtgcatatctttggcagagatatacactcatttttaatacccaagagtggaattgatgagtcagagggtataagtgtcctctcctagcacttccctacacatgctgtgttcctactttaagtatcataaaaacaagtttccattgactttcttgctttattcagtcctacccgctctgctacagaaacgaagtttgagagctaggaaattgacacattcaaggttatagactgggacttccctgatttcccatcattttccccaaataattgctagtgactcagtaacaacatccactctttaagtaacttaggttaattgttaatgagtacagctagattcaaaacagttcagatttttgaagcacttaacctttttcttgcctattttaccttgcatcgtttcaaacactacaaaatacatactcattgcatttacaattaattgtaagattctgaaagtgatttttcagtgcctgaatacttcaaaaaatcttcccaaagcagctttgctttgctggtttgtttttattctttcgcttgctccttaattttttcattttaactatattttgctattgagttgtgataatgaaaataattgtttaaattctatgttctttttcctcaccaatttttatttcagatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaaggtatgcattgctgtttttaaaaagcaagaaagggccagatgtggtggctcatacctgtaatcccagcactttgggaggctgggacaggtggatatggacattttttaaacgtaaccttaatgctgtgtgttagtctgctcaagctgctataataaaattccatagactaggtgtcttaaacaacagacttatttctgacagttttggaggctccaaaatcaaggtgctggctgatttggttattgatgagggccctcttcctaccttgcagatggctgccttctcactgtgtcctcacatggcatgggttgggattggatgggacaagatggagcaagtactctggtctcttttcctctacttttaggaacactaatcccatcatgggggggtctcatcttcatgacctcatctaaacctaattacttcccaaaggcctcatttccaaatatcattacattaatcatggaaaaaagattaaaaatatgagttctaccagcctggacaacataatgaaactgtctctacaaaaaatacaaaaattagccgggcatggtggtgtgtgcctgtagtcccagctccttgggaggctgagcggggaagatcacctgagccagggaggtcaaggctgcagtgagccatgatcatgccactacacttcggcctgggcaactgagcaagatcttgtctcaaaatatatgtatctctcctttaaggatgatggacactgtagtgcttgccaacaacatcgaaggttaaagaagaagtttcaaactgagtacacttttgggtactttacctgtaatagttctctaagctcttgaccatcctccctccaaaaagatgagaattctcctactgctaaaaaaacttaaacgtttacttatttttgacgcatttaagatccttttgatctttaagatatttcaagtgcttttgaaacactattcagataatcgtataagttatgaaacagtatgaacattaatgatatttaaaattatattcattgatgtaagaatcaatggaaagcttccaattttttccttatagatgcatttatttaaaacttacacaagctccacttatcttggtggtggtaaaataaaccctttaattgtcatctttctttctttttttaattttttatttgttttaagacggagtctcactctgtcgcccaggctggagtgcaatggcacgatcttggctcactgcaacctccgcctccccagctcaagcgattctcctgcctcaccctcccgagtagctggaattacaggcatgtgccaccacgcccggctaattttttgtattttcagtagagacagggtttcgccaagttggccgggctggaatttttctactataacagaaacacaagcaattgtgtcatttttttcctgcatcttaaacacgcgcttaattgtttggccataaattgttagttttcaaaccttaatgtatctgcagcagaagggtttagcaggttgtaataggaagagatcaagagactgtgcattagggagagtgtcttttctctatctaacaggagtcaatgggcgctcatattatcactgagactacaaactaggatggtgtgggaaggagagcctaagggttggaattcatttgaactctcctcagtctcactaaattgagaggcaagtaattgatacaggctctctactcatgctgggactgctgcctatttgtcttcccaaaagctgatgaggaaagactggcactaagaatcttttaattttatataaaataaggatggggctaactgaagtgaagcaggtgagggttattagagaaaatataacattgtcacttactgagaaatcctagatttagtgctaaacttttttgccaatggctgtgtaacagagaatgccctagtaaaaggtcttgtaaaaatagtaccgaatcagtatctttttttctttctttgaaaaaattatgtagtgtaagataaagccctttatttagtatatgtactaaagtacttattttaatctttatgtgtatatatattactgtatataatataaaaatcaaataacccatattcatttcttatctgtctttccatatgaatctgctctaatagtaaaatgaataacatcagtttattctagaagaggttttaaataattacaaatattagcaaataacatcaaaagttatctagcctttattgctcatgtgccagtaaccttctgacctagaagagggctttgtggggaggagaaggggaaaggcgctgtagagaagtatgtagaatccagtagttacctttaagccaagagggaagtaattgccagtggtaaactactggtctgaggggaaaagatctatgcccagaatatcaccatctcaagttagtggctttatacaaggatgaaataatatagaaaaaaatgagatgatatggtatcacaaacaatcagaaccaaaggaaccttaaagattattttataattttttttttttttttttttttttggagacggagtttcacttttgttgcccaggctggaatgcaatggtgcaatcttggctcactgcaacctccacctcccgggttcaagcaattctcctgcctcagcctcctgagtagctgggattataggcatgtgccaccacaccctgttaattttgtatttttagtagagacggggtttctccatgttggtcaggccggtctccaacttccaacctcaggtgatctgcccgcctcggcctcataaagtgctgggattacaggcatgaaccactgcacccagcccattttataacttttatgaccttaattgggaacctgaagtacagatgggctgttgcctaggatcacgccgatagttgggaatagaattcagatttcctgacttctggtccagtgttttggggtttgtttcagtttttttttttgttttgttttttgttttttttagattttaaaaaattgtgataaaatacacatacagtttaccatcttaaccatttttagtgtatggttccgtagtgttaagtacatttacattgttgcacagtcaacctccagaactcttcatcttgcaaaaccgaaactctacatccattaaacagccaggcgtggtggcacacgcctgtagttccagctgcttgggaggctgaggcaggaggattgcttgagaccaggagctcaaggctgcaatgagctgtgattgcaccactgctctccagcctgggatacagagcaagaccctatctttaaaaaataataataataataaaaacatgttcattaaacaactccccattccctctcttcccaacccctggcaactaccattttactttttgtctctataaatttgactactctaggtgtcagtattgttgttgctttgtttgtttgtttgtttcttcctttttgtggagaacggggtctcactatattgctcaggcaggtctcgaactcctgggctcaagctatcctcccgcctctgcctccctgagagctgggattataggcgtgagccaccgcgcccagcctgtttgtttgtttttaactcgttgtagcattacatctaaaagtaatgtggaaattacttgttctccttttgatttttttggcatgaaatacacacttcattctgactttttttggtgttgatgctttcttataatataaatcagcttatagtgccgtttctttacttgtattttttcctctgccttgagtacgttttctctatctgtatacctagtcccattccccactctacccccaactccctgaatctactttgtgaactcatgtttcaaggttcagctcagaagtcacttctttcaagttttctcccgcacccacagcagagttaggagctccttcttatctactcctggtgctggtagagttttgttttgttttattttgttttgttttgtttttcttgagacagggtctcgctctgtcgcccaggctggagtgcagtggcacacaatctcagctcactgcaacctctatctctcaggttcaagcgattctgctgcctcagcctcccgagtagctgggattacaggcatgcgccaccacacccagctaattttttttgtgtgtatttttagtagagatggggtttcaccatgttggccaggctagtcttgaactcctgacctcaaatgatctgcccgcctcagcctcccaaagtgctgggattacaggcgtgagccaccaggcctggctgagcattttgctttttacactattttgggactggtttctgccctgcccattagaccaagcttcttaagggtaagtgctttatcttcttatctctgatgcattccatgtttgagcctatagtttttattatgcccaagagggtactttttaagaagaaagagattaaacaatcctttcctctaccccctagccagagaaacctttctgagacatagatgtgatcatatctgtctctagtttaaaacccttcactgcctcccaggacccttgggatcaagtccaaactcctttacgtggctcgcctaatctttcatgatcaggcacccttttgtagcctcatctcatgctattttctcaaattctgtgcccaagctttgcctgtgcacttgtaggccacgttctgtctctctccttggagcttgtttatgctgtttcctttgcctaaaacacttttctcccattgcccttatcccccaaggcctccttctcctagtaaactcctaattcattcttttgtacccagttttaggtataatttcctccaggaggccttcgtttatgcatgcatgcacacacacgcacacacacccttcctgtgctcttcataacacattgtaattacctttgtcatcataccatttatactttcctgtttgcttgtgttctttacttgtctatgaactattgggggcctgaggtttatgtatttgttaattgtatccctagtacctagaacctagttaagtgtccagtaagtatttcttgaataaactattgttttccaaacatgttttcagaatagtgttcagcaggatgttaaaaggatgccatgaaaaaggaaccccatagttaaatagggaaatgccttgtacatttctaagagggaacatagactatactgtcctatattgtactgtactgccctgtcctggatgacagtggttctcaaacgccagtgtgcccaaccccagaaattttagattctgtgaatggagcccagaaatccgtggtttaaaaatgccccaggttattctcatgtgaggccatatttggaaaccactggtacataatgattataaagatgctaaaataaataaatagttgtgatcacaaaggtatagttaaaatatgtaatgcatttggaatagtgcctagcacgtactatttatgcaatattactggtaactgctgctgctgttgtcattattgttatatgtgaccatgaaacacatgttttgtggcatatttattcacatttcacaaaactattttgggaaaggctgaattaagcaagtacttcagtgccacctatatgctgatgacatccagatctctatctctagccctgacttctcctgacctcaagatttgactcttcagttgcctactggttatttttatatgggtgtcctgaaaacacctcaaaaatatctgaagatcccaaacctgtacctccttttatatttcttattggcatcaccatatccttgtcagccaagctagcaatcttgtaatcaactttagtttgtctttcttcttcagccctcatatccagtcagtcacccaatcctacttgtcccacttcagaagtgtccctcaaatccatccctctatttctggaattagtcgtgacctttccatatgctgctccttttacctaacccttgtttttctgcctggcaaatgactgtccatgcttaaatgtcactcctccacttccctcctcccccgatccagccactgccaacctgtgaagccttctccaactagcctgagcagaagaacttgttttctcatcttgtcccagagcactttgtacataactttattatagcacttatcactttgtactttgtgcttaacctcctagcctcatcttacatcctctcccactagcgtgtgagctatttaagagcagatgccacgggtgagtcatcctcatatctcccggcacttgttgggtgcttggcacgtagtaggggctcaataaatgttttcaatgaatttaaacaactaagagagtctaaaactagcataattattttctctttttgcagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaattatatcata

SEQ ID NO: 2165 - DNA, 53813 bp, Homo sapiens
  source 1..53813: mol_type = genomic DNA
gctggggccaagccgcagagcggagttggcatttccagattggggctcgggccgcgcctcctccgggaccctccccttggaccgagccgatcgccgcggggcagttcgggccggctgtcctggcgcggtgggtacagcttgtgtaggctttcccctcccccgctttccctccttcccctctcctccctcccctcttcttttcccctccacttccctcgggccggcgctgctggggagggcgggaaggccgcgccagcccatcaggggtggcccggccccggctgcttgcccgggttcctcggactgccgacggcaggcgtgggtgggtgggtgacttcaggcctgcaggattgccttcctaaaccctgtgacacctaaggtaaattgaggcaaagaactttttaaaaaaatatgatcaaagggatttcctccccatgtgataacctgtggcttgtgtggagcagggtggagtgtgtctggagagggcatatgaaactgaaagaataagggccaaagagcttccggaagaggaaattagctggtgattctttccaatctgctttcccagtcacctttccggcatgttctgtaaaacaaaatgtaatttgactttgtttcattattttaactccataacacttaaattgttttcttttcggggaggggagtgtttattctcaaactaagcagtagccctctccaccttcgaaaaaggaacaacgtcaatccaacctttgttaaaaaactccaacctatcagattttaataatctagtagtttgctttcaaatataattatgtcgctagttctgtcacaactatactttgatagtttaatgactcacagaaatttgtaagactggaggttgcagtagtgtttctttcttattcttttttttccccataatatttattatagtcaatgaacagtgttacagacggccatcttagaattataacattttagagttggaagggatcttagtcaaaccctgtccttttacaaaaccagaaaccacggcttaggaagatttcatagcttgctaaaggctatccaactagttagattagaacccatgttatctggcttcttgcccaccactcttactgcgcaattgctccatatcgcctccaagcatgaaaattaaatgtattcaattcaacacacatttctgaagagtataatactttgtaccagtgactgtggtaccactttctatgtatttcaatgtatttaacatgcttatggagtacttgagattcccccccacccccacattcaagaagtggcaacagtttagatttatacacacaccttcacatgtacgtgtgtatacttgcatttgctcagatagtttcttgaaggatacacaataaaaatgttaatagtaatgacttatggaggagaagagagatagaagactttttactttgtacttcacatgatctaatgtacggtttgaatttgttataaattcgtattgatttcataattgaaaagttttaaagttcacaccttcccacacaaatatatatatcaacataagcaagtatataccaatggtatgtacacatttatgtgcatatatgtatttatacatatcagtggtttgtactgtaaaatccggtatgattcaggtcaactcagctgacaaagcagacctcattattggatactcatgtttcgttttcttgtattgctctctcctaatgtaagatagtaaaaataatatgttactagtcgtcatatatttttagaaattgtcctaagcttcttgattatcaaataatgtagcaaacttttaacacatttaaaatatcaaatctgggtacttgcttcagtggtagcacatatactaaaattcgaacaattcaaagaagattagcatggtgtttttttttatcaattaattaattaatttttttttttgagacggagtcttactctgtcatccaggctggagtgcagtggccctatcttgactcactgcagcctccgcctcctgggttcaagctactcagcctccccagtagctaggactacaggcatgcgccaccacgcctggctaatttttgtatttttagtagacaccgggtttccccatgttggccaggctgatctcgaactcctgacctcaggtgatgcacccgcctcggcctcccaaagtgctgggattaaaggtatgagccacctcgcctggccagtccattttttttttttttgagacagagtttcgcttttgtttcccaggctggagtgcaatggcaccatctcagctcactgcaacctccgcctcccaggttcaagtgattcttctgcctcagcctcccaagtagctgggattacaggtgcccaccaccacacctggctaattaggtcccttttttttaataaaccacaagaaaaatttgacacctgacgctgtggctcatgtctgtaatcccagcactttgggacgccaaggcgggcagatcacctgaggtcaggagttggagtccagactggccaacatggtgaaaccccacctctactaaaaaaactagccgggtgtggtggcgtgcacctgtagtaccagctacatgggaggctgaagcaggagaactgcttgaacccaggaggcagaggctgcagtgagccgagattgcaccactgtactccagcctgggtgacaacagtgcacctttgtcccgaaaaaaaaaaaaattgacacaaggaaaatatctgcagcctgggcaacatggcgcagccctctctctaataaaaatacaaaaattagccgggcgtgctggcttgtgcctgtagtcctagctactttggggagctgaggcaggaggatcacctgagccttgggaggtggaggctgcagtgagccatgattgggccactgtactccagcctgggcgaaagagtgagaccctgtctcaaacaaaacaaagaaacaaaaatctgaattgtagactctttgtagataagaacatattttttaaaaaagttaagactagggccaagtgcggtggctttcacctgtaatcccagcactttgggaggctgaggtgggcggatcacctgaggtcaggagttcaagaccagcctggctaacatggtgaaaccccatctctactaaaaatacaaaaattagctgggtgtggcggtacacccctgtagtcccagctacttgggaggctgaggcaggagaaccacttgagcccatgaggcggaggttgccgtgagctgagaacgcaacattcaactccagcctgggccacagagtgagactccacctcaaaaacaaataaaaagttaagactaaaacagtttatagtgattaggagttcagctgtctagttttgtttttgttttgagatggagtttcactcttgttgcccaggctggagtgcaatggtgcgatctcggctcacctcaacctctgcctcccaggttcaagcagtttcctgcctcagcctcccgagtagctgggattacaggcatgcgccaccacgcccggctaattttgtattttcagtggagacggggtttctccatgttggtcaggctggtctcaaactcccgacctcaggtgaaaaagtgctgggacctcaggtgaaaaagtgagtcactgcacctggcccagctgtctcgtttttagaaatagattaagactcaaaaaaaatattgcccaccgtaatatatctgattattagcaaagcttggactagagtctaggttctagtctagtggcccttgtactatacctgtaattttattgctttctagtgcattggatgattccaactaggctgacaaagtaataatatctaaaggttagccaggaccatttcaatagttaagaattattatttttttctttggtttttattttattttgtcttccttttttttttcattttcaggaagtgagcagtttctcaaaattattataattaatggaccagctaatttgtatagtgcttaaaatattttagtaacataaattttactaaataaatttactaatttagtaaataaatgttctccttttatttcattgtaaacattaatttctttagtaaatcctgtatttatattgtaaatgtttagcgataaaataatgatatttcactgtttttgtttggtctaatatttaagtctggtaggtagtattagcagagagcaaaacctacagtttatgaaataaacattcattgagcacttaatgtgttccaggcattcattgtagtatgtggtaggattccaaggataaatatggcaaaacaaatgcctttcttctgttttttttttttttttttttttttttgagacgacggagtctggctctgttgcccaggctggagtgcagtagcgcgatcttggctcactgcaggcactgcctcccggcttcacgccattctcctgcctcagcctctcaagtagctgggactacaggcacccgccaccacacccggcttagagtgtgtgtgtgtgtgtgtgtgtgtgtgtgtgtgtgtgtgtgtgtgttttagtaaagacagggtgtcaccgtgtgtgtgtgtgttttagtaaagacagggtttcaccatgttagccaggatggtcgcattctcgtgtgtgtgtgtgtgtgtgtgtgtgtgtgtgtgtgtgtgtgtgtgtgtgttttagtaaagacagggtttcaccgtgtgtgtgtgtgtgtgtgttttagtaaagacagggtttcaccatgttagccaggatggtcgcattctcctgacctcgtgatctgcctgcgttggcctcctaaagtgctgggattacaggcgcgagccatcacaccaggccgcctttcttcttttttttttttttttgcttttttatgttcgtctgtttttattttgcttttgtgtgtttgtttgtttttccattgttcttttgaggctgggagattatcatgagctgtcaattctcaagctttatctctgtgagataatctggtaatagttttataaaatgtaacctgttagcactattaaaggacattgtgtgagtagatatgaagagacaaacagtagtgataagataaaaaatactttagaatttaacaaatactgtttctgtatcttagaggtcatgtgctacagtgtttggaaagagccctacgttgggtaccacagtacaggttattgactttgtttccaattagctgtgggattgtgcatgtcaatgaccccatctttctttacatgttcacatttttgatatgttattttaggtgttgaattcaaaacataaaaagggtattttaaggccgggcgtggtggctcacgcctgtaatcccagcactttgggagactgaggcgggcggatcacgaggtcaggagatctagaccatcctggcacccctctctgctaaaaaaaaaaaaaaatacaaaaaattagctgggcgtggtggcaggcgcctgtagtcccagctacttgggaggctgaggcaggagaatggtgtgaacccgggaggcggaccttgcagtgagccgagattgcgccactgcactccagcctgagctacagagcgagactccgactcaaaaaaaataaaagggtattttgaatattttattttatttatttgtttttgagacattgtcttgctgtgtcacccaggctggagttcagtgcatgatcccagctcactgcaacctccacctcctgggttcaagtaattctggtgactcagcctcccaagtagctgggattacaggcgtgtgctaccacacctggctaatttttttttttttggtatctctttttttcccctcggagacagagtcttgctctgtcgcccagagctggagtgcaatggctgcgatctctgttcactgcagactccgcctcctgggttcaggcaattctcctgcctcagcctcccgagtagctgggattacaggcgcacgccaccacaactggctaatttttgtatttttagtagagacggggtttcaccatgttaaccaggttggcctcgaactcctgacctcgtgatccacccacctcagcctcccaaagtgctgggattacaggtgtgagccaccacacccagccttttttgtattttaagtagagacaggatttcaccatgttgcccaggctggtcttgaactcctgacctcatgtgatctgcccgccttggcctcccaaagtgccaggattacaggcatgagccactgtgccggcctttgagtattttaagttataaaagaaatatgtgtttctatatatattatataatatatattatacatgatatataatatatatgatataaattatattatatacaatatattatatatgattaatatataatatatgatatatcatatataatatcaaaatatataatatgtatataataatgtatgatatatataatatagtatataatatattacatgtataatatattatatataatatataatacaatatatgtaaaatatatataatatataacacaatataatatgtaaaatatattacatatataatatatatatttttcagacagagtctagctctgtcacccaggctggagtgcagtggtgagatcttggctcactgaacctccgcctcccaggttcaagcgattcttctgcctcagcctcccaagtagctgggactacaggtgtgctaccacacctggcttattttattttatgtatttatttatttttctgagacggagtcttgctcctgacctcatgtgatctgcccgcctcggcctcccaatgtgctgggattccaggcatgaaccaccgtgcctggccagagatatgtgtttattatagaaaatttatgaaatagaataatgacgatcatattgtctacaggttgttttaatccccccccccccttcaacattctatagttaacatttctgtttttttttttgagacggagtctcgctctgtcgcccaggctggagtgcagtggtgcgatctcagctcactgcaacctccgcctcctgggttcatgccattctcctacctcagcctctctaagtagctgggactacaggtgcccgccaccacgcctggctaatgtttttgtatttttagtagagacggggtttcaccatggtctccatctcctgacctcgtgattagcccgcctcagcctcccaaagtgctgggattacaagtgtgagccactgcgcccagcagtcttttttttttttttggtttggtttggttttttagacagagtctcactctgtcccccaggctggagtgcagtggcacaatctcagctcactgcatctccgcctcctgggttcaagtgattctcctgcctgagcctcctgagtagctaggattatagacatgtgctaccacgcccggctaatttttgtatttttagtggaggcatggtttccccatgttggccaggctagtcttgaactcctgaccttgtgatccgcccgccttggcctcccaaagtattgggattacaggtgtgagcccccgtacctggcctttttttttttttttttttgagacggagttttgctcatgttgcccaggctggagcgcattggtgcaatctcagctcactgcaacctctgcctcctgggtttaagtgattctcctgcctcagcctcccaagtagctgggattacaggcgcacgcacaaccatgcccagttaatttttctatttttagtagagatagtgttttaccatgttggccaggctggtctcgaactcctgacctcaggtcatccacctgccttggcctcccaaagtcctgggattacaggcatgagccactgcgcccagcctgaagtctttcaaaatacattttttatttatccagtgtattattttatactgcactttcttcatctgtaaagtaacagggtcaggcatggtgactcatacctgtaagcccagcactttgggaggctgaggtgggaggattgtttgagaccagcctgggcaacatcgtgagaccccgtctctaccaataataaaaaaattagctggatgtgatggcacgcgcctgtgaagatcgcttgagcccgggaggtcaaggtggcagtgagccatgagggcaccactgcattctagcctgagtgacaagagtgaggccctgtctcaaaacaaacaaacaagcaaacaaacaaacaaaaaacccagggtggctgggcttaaggactagttgattccaacgattcaaaacccattataatagtttttaagcctgattatctgagattttgtcaaggaaaaaaattccacataacaatcccaggccaggcatggtggctcatgcctttaatcccagcactttgggaggccaagtcagggagatcccttgagtccaggagttcaagaccagcctgggcaacatggtaaaatgctatctctactaaaaatagaaaaattaactgggcatggttgtgcgtgcacctgtaatcccagctactctggaggctgaggtgggaggatcacttgagcccaggaggtggaggttgcagtgagtcaagatcagggcaccccattccagcttgggggacagagcaagaccctatctcaaaaaacaaaaacaggaatttgaggccaaatttatggattatatattttatctgctctgtatgtggttaataataggttatcctttatatgataaaaacatacttatgtccattttgcaggacttggcatgggcttttattgttttaaattgtgatacatttgtagctctgctgtttgatacattttgggatttgattttggtatgatttggtacccagtctttgttatggatacatgtgattcaccttgttatgatatagttttatgtattttcgaggatatgggtcatagtgaaaagtcacgtttacctgtacagactgagaatagcttgatctcagatggtcagatgttgaaccaagtggattaaagctgatttcttaaaccggacaaggctgctgccattgtgcattccctggtacttataaaatattatggtttgaaattttattcttatttctgtaatcatcttattcaccttaaatacagaaatacagacatctggctgggcgcagtggctcacacctgaaatcccagcactttgggtggccgaggcaggtggatcacttgaggtcaggagttcaagaccagcctgaccaacagagcaaaaccccatctctactaaaaaaatacaaaaaaaaaaaaaaaaaaaaaagctgggtcatgcctctgcaatcccagctacttaggaggctgaggcaggaaaattacttgagcctgggaggtggaggttgcagtgagctgagatcatgccactgtactccagcctggatgacagagtgagactccatctcaaaaataaagaaaagaaaaaaaaaacacagacatctcagcatatattaccatgtgacttaacctttctatggttctagctaattttttaggccttgaaagggaaggaagcctaacattttctgctacctcattggactgtcccttctgccagtaatccttgtagtaatttccttagacctatattggtcataatcactgggtgcatgacctttgatgagtaacagtcagaactactgtttcctcatatttcagatgaggcctatgatatattatgtaggttaaattagattccatatatgaaaacattctaaattgtaaagcacattacatatgttagttattatcaaaggtaacatcgtgaaagaagagaagatgagctatagaatcacacaagcccatgcttaaattttgaccttacattaaaccaaagaggattgatttttttttttaattgagacggagtctcgctctgtcgctcaggctggagtgcagtggcgcaatctcagctcactgcaacctctgccgcccaggttcaagcgattctcgtgcctcagcctccttagtagctgggactacaggcacgcgccaccacgcccagctaatttttttgtatttttagtagagacagggttttgccattttggcgaggctggtctcgaactcctgacctcaggtggtctgcccacctcaacctcccaaagtgctgggattacaggcttaagccaccatgcccagccaagattgaaaatttttagtttaaattcagcatgtttagtagagaagtacttacttgtagctaaaatgatgggatgaaggaaaatgaaaattagtttgtagatagtatttgggtacatgcggacactcatgaaatatgttgtatcgtttaaatttggtttgtagcacagtttcctttactttgtgtcatttaaaaaaattaaaacctagacagaagagaaacgtactaaatgtttgaatatagatagcactgtggctttcagatagagttaaatatttttactgaagaaagagaaaagatgtgggctcttatccataacttgtttgatcagcctgggcaatatagtgagaccttgtctctacaaaaaaaaatttaaaaattagctgagtgtgctgtcgcctgcctggagtccagctcctcaggaggctgaggtggtaggattgcttgaaaccgcaaggcaggggttgcagtgagccaagattgtgacactgcactccagtctgggcgatagagcaagaccctgtcccagaagaaaaaaaaaagttgtttaagtacttgcttgagatcctaacatgatcatggaatagaatacttcactctgaggtgagaagatcacttgaggccaggagttcaagaccagcttgagcaacatagtaagaccccatctctttttgtgtgtgcgtgtgtgtgtgtgagggagtcggagtttcactctgtcagccaggctgctggagtacattggcacgatctgggctcaatgcaacctccgcctcccaggttcaagtgattctcctgcctcagcctaccgggtagctgggattacaggcatatgccaccatgcccagctaatttttgtatttttagtaggggccgggtttcaccatgttggccagggtggtctcgaactcctgaccaagtgatccacccacctcagcctcccaaagtgctgggattacaggtgtgagccaccacacctggccatgagccaccaagcctggtcgagaccccatctcttaaagaaaaaaaaaagaatacttcgttctgagaaatgtctaggggtaggtattacctgcttatgaagtcatccatggcatttctggaaccatctgattgtatgaactgctttctaatcactctgtcagaataagttatctggacaaagtatcagagtacagtaagttccggttccatgccactaatcagctctatggccttagtcaaatcatttaccttccttatgttttagtttctttttctttctttttttttttttgagacaggatctggttctatcagcccaggctggagtggccaggctcaagtgatcctcccacctcatcctcccgagtagctgggactacaggctccagccaccatgccttagttttttggggttttttttgtttttttgttttttttagtgactgggtctacctatgtttcccaagtggattagtttctttttctgtaaagtaagagaatgatttttattatcctgtccagcaagacatagttattatgaacaatttttgctcgtgagtgtctacaaaatataataatggccgggtgcggtggctcatgcctgtaatcctagcactttgggagaatgaggcgggaggatcacgaggtcaggagatcgagaccatcttggccaacatggtgaaaccccatctctactaaaaatacaaaaattagctgggtatggtggcacgtgcctgtaatcccagctactctggaggctaaggcacgagaattgcttgaacccaggaggcggaggttgcagtgagccgagattgtgccactgcactccagcctggtgacagagcgagactccatctcatagtaataataataatgatgatgctttttagtatacttgattctgagctgctcgttttgttaaaattattttagggaagtttttgcccaaagttcgcggatacttctttcttcttaccaggccccaaagtcattgtaaatttttacaaggcagtggatgaacagttcataactccaaagatagatatcactcagaaaaatttttccacaagaagtccttttttttttttcgtcctttttttttttggcacactagtgtctcacttagcaagtccttttattttcaactcaagttaacaataagttggccgggtgtggtggctcacgcctgtaatcccagcactttgtgaggctgaggcgggcagatcacctgaagtcagaagttttgagaacagtctggccaacatgacgaaaccccgtctctactaaaaatacaaaaattagtcgggcatggtggcgcgcccctgtagtcttgctactcaagaggctaaggcaggagaatcacttgaatttgggagatggaggttgcagtgagccgagatcacgccactgcactctagcctgggtgacagagcaagactccatcacaaaaaaagaaacccaataagtagcaatcaggtatcacctgtgtttctcagcccttctcttctgctgctggtttactgccactcaagcagtggaccaaaaggcatttgtttctggccaaccaccatggacatgatctgatgactgcttttatctctgggacttgacctgtatccctctctctctcttttttttggatagcttttcattctgtctcccagggtacagtgcactggcacaatcatagctcactgcagactctgcttcccaggctcaggcagtccttccacctcagcttcctgagtagctgggactacaggcatgtgcaaccatgcccgactaatttttaattttttttttttttgagacgaaatttcgctgttgttgcccaggctggagtgcaatggcgcaatctcggctcaccgcaacctcggcctcccaggttcaagtgattctcttgcctcagccttcctgagtagctgggattacaggcatgcgccagcacgcccggctaattttgtatttttactagagacggggtttcttcatgttggtcaggctggtctcgaactcctgacctcagatgatcctcccgcctcggcctcccaaagtgctgggattacaggcgtgagccaccacacctggcctaatttttattttatttttttttgtagagatggggtctcaccatgttgcccaggctggcctcaaacacctgggctcaagcagtcctcctgccttgacctcccaaagtgctgggaatacaggcatgaaccaccatgtctggccctctctctctctcttttttgaaacctgatgatcgccaggcacggtggctcacgcctgtaatcccagcactttgggaggccaaggcgagcagatcacttgagatgaggagtttgagaccagcctggccaacatgatgaaacgctgtctctactaaaaatacaaaaatcagccaggcgtcgtggcggcacacacctgtaatcccagcactttgggagtctgaggcaggtggatcacttgaggtgaggagtttcgagcccagcctgaccaacatggtgaaaccacatctctactaaaaatagaaaaaaaaaaaattagctgggcctggtagcacacgcctgtaatcccagctacttgggaagctgaggcagaagaattgcttgaacctggaaggtggaggttgcagtgagcccaaattgcgccactgcactccagcctgggcgacacagcaagagtccgtctgaaaaaaaaaaaaaaaaacctggtgggttgctcagaggcagttacctatgtaacaagctggcagaaattctcaggataggcaaaaagataagaaccaaagaacatatccttccctttctaagtcataaaaattacttcctgtgaatgaaaagccaaaactttgcattaccaggccttgctattgatagtttacttggccagtgtattcacagagggaggaagcattgtcacatggcaaataaccagattacacccatagtctggttggcaggattgtacaagggtgcctgactaatcaagagtccacctgcttatttcttttcattagaatctaatatatttgctgtatagaatttagaaagttaagaaaagcgcaaagaaaataatctcactgctcagagataaccacagcagaattttgatatgtaatttagcctgtctttatatatctgtattttttataatttgggttatataatacaacatcattttgtaaccagctttttccacttaatacaacatcatggtgctcgctttggcagtacatatactaaaattggaatgatacagagaaggttaacatggcccctgtataatatatgcatgtttttaaaatacatcctgaacatgaatttttaatggttacctggtggcccatattaccatagtattgtcctcttttgttagatattgaattgtttttagtaaatagcactttatggaacatccttatatatacactcataatgaaatgatgggggattttttttttttttttttgagatggagtctccctctgttgcccaggcttgaatgcagtggcgcaatcttggctcactgcaacctccacctcccgaattcaaacaattctcctgcctcagtctcctgagtagctgggactacaggtgtgtgccaccacccccagctaattcttgtattttttttttttttttttttttttgtggagcctaggttttgccatgttggccaggctggtcttgaattcctgacctcaagtgatccacccaccttagcccccaaagtgctgggattacaggcatgagccactgcgcctggctgatcagggatttatttttttttttttttgagatggagtttccctcttgtttcccaggctggagtacgatggcacaatctcagcttactgcaacctctgcctcccaggttcaagtgattctcctgcctcagcgtcccgagtagctgggattacaggcgtgcaccaccatgcctggctaattttttgtatttttagtagagacggggtttcaccatggccaggctggtcttgaactcctgacctcaggtgatccgcctgccttggcctcctagaatactgggattacaggcgtgagccaccgcgcccggcctgatcagggatttatttatttttatttttttgagaatatgtttagaactagaatggatggttcaagagataatcatatatttaagacttttagaacatatattgccagattaccttccagaaaagatgtaccagtttttagttctaacaggcaaatgcctcttgcttcatactctccagccactgcgttttcgttgttggtagtaatgttgacctttgccaaataggataaaaatgttatcttttaaagtgtttatttctttgattattaatgaggtttaacattgttgcatatgtttgttgaccattaatatttcccacttgtaaatttgcctgttttctatcaacgtattaatctttttcttatagattttttttttttttgagacggagtctcgctgtgtcgcccaggctggagtacagtggcaccatctcggttcactgcaacctctgcctcccaggttcaagcgattcccctgcctcagcctcccgagtagctgggattacaggcatgtgccaccacgcctgactaatttttgtatttttagtagagacggtgtttcaccatgttggccaggctggtcttgaactcccgaaatcaagcgatccacccacctcggcctcccaaagtgttgggattacaggtgtgagccactgcacccagccttcttatagatttataagtgtattcatactactttttttgttttttaagacagtgtcttgacctgttgtataggctgaagtgcagtgacgcagtcacagctcactgtaacctggaattccttggcctacattgcccagtctggtcttaaattcctgggctgaagtgattctcccgccttaacctcccaaagtgttgggattacaggggtgagccaccgcatgtgacctcatgctgctttttttttttttccaactactttagtcagatgcttcttgagactattactagtcaaaaacaagatagattaaatggaggtagtgacaggacactgccctgtttgaggccatctattattggtgtgaaaagcaaacattacataagtaggtttagatagaaggtcattcactccagcattgttcataatagtaaaaaactagtcaaacacagtggttcacgcctataatcacaacactttgggaggccaagtcaggagtatagcttgagtccaggaattccagaccagcctgtacagcatagagaaaccacatctctaagaaaactttttaaaattagcagggcatggtggcatgtggctatagtcccagctactcaggaggctgaggtgggaggattgcttcagcccaggaggtcgaggttacagtgagctatgatcacactactgcactccaactcgggcaacagagcaaggccttgtcttttaaataaataaataaataaataaaaaggaaaataatatgagtaaactctacccatcagtggtaaataccacatatttctatcaatgttaggcagtcttcctagaataatcccattaaagaaaatccaaaatcgttgtatgaaaaaatacacaggtttgttccatgtgtaaaaatcttttaatcttggtacattttttatcaaaaacattcacactacttgaatacattaaaagagtacaaaagcattccaatgtacatatggacacacaaaacacagggaatgctttctagtgaaattaggagtaaatacaagaatgttaaaggagagagtctcatattaccagagtcagtgaattaattgcctttttttttttttttgagacagagttttgctctgtcacccaggctggagtacagtggcatgatctgggctcactgcaacccccgccttctgggttcaagtaattctcatatctcagcctcctgagtaactgggattataggcatgcaccaccacgcctgactactttttgtatttttagtagagatggggttttcgccatgttggccaggctggtttcaaactcctgacctcaagtgatccgcctgcctcggcctcccaaagtgctgggattacaggcatgagccaccacgcccggccattaactgctttttacaacacaaactatacctgtttggaattagtttttaaatatataagctacaggatgtacaaacaccaatgtgaacaactgtcagagaattttgtaattcaggaacatagcttcaagtgcttcataacatggaaagcaactcctaaaaatagtaattggcttaatttcttaaaagcattccagaaagtgatttgttacaattagcaacagaagaacaacattagaaataagaatactgggaacataagaactgaggtcctccagtaccaagagatagaatcaaactttttctcattagaatttaaagaatatagccacgcacggtggctcacacctgtaatgccaacactttgggaggctgaggcgggtggatcacgaggtcaggaggtcgagaccatcctggctaacacggtgaaaccccgtctctactaaaaatacaaaaaaattagccgggcgtggtggcgggcgcctgtagtcccagctactcgggtgactgaggcagaagaatggcgtgaacccgggaggcggagcttgcagtgagccgagatcgcgccactgcactccagcctgggagcgagactccgtctcaaagaaaaaaaaaaaaaaagaatttaaagaatatagttaaaggaaaaattcactgggctctgtgaaacaggttaaatatgtaaccacttcaaacagaaatgacttagtcctctcacctagttctgaaaatgtactaacatcccattttccatatcaaaagcacgtaatttcattagcaaaagcctctttgttttagacttaaaatcacctctgatccaccaaagtttatgcagttaccaaactactattttaataacattttgacagctttattaagataaaatttatataccataagatccatttaaagtatatagttcagtggcttttagtatatgcagagttgtgcaactatcaccacaatctaattttagaacattttcattactccagaaacaaccccagtaaccatttgtagtcacttcctatttccccctccccagccctaggcaaccactaatctactttctgtttctatttattttaataacatttcaaacttgtaatattattgttctcatgcttattctgggtcgttggctcagaggtttaaaagctcttaaactacccaaatttacaagtcctatgacatcctcattcagaaaacattcaaatgatggtttcataatgttatgatagttccatcttctaagagtttttgatctggagcatatgtttcaaattctatgtttgtactactgctaaattcacttaattagaagaagtaaaatcattctatcgagactcaagaatgagtttgttctgtttatgttaacgattccaggcttttgatggtaggaatggctttagcagtcttctgtggcacaccattatcttaaataatattgtcaccttccccactgtcttcatcctttggctcaaagtttggttcaatctgctgtggttaggcaagaaggctattatcagcagattggctggagctaccagaagtctgactgttcccagtaacattattctcctggttgctggtctcactgttaggatgaggtggctgctgtttgcactcatcatgtctgtttacttgattgagatgcttccctgaaacttatgtaccatcaacttctaaaaacttcatcattaacagttcatagttctgtgctgtgagccaggcctggaacaagccaggatataaaagatccctgggatgctctctaagccatgtggtgtctcccttaggctagaaccatcctggatatagagtcctaggggatgcttagttcctgggagaacatccacatctatgattgaagacacgggtctgaagtcttagggcatagcagtgactggatatagcctttttctgtggttgacaaaaccacagaaagagtttttttttttttttttttttgagatggagtcactctgtcacccaggctggagtgtggtggcacaatctcggctcactgcaagctccacctcctaggttcacgccattcccctgcctcagcctcccgagtagctgggactacaggcgcccgccaccatcccagctaattttttgaatgttcagtagagacggggtttcaccgtgttagctaggatgatctctatctcctgacctcgtgatccgcctgccttggcctcccaaagtgctaggattacaggcgtgagccaccgcgcctggccagaaagagaggttttaagtgacaatattattaaagacattctggagaaaaagatcacctataatcccgtcaccttaacattttctcgatttatttaatattactttccgagtcttgtctataagtatacattttcatacagtggtaatctggcgtgcattctaccttatatccttttccccattaaaataacctttattctacgtatttgaaaaccttggctgggctcagtggctcacgcctgtaatcccagcactttgggaggccgaggcgggcggatcacgaggtcaggagatcgagaccatcctggctaacacagtgaaaccccgtctttactaaaaatacaaaaaattagctgggtgtggtggcacgtgcctgtagtcccagctacttgggaggctgagacaggagactcccttgaacccgggaggcggaggttgcagtgagccgagattgcgccactgcactccagcctgggcgacagagcaagactccgtctcaaaaaagaaaaccttaaggctgggcgcggtggctcatgcctataatcccagcactttgggaggccgaggcgggcggatcacctgaggtcaggagttcaagaccagcctggccaacatagaggaaccctgtctctactaaaaatacaaaattgccgggtgtggtggtgggtgcctgtaatcccagccactcaggaggctgaggtgggagaatcacttgagctcaagaggcggaggttgtggtgaaccgaggtcgtgccattgcactccagcctgggcaacaagagtgaaactctgtctcaaaaaaaaaaaagaaagaaaaccctaataaaaaaaaaaaaagcagcctggcacagtggttcacacctgttatcccagcactttgggagttcgaggcaggtggatcacctgagatcagcagttcaattccagcctggccaacatgttgaaaccccatctcttctaaaaataaaaaaattagccaggcgtggtggcgggcgcctgtaatcccagctacttgggaggctgagacaggagaatggcttggacctgggaggcggaggttgcagtgagttgagatcacgccatttcactccagcctgggccataagagcaaaactctgtttcaaaaaaaaaaaaaaaaaaagggagaaatagaaacttttgtgtcgtatacagacaccagggttttgtatgtgcctttgtctctgtatcccccacctccacattcccacattctcgctagattagctgtcaacctcctctccttggcacctcctggtggctctctttacgcagttgactggactaaatgtatgtacatacatgtatactgtaaaaccttacatatcaccattgtagaatctcccaaacccttcatttaaacatgcaccattgcttgctggtcctttttgtcccattttttgcttccatagtgctattttcccaactactgttacccttaagattcctgacttcccagcccctttataccaaaagctttctttgacatttttctctttccgtgccttcctgcctttccacttacccagtacaaagcctgaagatgctttcacagagaagccttaaattatcccagcatactttattgcacccacaccttttcacttcaaaaacctttttgtcacccttgtctaatattcataccctattttcttctatattctcaattcatctgctccatatatacttgttttctgtggtatcattttccccacctccatttcacttagatcctatatttttttaccctatcttaccctttttgtttggtgccttcctccaaacccaaggtttctgtctttcatcagtcatccttccacctttcactcttaaactctggtaattctggttttcctccttctcaaaaagctcacactctgctaatgtgtatatattgttcacttgagtgcttctaaataaatatttacttttcaaaacagtgaaatctgaactattagcatggaaacaacctctgggaagataagatctccactcaaaagcttcaaattgagattctcctgctcatgttgaatgatggttttatctaatattttctgaaatagggtgactacttgaactacacaaaattgtgaaatgagaatatctttgattttatacttctatttttttttttttttttgagacagagtctcactctatcacccaggctggagtgcagtggcagtcttggctcattgcaccctccacctcccaggttcaggtgattctcgtcccttggcctcccaagtagctgggattataggcatgtgccaccacacccggctaatttttgtagtttttggtagagatggggtttcaccatgttggccaggctggtcttgaactcctgacctcaagtgatccacccacctcagcctcccaaagtgttgggattacaggcgtgagccactgtgcctggccacttacatctattttgattgacttgaaataaaatttaacacctcagggaaggcaattctcatgtgttttgaattatactgagcattaattcttcaggataattatagacttggaaaggtttaacccagtctcccagtccatgctgaagttcctttaagtgataggaggaactcataatctacaaggcaacccaatccatttggtgctaccatcgattgttataaagcccatccttgggttaaaatctactatttacagttgtatttaatgaccttaattctgccctcaagctatataaaatttggatctgttttctacatgataatcttttagatatcttaaggtagttagtctatcctctctacccttcccctcacagtttttccaccctttgagataaatatccttcgctattccaactatttctcatatggtatcatttttatcatcccgattgctccctaaggatgttaaactttgttaatgtcccttccaaaatgtatttggaactggaaataatatcccttggtagctgaattggatctggatgttgcacatctggacactaatgcagtctgaagttgctgtaagttttttagtcgacttgtaatgttggcttatgatgaatttgtaattaaataaaatcccaaggttttaatctggaggattgcctttaagtgatttcttcttaaactaagtctcaatcttcttttagttatgcaacagattttttttgtttgttttttgagacgctcgctctgtcgcccaggctggggtgcagtggcacgatctcagctcactgcaacctccacttcctgggttcaagcaattctcctgcctcagcctcccaagtagctgggattacaggcatccgccatcatgcctggctaattttctttctttcttttttatttttttttagtagagacggggtttctccattttggtcaggctggtctcgaactcctgacctcaggtgacccaccctcctcagcctcccagagtgctgggattacaggcgtgagccatcacgcccggccttttttgagatggagcctcgctctgtcgcccaggatggagtgcagtggcatgatcttggctcactgcaacctccgctccccgggttcaaggcattcttctgtttcagccttccgagtagctgggattacaggtacctgccaccacgcctggctaatttttgtatttttagtagaggtgggggtttcaccatgttggtcaggctggtctcgaactcctgacctcaagttatccggccaccttggcctcccaaagtgctgagattacaggcatgagtcaccgtgtccggcctatgcaccagatattttttaaaaaccagatgtaagactttatacttatccctattaaattttatctcattagcctatcaggtagccttggtttttttcttttcttttcttttctttttttttttttttttgagacagagtttcactcttgttgcccaggctggagtgcagtggcgcgatctcagctcactgcaacctctgcctcccgggttcaagcgattctcctgcctcagtctcccaagtagctgggattacaggcatgctccaccacgcccagctaattttgtgtttttagtagagacagggtttctccctgttggtcaggccggtctcaaactcccgacctcaggtgatttgcccacctcggcctcccaaagtgctgggattacaggtgtgaaccaccatgcccggctgttttttttaagactagtcaagtgcagagtgagaaggggggaaagagtagaacaaggagtttgatcagccttggtttctttgaatcttgatttttgtcatccagtttattgtgctgattcaacaaagggccttgaagctaatgttggaatgttttcagacatataggaaatgataattcatcaaaagtcatggagactatattccaaaagttttatgcagatataactcagctgttgaggtatatgagttaataccactataaattgacatggccaggaaagactgaagtccattgccagcttgctttgtgttgaacattactccaaaagagattaaattttaaggcatattgtgtcaacataaaggcaaaagagctggctaattcttctcaagaaatcaattaatggcagggcgcggtggctcacgcctgtaatcccagcattttggaaggccgaggcgggcagatcacctgaggtcaggagttcaagaccagcctgaccaacctggagaaaccccgtctctactaaaaaatacaaaattagccgggcatggtggcgcatgcctgtaatcccagctacttgagaggctgaggcaggataattgcttgaacctgggaggcggaggtcgcatgaaccagtatcacaccattgcactccagcctgggcagcaagagcaaaactccatctcaaaaaaaaaaaaaatcaattaatgcacgcataatatagagacagagtcattgttaccattctcttattttgcctttgacaagtttatattgagcatgttatcaggcaatgtgggagattctggagaaccaggtttgcctcataactagggttaccatatactctagtttgcctggggcaaccctgatttatgcctgttgtcccagtgtgattattactagtgtaatttttcactttgagaagtgtccaggtttggaggataaattatctttctaataattgatacccttctcataacctaacgggttccttttagtattttatctgggttaaaattaccagctgtaatttggcagctctaataagactgcagcaatacttatcttccatttgaacagattgttacttgaccaagggaagttaatagcaaaagtaactgcagggcacatgtatgtcatgggcaaaaaaaaaaaagtaacagcaattaaggtttgcaggtacttagaatttttcctgagccaccctctagagggcagtgttacatatatatctgtaattatccagttacaacaaaaaaagggctctcattcatgcatgaaaatcagaaatatttcatactcttaaagaacacattggaaccaatattatgattaaaacatattttgctaagcaaagagatattaaaaattaattcattaacattctgaacattttttaacttgtaaaaacaactttgatgccttgaatatataatgattcattataacaattatgcatagattttaataatctgcatattttatgctttcatgtttttcctaattaatgatttgacatggttaataattataatatattctgcatcacagtttacatatttatgtaaaataagcatttaaaaattattagttttattctgcctgcttaaatattactttcctcaaaaagagaaaacaaaaatgctagattttactttatgacttgaatgatgtggtaatgtcgaactctagtatttagaattagaatgtttcttagcggtcgtgtagttatttttatgtcataagtggataatttgttagctcctataacaaaagtctgttgcttgtgtttcacattttggatttcctaatataatgttctctttttagaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtaaactttattataaaaccaataaatagcttcccaagtatgccagggctcataaaaagtaaatagatgcccttagccccctgaactggtaaatatttaggtataacttggcatgattatatatatatctgtattattccgtgaactcttatgttgaacctgtaatgtaactactgaatttatgtgaaaaagactaccatattatgagtcatgcttctcttcatgtaattgtttttaggaagtagataacttgcaaaagatggtagacatccccaatagcaaaatgggtctaatagtaatattaaccatcatttattgagcacttactataagtgctcaatacatatacttcatgcattttctctaagcttcacaatagctttgtttgtttgtttttgagacagagtttcgctcttgttatccaggctggagtgcaatggcgtgatttaggctcaccacaacctccacctcccgggttcaagcgattctcctgcctcagcctcctgagtagctgggattacaggcatgtgccaccacgcccggctaattttgtatttttagtagacacagggtctctccctgttggtcaggctggtctcaaactcctgacctcaggtgatccacccgcctcggcctcccaaagtgctgggattacaggtgcatgcaccatgcctggctaatttttgtacttttagtagagacagggtttcaccatggccaggctggtctcgaactcctgaccttgtgatccgcccgccttggcctcccaaagtgctgggattacaggcatgagccactgcgccggccatatgagtactttcaaatggactgtggtagacatttcaggaagggccattggagtgattgcttctaaagatattttaaaaagttataccattatatatttgacccatttattttaagattgaataatgcctataaaatattggttatttcgaaagattttatttatgtaccatcatatagtaatcttgaaggtttgtttagtgtcatgtagctataaacttagagaaacttacaatttcattatgtagaactttaatgttactaatacttgaaacataacttgttttaaaatttcacagtttgaaacagtaaggacaatattggtggcccaaataacatactaaaaagaaagtatggccgggcgcggtggctcccgcctataatcccagcactttgggaggctgaggtgggtggatcacctgaagtcaggagttcaagaccagcctggccaacatggtgaaaccccgtctctactaaaaatacaaaaattagctgggcgtgatggcatgcgcctgtagtcccagctacttgggagactgaggcaggagaatcacttgaacccagaaggcagaggttgcagtgagccgtgatcgcgccattgcactccagcctgggcaacaagagtaaaactccatctcagaaaaaaataataataattaataaataaataaataaataaataaataaataaatgaaaataaagtatgccaggtacagtggcttacgcctgtaatcccaacactttggaaggccgaggcgggtggatcacttgaggtcaggagttcaagatcaggctggccaacatggtgaaaccccatctctaccaaagatataaaaaattagccgggtgtggtggcgcatgcctgtaatcccagctacttgagaggctgaggcaggagaatcgcttgaactcaggaggcaaaggttgcagtgaaccaagactgcgccattgcactccggtctggggaacagagccagactcagtctcaaaaaaagaaagaaagtaacaattttagtttttaacataaaacttgggcagttttatttttgtcttctataaaaatacctcacattgaatcagtgaatttagtgtgtatttcttcctcaaaggataaaaatcatatctgttacttagatgtgaatttgaatgtcttgttttaagctgtgagattttcatgttttttagatgtgcttaatttttaggtgttaaatgaatatttttgtgtaagcttctaattgcacaaatacatatattcctgtgtgttttcgtaggtgaaggtgataaagtaaagtgctttcactgtggaggagggctaactgattggaagcccagtgaagacccttgggaacaacatgctaaatggtatccagggtaagatatttaattgttcattgtacaggcaagttggatagcatgcagtgggagacttgaattactttttacctcaactatttttgccttcactatggcttgaaattcatgctaggtttataaaaatgagcaaggtttataagccttctctgatgaccaaaaacattcactgcttatgtgtgatatctataacattcagattatccctttttttttttgagacgaagtctcactctcttttgcaggctggagtgcagtggtgcaatcttggctcactgcaacctctgcctcccaggttcaagtgattcttgtgcctcagtctcctgagtagctgggattacaggcacccgccactgccaccatgcctggctaattttttttttttttttttgatatggagtctcactctgttgccaggctggagtgcagtggtgcgatcttggctcactgcaacctccgcctcccaggttcaagcgattctcctgcctcagcctcccgagtagctgggacaacaggcaagtgccaccacgcccagctaattttttgtatttttagtagaggcagggtttcaccatgttggccaggatggtcttgatctcctgaccttgtgatccgcccgcctcggcctcccaaagtgctgggattctggctaatttttgtattttttagtagagacagggtatcaccatgttggccaggttggtcttgaactcctgacctcaggtgatcggcccgcctcggcctcccaaagtgttggcattacaggtgtgagccactgcgcctggcctctagattatcccatttctttttttttttgagatagagttttgctcttgtcgcccatgctggagtgcaatggtgctatctcagttcactgcaatctccgcctcctgggttcaagtgattctcctgcctcagcctcctgagtagctgggattacaggtgcctgccaccacgcccagctaattttttatatttttagtagagacagggtttgaccatgttggtcaggctggtctcgaactcccaacctcaggtgatccacccacatcagcctcccaaagtgctgggattacaagcatgctccaccttgcttggcctctagattatccaatttttaaatacagattaggaaatgtgtgcttttttgttgttggaagtaggctcttttatgatcagcgtgagagcccatattgccaaggagattccttaagaagccatcatacccctaggaaatattaatgtatctcattatctctatgacatacagttgttcacatttttttttttttttttttttttttttttttttttttgagacggagtctcgctctgtcgcccaggctggagtgcagtggtgcgatctcggctcactgcaagctccgcctcccgggttcacgccattctcctgcctcagcctcccgagtagctgggactacaggcgcccgctaccacgcccggctaattttttgtatttttactagagacggggtttcaccgtgttagccaggatggtctcgatctcctgacctcgtgatccgcccgcctcggcctcccaaagtgctgggattacaggcgtgagccaccgcgcccggcccagttgttcacattttaagatctctggttggagtgtggtggctcgtgcctgtaatctcagcactttgggaggctgaggcgggtggattgctggagcccaagagtttgagaccagcctgggcaacatagtaagaccctgtctctacaaaaaatacaaaaaaaaaaattagccagtcatgatggcacacacctgtagttccagttactcatgaggctgaggtaagaggatcacttgagctggggaggcagaggttgtggtgagctgatgccactgcactcggcgccactgcactccagcctgggcgacagagtgagacactgtctcaaaaaaaaaaaaaaaaaactagccgggcatggtggcttacgcctgtaatcccagcacttcgggaggctgaggcagggagatcacttcaggtgaggagtttgagaccagcctgaccaacatggtgaaaccctgtctctactaaaaatacaaaattagccgggcgtagtggtgcatgcctgtaatcccagctactcaggaggctaaggcaggagaatcgcttgaacccggaaggctaatgttgcagtaagccaagatcgtgccactgcactccagcctgggtgacagagcgagactctgtctcaaaaaaaaaaaaaaataacaaaagtcaaggtgctaatttaataacttgttttagaaagttctcaagttgatattttttgctctactaatattagcataggtagcataacagagggaacttttttaaccttaaaatgacagtgggatagggaattgggtaacattttactttgtggctccttagaagtactgaaaagcaagttaatggaattaatagaattaatatgatggagattatatctttgcttatacttcactaatttatcagctactaaagtttaatcttttaattgtttaggtgcaaatatctgttagaacagaagggacaagaatatataaacaatattcatttaactcattcacttgaggagtgtctggtaagtctcatataatttatattttcaaattcacatttcaaattataatttatattttcattatgtagtttatattatatcatttgttttatagttatttcttcatgtgatattcacagtatagtattataaatcaatatatgtgtacattacatcaaaacacaaattttaagttaaaaacaaaataataaatgtatgatgggctttaaagatgagagctagctgggcagtgtttcacacctgtaattccaacattttgagaggccaaggtgagaggattgcttgagcccaggagtttgagatcagcctaggcaacatagtgagaccctgtctctacaaaaaattttaaaaaccaattagccagacttgtggtacatgcctgtagtcccagctacttgggcggctgaggcgggaggatcgcttgagcccagaaggtcagaggattcagtgagccaggttcattccactgtactccagcctgagtgagaaagggaaaccctatctcttaaaaaaaaaaaaaaaaaaaaagagagagcctaaaaagtgtttcttattctttacctgaagtaaatttgtcaaaagataatcaggatgaactgatttaagtatcattgtaggcaaaaatgggcttgaagaactaaaatattaaaagtcccttagccttctgaaattagatctttgtataatgtgctttgtactcataagtagttttaagtttttgcagacaatatttaaaatctcaaatatatctaaattgataggatgggcgctgggcacggtggctcacgcctgtaatcccagcactttgggaggccgaggcagatggatcacccaaggtcaggagttcgagaccagcttggccaacatgatgaaaccccgtctctactaaaaatacaaaaatttagctaggcgtaatggcgggcgcctgtaatctcagctactggggagactgaggcaggagaattgcttgaacctgggaggtggaggttgcagtgagctgagatcacgccactacactccagcctgggcaacaagtgtgacactccatctcaaaaataaataaattaaataaataaataaattgataggatgaattgaggtggccaaggcatcagtaataggtggaaagaaccctggactaaaatgggagactagagttgcccccagtgactctaccttgaagtcattcattctccctgggcctcagctttttgtttgtaaaatgaagggattagattagataatcttatgacttccttctagctccatcaggctatgcctcttgtgaatattcatatattgaattggaataaagccaatttattttaaatttatgattaatttcacttttcaaatggaaatgattgcctctaccaaaaataattctaacttacagttcctatttctgttacaggtaagaactactgagaaaacaccatcactaactagaagaattggtaaatatgcttgttaactatccttttaatttaactgccaatttatttatttatttatttatttagagacagagtctcactctgttgcccaggctggagtgcagtggtgcgatctcagctcactgcaatctctgcctcccgggttcaaccgattctcctgcctcaacctcccgagtagctgggactacaggcctgcgccaccatgcccggctaactttttatatttttagtagagacggagttttaccatattggccaggctggtctcaaactcctgatcttgtgatgcgcccgcctcggccttccaaagtgctgggattacaggcatgagccaccgcacccggcctttaactgccaatttattatagttgttatttatggggtggaaagataagcatgttcttccaaggtcaccatgatatatttatttcagatgacattactataaatttaagaatttaggcggccgggcgtggtagctcacgcctgtaatcccagccctttgggagaccgaggcaggccaatcacgaggtcaggagatcgagaccatcctggctaacatggtgaaaccccgtctctactaaaaatacaaaaaaaaaattagctggatgtggtggcgcacacctgtagtcccacgtacttgggaggctgaggcaggagaattgcctggcctgaacccaggaggtggaggttgcagtgagccgagatcatgccattgcactcaagcctggcgacagagcgagattccgtctcaaaaaacaaaaatgaaaaaaataatttaatgaagtacttataaattgcagtcagaggctgggtgcagtggctgacacctgtaatcccagcactttgggaggccgaggagctcaagaccatcctagccaacatggcgaaaccccatctctactaaaaatccaaaaattagccgggcgtgatggtgtgcgcctgtaattccagctactcgggaggccgaggcgggagaatcgcttgaacctgggcagtggagattgcagccagctgagatcgtgccagtgcactctagcctgggcaacagggcaagactccatctcaaaaagaaaataaaagaaaaaaaaatcagtcagacgtgtctgtattaaaaatgttagtaggccatcagatagtttttccaagttcaggaggaacactgataggttgcctcattgccatctctgctaaaatcacaagagaaagggtgaagtgtctttttgtacctggggttccttaagtaagccaaaattatttcagttttctactagtgtgccattaccctgataagccctaacccacctgcttctttatcccatactgtcattgtaccttccccagcttcttcacagaggtgtaagttttggtttgtttacctcctgttacctcatggagaagtagaggttttaaaactcaaaaagtgggcagagaaagatattatgctaagcaaggaaggtaattgttatccccacttttcagatgaagaaagagtcagagaggttaagtgacttgcgcacaatcacattacaaatagttagtggaactaggaccacaagcaaggtcttctgaatcctacatcacagggcagatctcattttcaacttaggcatatttcaaaagtagtagaaagtttaatttagaatatgtctagtgattccccacttcctaaactggtaccatcatctatttagtatcttaagaattacaagcggctgggtgtggtggctcacgcctataatcccagcactttgggaggccaaggcaggtggatcacctgaggtccagagttccagaccagcccggccaacatggtgaaactccgtctctactaaaaatacaaaattagctgagtgtggtgctgcacgcctgtaatcccagctacttgggaggctggggcaggagaattgcttgaacctgggaggcagaggttgcagtgagccaagaccacgccattgcactacaccctgggcaaaaaggagcaaaactctacctcaaaaaaaaaaagaaaaatacaaaaattaccagggcgtggtggcacacacctatagttccagctacttgggaggctgaggcataaaaatttcttgaacctggaaggcggaggtttctgtgagctgagatcatgctactgcactccagcctgggtgatggaccgagattctatctcaaacataaataagtaaataaataaataaataaataaataaataaataaataaaacataaattcagctccatgactgctcctgcagagcagggctacccactacgcagtgagtggcattactactatttaattgcagaacactatcattaccccaacaagaaactccatgctcacccatcaacagtcattctccattgcccaccctacccctaggccagggcaaccagtaatctactttctgtctctatggacttgcctattctggacatttaatgtaaatggaataatgtaatatgtgtcctcaaggtgtatccatgttgtagcatatatgagtacttcattcttttctattgtagaaaaagagtccattgtataaataataccacattttgtttatccatttgtcagttgacatttggcttgtttctactttttgactattatgaatgatggttctatgaacatttgtgcataagtttttgtatagacatgttatatacccagttctcttgggcatatatccagggatggaattgctgggtcatgtggttattctatatttaaccttttgataaactatcagacagatttccaaagtgactgcaccctttaacattcctaccagaagtgtatgaggatttcattttctctacattcattatctgtcttatttatcacagccattctagtggatgtgacatggtatctcattgtggttttgttttgcatttccctgatgattaatgatattgagcatcttttcatgtgcctattggccatttgtaaatctttgtagaaacgtctgttcatctcctttgacttttttttttttttttgagacggagtcttgctctgtcacctaggctggagtgcagtggtaagatcttggctgattgcaacctccgcctcctgggttcaagcgatcctcctgactcagcctccctagtagctaggattacaggtgctcaccaccatacctggctaatttttgtatttttagtagggacggggtttcgctatattagccaggctggtcttgaactcctgacctcaggtgatccacccacgttgggctcccaaagtgctgggattacaggtgtgagccaccatgcccgacccattttttattttttcttttttttgagacagggtcttgctcagtcacctgggctggagtgcaatagtacagtcatgctcactgtggcctcgacctccctggctcaagcaattctgctgcctcagtcttccgggtagctgggactacgggtgtgcgccaccacacccagttaatttttgtattttttatagagagaaggtttcgccattgttgccctggtggtctcgaacccctgggctcaaacaatctgcctcccttggcctcccaaagtgctgggattacaggtgtgatccactgtgcccagccttgaccattttttatttgggttgtcctttttctactgaacagtctagggggatgggttatctttttgttattgagttaaaagagatctttatatattacagttcttttttttggcttcttttactttctaaatgaagatgatagttatttatatataaaagttcctgtcagatttatgatttgcaagtattttctcccattctgtgggtttccttttttttttttttttcccaagacggagtcttgctctgttgcccagtctggattgcagaggcatgatctctgctcactgcaacctccgcctcccgggctcaagcaattctccttccttagcctccagagtagctgtgattacaggtgtgcaccaccatggctggctaattttttttgtatttttagtggagatggggtttcaccatgttggccaggcttgtctcaaactcctgacctcgtgatctgcccacctcagcctcccaaagtgctggaattacaggcgtgagccactgcacccggccacctttttcactttcttggtgttcttcgaagcataaacgtctttaatttttttttttttttttttttgagacggagttttgctcttgttgcccaggctggagtgcaatggtgccatctcagctcaccacaacctccgcctcccaggttcaagcaattctcctgcctctgcctccccagtagctgggattacaggcgtgcaccaccatgcctggctaattttgtatttttagtagagacggggtttctccatgttgaggctcgtctcgaactcctgacctcaggtgatccgcctgcctcggactcccaaagtgctgggattacaggcgtgagccaccgtgcccagcgaaacatctttaatttttatgacatccaatttatctatttttctgtgtgtgttgctcatgcttttaatgtcatatttaagaaaccattgcctaatccagggtcaccaaggtttatacctatgttttcttctaagagttttatggtgttatatcttacattctggtctttgatccattttgagttaatttttgtatatggtatcaggtaggggtccacgtcctttttgtttttagcaagttgagtttgagatacctgcaggacattgaagtaggaggataataaaaccttgtataaaggagagtaagatgttgctggtagggaaagtgtctggaaagactttttttttttttccggagacggagcctcgctctgtcacccaggctggagtgcagtagtgcgatcttggctcactgcaaccaccgactcccgggttcaagcgattctcctgcatcagcctccccagtagctgggactacaggcacatgccactgcgcccggctaatttttgtatttttagtagagacagggtttcgccatgttggccaggctggtcttgaactcctgacctcaggtgatccacctcagcctcccaaagtggtgggattacaggcgtgagccactgtgcccagctggaaagaccatttttcagaagggtcgatgagggaatggaagggagccaccaacatctaattaggtgggcacaagtaatggagcaacaaaacaaactgaaaataaaaacaagtcaaagataggagaagcaggaaagagcaatgtctagttgccctctggacatttccacctagaatgcatctctaaaaaccactcagactgaatctaatcctgcacttttttctcctgtattggttaatagtaccacagttcacaaggttgcccagtaatttatgttgttcctaagctctttgctctctgtaatccttttacatttaattaatcatcaaatttgatggattccacctttttaatgttgcttcagactttcccacttattctgctctagttcaggcccttccttgtttttcaactggacaattgtagtagtctcctaactggtcttttgtctgtattataacctgccaacagagtttttctttttgtttgtttgtttttgtttgttttgtttttttgtttttctgagacggagtctcgctccgtcaccgaggctggagtgcagtggcgcgatctcggctcaccgcaacctccacctccgggggtcacgccattctcctgcctcagcctcctgagtagccgggactacaggcgcccaccactatgcccgggtaatttttttttttattttttggtattttttgcagagacggggttttgaactcctaggctcaagcgatctgcccgtcttagcctcccgaaatgctgggactacagacgtgggccaccatgcccagccttatcttttatttttattttttaatatagatagggtcacactttgttgaccagggtggtttcaaactccaggcctcaaggaatcccccttggcctccccaaagtgctgggattacaggtgtgagccactgcacccagcctcctctctttcaaaaaacatttattgagctataatatacatacagtagccgggcgcagtggctcacgcctgtaatcccagcactttgggaagttgaggcaggtggatcacgaggtcaggagttcgagagcagcctggccaatatagtgaaaccccatctctactaaatatacaaaaaaattagccaggcgtggtggtgcatgcctgtaatcccagctactcgagaggctgaggcaagagaattgcttgaacctgggaggtggaggttgcagtgagccgagacgcgccattacactccggcctgggtgacagagcgagactacgtctcaaaaaaaaaaaaaaaaaaaaaaaaaatatatatatatatatatatatgattttatatatatatgattttatatatatatgattgtgtatatatatatgattttgtatatatatatgattttgtatatatatatgattttgtatatatatgattttgtatatatatatgattttgtatatatatacacacgcacacatacacacataaagtgcttaaagtaccctaatcgtaagttttctacttgatgaattttaacatatatatgttaaaatatatattaaatatgtgttaaatatatattaaaatgtatatgttaaaatatatatatttatctgtgtgactatcccccagattaagatatagaacattcccacaaccctagaaagttctttcatgctccttccccatcagtacccacccccaagttatattctggcttctattaccatagattaattttgtttattaccatagattagttttgaagttcttataaatggactcatgcagtaggtactcttttgtgtcataatgatgaattatgattatgttttgctcattatatctatgagatccatccatattgtctgtggcaatagttttttttttttttcttgctgtgtagcgtatgaatataccacaatttatgtatctgttcacctgatgatggacatttgagttgtttccagtttggggctattataaataacactactatgaatactcttgtgcatatctttggcagagatatacactcatttttaatacccaagagtggaattgatgagtcagagggtataagtgtcctctcctagcacttccctacacatgctgtgttcctactttaagtatcataaaaacaagtttccattgactttcttgctttattcagtcctacccgctctgctacagaaacgaagtttgagagctaggaaattgacacattcaaggttatagactgggacttccctgatttcccatcattttccccaaataattgctagtgactcagtaacaacatccactctttaagtaacttaggttaattgttaatgagtacagctagattcaaaacagttcagatttttgaagcacttaacctttttcttgcctattttaccttgcatcgtttcaaacactacaaaatacatactcattgcatttacaattaattgtaagattctgaaagtgatttttcagtgcctgaatacttcaaaaaatcttcccaaagcagctttgctttgctggtttgtttttattctttcgcttgctccttaattttttcattttaactatattttgctattgagttgtgataatgaaaataattgtttaaattctatgttctttttcctcaccaatttttatttcagatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaaggtatgcattgctgtttttaaaaagcaagaaagggccagatgtggtggctcatacctgtaatcccagcactttgggaggctgggacaggtggatatggacattttttaaacgtaaccttaatgctgtgtgttagtctgctcaagctgctataataaaattccatagactaggtgtcttaaacaacagacttatttctgacagttttggaggctccaaaatcaaggtgctggctgatttggttattgatgagggccctcttcctaccttgcagatggctgccttctcactgtgtcctcacatggcatgggttgggattggatgggacaagatggagcaagtactctggtctcttttcctctacttttaggaacactaatcccatcatgggggggtctcatcttcatgacctcatctaaacctaattacttcccaaaggcctcatttccaaatatcattacattaatcatggaaaaaagattaaaaatatgagttctaccagcctggacaacataatgaaactgtctctacaaaaaatacaaaaattagccgggcatggtggtgtgtgcctgtagtcccagctccttgggaggctgagcggggaagatcacctgagccagggaggtcaaggctgcagtgagccatgatcatgccactacacttcggcctgggcaactgagcaagatcttgtctcaaaatatatgtatctctcctttaaggatgatggacactgtagtgcttgccaacaacatcgaaggttaaagaagaagtttcaaactgagtacacttttgggtactttacctgtaatagttctctaagctcttgaccatcctccctccaaaaagatgagaattctcctactgctaaaaaaacttaaacgtttacttatttttgacgcatttaagatccttttgatctttaagatatttcaagtgcttttgaaacactattcagataatcgtataagttatgaaacagtatgaacattaatgatatttaaaattatattcattgatgtaagaatcaatggaaagcttccaattttttccttatagatgcatttatttaaaacttacacaagctccacttatcttggtggtggtaaaataaaccctttaattgtcatctttctttctttttttaattttttatttgttttaagacggagtctcactctgtcgcccaggctggagtgcaatggcacgatcttggctcactgcaacctccgcctccccagctcaagcgattctcctgcctcaccctcccgagtagctggaattacaggcatgtgccaccacgcccggctaattttttgtattttcagtagagacagggtttcgccaagttggccgggctggaatttttctactataacagaaacacaagcaattgtgtcatttttttcctgcatcttaaacacgcgcttaattgtttggccataaattgttagttttcaaaccttaatgtatctgcagcagaagggtttagcaggttgtaataggaagagatcaagagactgtgcattagggagagtgtcttttctctatctaacaggagtcaatgggcgctcatattatcactgagactacaaactaggatggtgtgggaaggagagcctaagggttggaattcatttgaactctcctcagtctcactaaattgagaggcaagtaattgatacaggctctctactcatgctgggactgctgcctatttgtcttcccaaaagctgatgaggaaagactggcactaagaatcttttaattttatataaaataaggatggggctaactgaagtgaagcaggtgagggttattagagaaaatataacattgtcacttactgagaaatcctagatttagtgctaaacttttttgccaatggctgtgtaacagagaatgccctagtaaaaggtcttgtaaaaatagtaccgaatcagtatctttttttctttctttgaaaaaattatgtagtgtaagataaagccctttatttagtatatgtactaaagtacttattttaatctttatgtgtatatatattactgtatataatataaaaatcaaataacccatattcatttcttatctgtctttccatatgaatctgctctaatagtaaaatgaataacatcagtttattctagaagaggttttaaataattacaaatattagcaaataacatcaaaagttatctagcctttattgctcatgtgccagtaaccttctgacctagaagagggctttgtggggaggagaaggggaaaggcgctgtagagaagtatgtagaatccagtagttacctttaagccaagagggaagtaattgccagtggtaaactactggtctgaggggaaaagatctatgcccagaatatcaccatctcaagttagtggctttatacaaggatgaaataatatagaaaaaaatgagatgatatggtatcacaaacaatcagaaccaaaggaaccttaaagattattttataattttttttttttttttttttttttggagacggagtttcacttttgttgcccaggctggaatgcaatggtgcaatcttggctcactgcaacctccacctcccgggttcaagcaattctcctgcctcagcctcctgagtagctgggattataggcatgtgccaccacaccctgttaattttgtatttttagtagagacggggtttctccatgttggtcaggccggtctccaacttccaacctcaggtgatctgcccgcctcggcctcataaagtgctgggattacaggcatgaaccactgcacccagcccattttataacttttatgaccttaattgggaacctgaagtacagatgggctgttgcctaggatcacgccgatagttgggaatagaattcagatttcctgacttctggtccagtgttttggggtttgtttcagtttttttttttgttttgttttttgttttttttagattttaaaaaattgtgataaaatacacatacagtttaccatcttaaccatttttagtgtatggttccgtagtgttaagtacatttacattgttgcacagtcaacctccagaactcttcatcttgcaaaaccgaaactctacatccattaaacagccaggcgtggtggcacacgcctgtagttccagctgcttgggaggctgaggcaggaggattgcttgagaccaggagctcaaggctgcaatgagctgtgattgcaccactgctctccagcctgggatacagagcaagaccctatctttaaaaaataataataataataaaaacatgttcattaaacaactccccattccctctcttcccaacccctggcaactaccattttactttttgtctctataaatttgactactctaggtgtcagtattgttgttgctttgtttgtttgtttgtttcttcctttttgtggagaacggggtctcactatattgctcaggcaggtctcgaactcctgggctcaagctatcctcccgcctctgcctccctgagagctgggattataggcgtgagccaccgcgcccagcctgtttgtttgtttttaactcgttgtagcattacatctaaaagtaatgtggaaattacttgttctccttttgatttttttggcatgaaatacacacttcattctgactttttttggtgttgatgctttcttataatataaatcagcttatagtgccgtttctttacttgtattttttcctctgccttgagtacgttttctctatctgtatacctagtcccattccccactctacccccaactccctgaatctactttgtgaactcatgtttcaaggttcagctcagaagtcacttctttcaagttttctcccgcacccacagcagagttaggagctccttcttatctactcctggtgctggtagagttttgttttgttttattttgttttgttttgtttttcttgagacagggtctcgctctgtcgcccaggctggagtgcagtggcacacaatctcagctcactgcaacctctatctctcaggttcaagcgattctgctgcctcagcctcccgagtagctgggattacaggcatgcgccaccacacccagctaattttttttgtgtgtatttttagtagagatggggtttcaccatgttggccaggctagtcttgaactcctgacctcaaatgatctgcccgcctcagcctcccaaagtgctgggattacaggcgtgagccaccaggcctggctgagcattttgctttttacactattttgggactggtttctgccctgcccattagaccaagcttcttaagggtaagtgctttatcttcttatctctgatgcattccatgtttgagcctatagtttttattatgcccaagagggtactttttaagaagaaagagattaaacaatcctttcctctaccccctagccagagaaacctttctgagacatagatgtgatcatatctgtctctagtttaaaacccttcactgcctcccaggacccttgggatcaagtccaaactcctttacgtggctcgcctaatctttcatgatcaggcacccttttgtagcctcatctcatgctattttctcaaattctgtgcccaagctttgcctgtgcacttgtaggccacgttctgtctctctccttggagcttgtttatgctgtttcctttgcctaaaacacttttctcccattgcccttatcccccaaggcctccttctcctagtaaactcctaattcattcttttgtacccagttttaggtataatttcctccaggaggccttcgtttatgcatgcatgcacacacacgcacacacacccttcctgtgctcttcataacacattgtaattacctttgtcatcataccatttatactttcctgtttgcttgtgttctttacttgtctatgaactattgggggcctgaggtttatgtatttgttaattgtatccctagtacctagaacctagttaagtgtccagtaagtatttcttgaataaactattgttttccaaacatgttttcagaatagtgttcagcaggatgttaaaaggatgccatgaaaaaggaaccccatagttaaatagggaaatgccttgtacatttctaagagggaacatagactatactgtcctatattgtactgtactgccctgtcctggatgacagtggttctcaaacgccagtgtgcccaaccccagaaattttagattctgtgaatggagcccagaaatccgtggtttaaaaatgccccaggttattctcatgtgaggccatatttggaaaccactggtacataatgattataaagatgctaaaataaataaatagttgtgatcacaaaggtatagttaaaatatgtaatgcatttggaatagtgcctagcacgtactatttatgcaatattactggtaactgctgctgctgttgtcattattgttatatgtgaccatgaaacacatgttttgtggcatatttattcacatttcacaaaactattttgggaaaggctgaattaagcaagtacttcagtgccacctatatgctgatgacatccagatctctatctctagccctgacttctcctgacctcaagatttgactcttcagttgcctactggttatttttatatgggtgtcctgaaaacacctcaaaaatatctgaagatcccaaacctgtacctccttttatatttcttattggcatcaccatatccttgtcagccaagctagcaatcttgtaatcaactttagtttgtctttcttcttcagccctcatatccagtcagtcacccaatcctacttgtcccacttcagaagtgtccctcaaatccatccctctatttctggaattagtcgtgacctttccatatgctgctccttttacctaacccttgtttttctgcctggcaaatgactgtccatgcttaaatgtcactcctccacttccctcctcccccgatccagccactgccaacctgtgaagccttctccaactagcctgagcagaagaacttgttttctcatcttgtcccagagcactttgtacataactttattatagcacttatcactttgtactttgtgcttaacctcctagcctcatcttacatcctctcccactagcgtgtgagctatttaagagcagatgccacgggtgagtcatcctcatatctcccggcacttgttgggtgcttggcacgtagtaggggctcaataaatgttttcaatgaatttaaacaactaagagagtctaaaactagcataattattttctctttttgcagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaattatatcata

SEQ ID NO: 2166 - DNA, 53813 bp, Homo sapiens; identical to SEQ ID NO: 2165
  source 1..53813: mol_type = genomic DNA

SEQ ID NO: 2167 - DNA, 19955 bp, Homo sapiens
  source 1..19955: mol_type = genomic DNA
gggcttatcccgcctgtcccgccattctcgctagttcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcggtgaggaccggacagggacgggggtggggccctcgggcagcccagcagcggaaccgttagccggagctgggcgagccggcgggcgcgcggccggtgggcaccgactccgcggcgcgcggccgcccatcccccccgtccccccctcactccctctcgcggggacccgcccggcaggcgcgcgcgcactgcctcccgcgccccctgtggaccccgcgcggccgcgcgcccctccccctgcggccgcgcgccgccgaccgcgtgtgcgacggggtcccctccccgccgaccggcctcgtgcgctcgggcccgcacgccgttgttcgcgtcacccccacccagctcccttccgcgtgtgctcggagggcgcggcgcaccgcctacgcaggccggagcggcttccccttccctcacgtgctctccgtccgcggcctgcgcacacacccatcctggggcccgcgccccgggcctgccctggagcgccccgcgcttcagactcacccacgtgtgcggcggcggcggcgactgcgtggccccgcacccgggcggtggagagaaagggctgtcaggtggccgcggcggccggcgtgcgagggaccggatgcccaagccgggcggatttggaaaaggatagctggtaatcgtggcttgttttgctttgttttcttttccagcaacgaaggttttgggaacagtaaaatggttcaatgtaaggaacggatatggtttcatcaacaggtgagctgccgggctctgaagcctccatcccaccttcttgcttgcttcctgctctgtcggcttctcggggcttgggaagccccaatccacagctctgttctgaaaggcgtttactacctctggtgtattagtatgattttttgttgttgttgttttccttgattagggattagtggatctagagaatgcctttgttttgcagctaaatattaatttgaagctaacttaaaaggcttcgtcacagtacaaagcaattcaaaaggcaagcggagtgaatgagccattccttaacagggtaaacgggaaactacggtccagtacatttttatccttgtcatctttttctactttattgaactcggtatttgagaatgtgatccactgacatcggatatttatacattgttaacgttttagggtaagaggatttgactatatgaggttttgtcatctttaccgagaggttgtattgcctttgtttcacgtttcattttaatacctgagataaattttgtcttagcacagctttgaccagagagaactgtttttatttgctcatccagtaaataatatatttacaagaaagtggttttttttccttcttccgttcttatttttcattcttccttgtcctagaatcataactggttaagtcgatttctgttagatccctggctgtagcttattagagtggccatagtcactggtaacttgacatttttcttcctgtttgaaggcaaagctgcagacacgtctttaggacttacccttcgggttgtttgtaggagtggtggtggtaacgtgcagtagacgcactgtattccatgggctcccttgtaagccgggcatcattttcaagatggctgccaaggctagtagtgctagttacatgggtgcagagcactgggtatgccagtagcaatcttggcctcacaggtatggtacttagtgccatctcagcattgtcttgcttgcttactgtagaagacctaagcagatgattaaaagaacaatgtggaatggacaacaaatgggcaaaatcaagcttaaggacagaatcattgcctgatgaaaaactgttcattaatcaatcatagagtattgtggaaacactcagagtaagagataagcatttggtgatctattctctacttttgcaattgtgggaaaatattttgtttcttccaaaatcttaggattttccatcttgttatatactgtttgctttcctggctggccgaaactacgtttttcattaattttttgataatggcttactagcaagaaggaagggaatgcttatatataattggcatactgatagctttttaactgatctctctgaactttctagtgttttagtttgtatttctgtcttactctgattatcgttactagtctaacccttaaaccagtggttttcaaatttaagtgtgcttaccttgggagggtgtgatgtaagtggtgagttcctccttctgagccttggattcattaggtctgggtacatttttaacaggaatgataatggtcttcgggccataccttcaaaatcactgcttttaacccttgacccaatgtaatggtaactctggtgtgcaaatttgcagccttttcagcggatagattgcaggttttgtatgtgttgaagaagttttagcatgtgccttgtttcgctgcattttttttaagtaggcataggttatgacattttttgaaatcaacagttttgtccagaataagagtaatatctttacattttttaagtatttagtccatgagatactgttcattgaatatctctattctgaattggaatcaactcaattggtcatcctccagggcaagttatgaattggcttttgatggtcctttgtttggactatcctaacctcaattattttgtcaaattaactggttaaaatgttctttatgcttctgaactggttttaatgattctgggacttttttaataagatgctgtaaaatctgactccaattaaatacagggaagatttgctttaattaaggaaaatgtatgtgataaaagaaatcactttggaagctagcagttggttctatatgtagttcgtgtagtggaacaaatagacttggctggaggcacctgtctcttatgagggagggagacagactgacacataacgtgctgttttctgtataaaggagagggtgcagtgttcgggatgactattgtgacgacttttaattggggtttttggatgcgctggattatatatgctaggattgtaaggaatttttataattacaatattgtatgtaaattttctgcctttaaagacataatttcattgtaaatgtgtttattccagcctgaattaccacctgatgaattgttacaaccttgttagaattaattcatgaaagggcttctccctgatggttatattgtgaagaaggtgctaagtaacatgagcatagagcttttaaaaatagcagaagttttggctttattttgttagactgtgtaatctagaaattctaagaaattcattgagttattcttttgtgaactgtgtctacaaaacataatcggagaatgtgactagaggggtttattagctccccccagattactgttgaattttgttagtggttgagtattgatccatattcaccaaagattaccatgaattggcaacagtttatagtgaccagaataggaatatttttctgtttccagagtacttaaaatgtttaaattaataattcttaatgttttgaggtgaaagaatttggagcagaggtcacaaatttgtgaccttctggctaaaactactcccagatgctttgattagacagtacagtattttttaaaggaattgggattaattactaacatttataattcaggagataacaccaagtaatccagattattatatttttaagatctgaactttagctggctttgggggcctgtatttccacataagtaaaaaccacctggccatattgtcaccacatttaggtggggtatactttttttacgacagccttcacgcctggcctctgtgtatgcatttgagtttattacccatggtctaggaagatgtaataaaccaagccagggaaaggtttggctatctctctttagtcacgcctatcaggtttagtctccctttggggtgggggctcccttgtggggattccatatgtacataactgataggtgacttccaacacatgttggtgaaaatagatacagctaacaagtatttatactagggtctatagtaagtgcttaaaatgagccaatttacttaatctttaaaaacctttgaggcgtaggtactgtcattctgaggcacaaaggagttgttacttgtccccataagcataggtgataagtggcaggattggaactgttttttgactctggagttagtgttcaccaactgctcttatgctgtctctgaaatagaccctagccattttcaatttggttgttgtccacatagttacagataatttcttagggtgattatttttagccgttgaaagactcttaaatgatccaagtatgtcactggggctcttgtctgctgacttgctaggtcctggatttgaaaagttttctgcctttcactatctactttgtgaagtttgggattgttaaaagttctagtttagcatgtaggtcagctatacaaataaaaggacttgcttaattcctgatactgggaggtgaagaattaaaggagagaatgttgcaccttatctcccttaatcttttttttttgtatggcctgcaaggtaagactgaatattgcctttttaaagggtgatttttcttgagatggagtttcactcttgtcacccaggctggagtgcaatggcacgatcttggctcactgcaactccgcctcccaggttcaagcgattctcctgcctcagcctcccgagtagctgggattacaggcgcccgccaccacacaggctaattttgtatttttagtggaaacagggtttctccatgttggccaggctggtctcaagctcctgacctcaggtgatccacccgcctaggcctcccaaagtgctgggattacaggtgtgagccactgcgcccggcctctaaagggtgatttttttttcttttttaaaggtggcggtgtaaagtacttactgtgtggttgttggttgtttgaagtggagtctctctgtgttgcccatatgggtcttgcactcctgggctcaagtgatcttccagcttcagcctcccaaatgtgtggttcttaatagaagtgtaaacctttggaaggatgtcattaccaaaaatctcttgggctgttaaagtcacactgatcttaacttgatcacagtagatccattgctaagccacataagtcatgggtagaccgtaacataactgacaaaatgttttggcactagggaaggtttaaagacttttctgcaggtgctgctaagggagagatgtcgaaggttccaaactggaaccctaaagacaaacatcaatgacatgtatgcaggagacattaggagagatttgtatgctggttatattaaccattgatcttaagctggcaagaagtcatccgtgttcaccaagtcactgatacgtgacttggagaatactagtaggtcccactccctgtgtcctcccaaagtacaatcctttactcttgaaatctaggatagagaactagtatccagtttgactcgtgaacaatgtgagtttgaaccacacaagtccacttacacacagattttttttgataaatatattggaaaaatgtttggagatttgcaacaacctgaaaacttcagatgaaccacatagccaagaagtatcccccaaaataaggaaaagttgagtatgttgtagatactagtctgttttattatttactaccataaaatgtacacaaatgcattagaaagttaatacagccatttgcagttgagaaatgtaaacaaacataaagattcaggcagcattaaatcataactgcacgacattcactgtagtaatattgtactattataatatgtagccactgcctattgctactgcagtgagccccttaaaatgccatgtgacgctaatcatcttcacatgaacagtttatctctccagtaaattgcatgtcagtaaaaagaacttgtagtacacaggtattgtggtttagtgcaatactgtaagtcttcaatagcaccatgggacccatgcaaagtggcgctagtgatgctgagaaaagtcatggcattgtaagaaaaagttcagttgctcgatatgtgctatagatgaggtctacagctggaattacctttcagacagatgtacacttaccgtatcgataagtgcagtactgtacatgtattttctcttacaactttcttagcattttcttttctgtagctttattgcaagaatacagtatataatacatataagacagaaaatgtgttaaggatttatgttaccagtaaggctttccagtcacgagtaagccattaaattttggaagagtcaaaagttacaggcagatttcaactgtgcagcaggttggcacctcaaacttctatccaccctcatagatactgagttattcaaggatacactgtattaccttcctgtccccctagtcctggggctgcagttgctgagtttgctaccctccagtcttagcccttggaaacatacagtttgtccgaaggcagaatcatagacaatatgtgggaaacagaagtgagtctgttgggtgtgaagggtgtttaatagagaagaaatacaaagataagtggacattattatcttacagtcatctacaaggcttggaaattggtatctggttgctttaggttatggagcatatagatggtaaatcctggagtttttataaccacaggattgtaaattagtgtatgcagttacgtgaattaaggtgttagactagtgtggtctggtgatctgcaacaaagtagtagtataagagcatttagttacggataaatttatgtataataagtcttatttaaggcaatactgtggattggcaaaaaagttttctaaaatttagcttattttttatgtagatatacagctaggataaagatagttatgttttaaaaggagtgggaggggggtcaaacatggtgaacatgctggagtagagtccgggagtttggatggattgggccatgaaaagcaaatgctagaattcctagttcctgtggcatggagaattatctggcaagctgtaattgtcttttgacttactaaaaagttttccagggaagttaaatttttttgcctttgttttcccattttgagttgcattttgtctatttttaagacccttaccaatctggataggccatagtataggagtggtagcaattagattttaatttagaaatctggctagtattagtgaatagtaaatgcccaataaatactaaaaagatttgagtacctaccttagtaatgtaagttattaagtgtttagtgtagtttttctcattttgcaggtaaaaaagccaatgaggcagctttcctaggttacacagctgttaatagttgagtcaagactaaaaatctagcagggcgtggtggtgcatacctgtaatcccagctactcatggctgaagtgcaagaacttgaaccccgaaggcagaggttgcagtgagccaagatcgctactgcactccagcctaggcaacaaagtgagactccatctcaaaaaaaaattgagtactgttatttctttttcttttctttttttttttttaagatctgcaaaggggtttaataatgcaaatatcacatatatttccatttttaacaccatatttaagttttccattttcttaacaatagaaagtgataaaaatgtttttcccaatgtaataatacaaatggaaaatattatagacagtcatacactaacccaatgaataagattcaccagaagcaaaatctattttgggggtcctatattgttacatatatacagggcaccagaaccacatttagactaatactttttatttctagttaaaacaatgcagggcactcctgtgacctgcaaatctaattgtacatatgtatgtgtcagactgtgcaggtggccaagaagaatagaaagaaagactttatccagctttggagttcagggcctgattgccccagctttagcccataggaacttgacagcttgttcatacctctcatctttagtcatagtttctctttctccaaccccttttctccctaactaccctgtgccatttagactggaaattctaacaggtagctttttctttctgaattatctttactactgtataatttttattttcagaatattccttatttctacatcttgaagacatttctttctagtagatgggggagctagagcttacattcactgccggaaaagggtcagttccagtgttaatttcccagcaaacacctgagagaaaaactgaacagaaaagaatagtgatggctggcagagagtgacacctgcacccagaaagctgcactgcagctgtctaatatttgagggtctcttttgttataactgccagtttaaactagagattctggctggttgcaaattcaaagcagatcaatacatttaaatcactggttcaacaaatcactctttttaatggtataatgtttttattgcaattgaggacgttttcagtaaataccttgagcttgaggccctggctaagtattccttttgcaatactgtttttactgtcatgacactggtcagtgaactgtgttagtttcacatatctatctatgtacccacaaaacacctccctgtctttgcaggagtgacattaccctgtgtgtaatggcagccttgtgctttctctgtgcagagacagggtcttgctctgttgcgcaggatggagtacagtggcatgattatagctcactgcaccctcatttccgggacttgaatggaggcccggctaattttttattttttatagatatagggtctcgccacgtaactacttttaattatttttattgccgggtatgatgatattgatatgtgaatacctgttgtaactacattagaaggcataacaaacagtcagagccaccacaaaatggattgataaagaaatgatgtattacccagataccatgagtagcattatcagtaatgaaaaattctccacagaagctgcatttttagtgaatttaatgcgtattaaaacagtacagaaatacatacatgactcagataacaataaacaaatttactttctataccaaatctttacatagtcttctagcaactaacacccaccacttccattaatgcagatagtgctccctatctttggaaaaaaattttatttttttattttttttgagatggaatctcactctgttgcccaggctggagtgcagcagctcactgtaacctccgcctcctagcttcaagcaattctcctgcctcaccccccagagtagctgggactataggcacacacagccacgcctggctaattttttgtaattttagtagagacgaggtttcacgatgttggccaggctgatcttgaactcttggcctcccaaagtgctgggattgcaggcgtgagccactgcacccggactggaaaaactttaaataccctgccaggggaagtattgcccctgttgaaaatcactattctagactttgcctgtatttgcctttcttactctaccagttttttattgtatttccccttagagccttagagtttgaaattcagtcatattggagagcagaactaataaatgatggctgtaatctgtttttgtggtgcctatggagttatggacagatggacattaggtacagccatcatttccctaggcaatcctaatcatctagcttgaaaggtcagttttcagtcacttgccttaagtcgcttttacagtttacctgttctgtttttttaattatcctgttcccatcaattaaaaatgttcttataataatccaagctataatttacaggtcagatttaaagttaattttatgtggatcctttgatgcatatgttgcccccagttcagcaagaagctaacagtcagtaagccagtttgtccagttcattgtaacctttgttccctttgtcattaaacgctagagctactactgagctttttctcactctgacctgacggagtaaagagggtgaggcaggccactgcaggcctggaaatccgtttccttctccagtggtgattcttgctcctcgtgttatcaccttaatcccaatatccaggctaaaaagtgagattattctctaccccctcgcttctgacatccagtcatccacaaagtttctcattttgcctcaaaaagagatctcaaatgtctttttatacatggctccgtggtctaaaccttcatcagtccttgtctggacttgtggagtagcttttataactgggcttttcttacattcaaacataccttatcacccaaaggtcacagttcccattaggtttcactctttgcgttatacattctgttggtggggaggggggttctcatttttatgatctcaaggaaagttggtagttgggagatgcaggataaggtgagaatgtaactactacttctgttggtaaccatgctctagaggtaagaggagggtgtgctagaacagttaatgtttaataggataaggaggggcagaatatattttgctagtcattgctaccctcttaattatggctcagtaggtcacactttaatttcttagacttttttttttttttgcctatcttacgggtaatgaggctacaactgtttgcaactgctgaagtcttgaaagcagagagcatggtggcttgtgttttttgatttttgccaaatttcctggtacctaattggcagccagagagtctctgggaaaattaatctttgacaacatgagatttatttcattttctaacttgttcaacttggttctgtcttgcaggaatgacaccaaggaagatgtatttgtacaccaggtgagtgcttgtgtagatatttgcacttctgattcaaggattgtaagaagaaaaggttagatatgttctcagcttttgttccttataaaaggttaagtccaaccaccagtttatttacttacgacaggagtagtagcatgcttaaaaatgtatacgtggaaatgtgttagagttgacttaattatcctagacatttcaaattggaattttgtcaacagctgtggctttctcaaatgttgagtcaaactcactgcattaaatatttatacctaatttcagatgaacagattattccatgattctaaagttgaacaaataatgttgctataaatacacagaaactttggcaagaagttttcaaaggcttttaggtgtacctgtagggacaaatctccataatcaagggtaaataagacagacctgcaaaacatagtaattgaagtgagtacttgaaaagtagcataaagagccttctgcttactttaaatcactttgaatgggtattgggttttttttttttttaaacctttggagagttttggctggcttggaaaatgaaaaaatttcactagtttaaggttaagtggggggaagtgtgacaaggttggcagctgctcattaaataatttttagattggcttccagtgatttgggaagagaaaactgttaacataggatgagtactgatgagtactgcatagtgaactttctccctaagtatcatttagggaaaatgtttgcacattcaggaattaagattattactaatgtaaaccactgccaagtgtatgttaatacttcaaatttagatatgctgtaggctacattgaatgtacttatcctcacagatacgaaatgagtaggaaaaaatatgtttgtgctatcagttttctcactaaggcttttgaaatattgtcaacttgtattaaaattagagaccataactacttttttgtactataatccagaaatcaaaagacctaaaagttaatatccatactcacatttaattagatactagcttttatggcagcatgtttcataggaagggctgtcataggttggtgctttgtagctcactgaagtgtcctacacagtatttgatgacaaggaggaagctatatcaatttctagtacacccaaacccaatcaggtagttcagggtcaaatgtaattatggaatcatttaaattctaaatgtaaataaatacaggactacttcagacaaaatgttgttttaaagtagatgttttataaaattggtattcttgtttggaagaacacagctcaactgttccttactccccttctgcatgttcaaaagaatgtgtagacttaggaacaagagacagcaaagtttctcggtcttgttgcctgttggcaacccttaagggttggggttggggcaggggtggagatgttgataaaaataaagagttgggattttaattatccataattctgctatcccctatgactgcaggtaattgatagttggctatatctgaaaggtatgaaaactatgtgacagtttagatgacagatgagatcaattatttgactcaactcacccagttgtactgattcacaaggtgccaccaatatgctttcatttttttggaagtggtttcaacatgtagttgtttcttgggactttggctgctcaggtcttagtggtgtatcagggagactgcagttctgggcagcttcacttaattggcctcagattcgttgattgtcctgtctcctctgcaatggaaatgcatgagtgatcctgtaatggatatagctgagatttggagtgaacatgggatttggagacccaatacctgggtttagaaagtctccttactaactgtgtgaccttgggcaagtcacctaactttaaagcctgttacattatctgtgtaatgggattaacaatactttcacatgtcctgtctcataatgagattgaatagatagtaagtgaaagaatgttgcaaaaaaatttcatagaaacgtgagatgttactcttcctcccttctcttaacagtctggagaaagtagaagcaacaagtctctaatacaagatttattgaattctggggaggtgataactaacaattccatgcagtcagatcatataaagaatgacatagttaatacacatgaattgcatttccactgatgtattatcagattggaagggattttggttgacatttgtaattgagtttgatacggtaacacaggggcaaagttggtttggtcagctttgaagcatgcaaaaccaaactcgcctgtcatctaaactgacgcagtgtggggccaccttctcctattaagtgcagtcctcaggggatagatggatatcctcatttgttaaaagttatatataatgcttttgcaaaaagcagtttttaaaatgatgtgtctgtcttgagtgttaaattacttgttttagttttgtaaatagtggtacaatgctggggccttgtatgattggagtgtttttgttgaagttggggatagtgtggtccccgctttcctaaatttattgatggtttggtcttatttaaagcaaatcttaagtgtatatccaagctaaaataatattgactctggtacattttaaatgaaaaagcacattattctcccctgttaatctatttttggaatgtgatattactagactgccataaagaagaataaccccaggaagtaccttcgcagtgtaggagatggagagactgtggagtttgatgttgttgaaggagaaaaggtgaggatgctttttgtgtaaaggtttgacttcagtatggaaatattttggaggtctcatccattaggatggtggctctaatgtggatggatgtgttcaggtgacctcatgaacacaggtgcatcaagcctaatgttctggctgcagttagagggcaatctcttcagaacagtgaggaactgatatttagtcatttctgtgcacccctggtcacgcagttgcgcccccccccccttttttttccttaactttgttgttttttgctttgtttgaaaatgttctgatttccttttgaaagtgttgaaagtgttctgatttcctttgtcactatcaatatgtaatggcttttgtagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggaggtaagtttcaccatcaacaacagcaatgtgataagttctggtaggactgtttagagctgttaattatatggaaagcaacttggattcctagtaagaaccaaaaggattaatttataatgtagtcacaattactagatggtctgttttgtttgttttttaactcttggatttatctggttgggtttttttattatattactgacccagtaggcttaatttccattgtctttttcagggtgctgacaaccagggtgcaggagaacaaggtagaccagtgaggcagaatatgtatcggggatatagaccacgattccgcaggtatggtccacgtaaacatgtttctattaaaatttcctcaaacccgtgttaggactcagcaatatcatgcctctcctgcagactcatttttctgttaacacttcacgttttctttcatcagatgcctaagaggtgaacctattaaaaacagcttgtatagatgaggtctgctttatacataaatttttttagaaaatgatgagggtttggaatttcaaattttctgtccttgaacaggtaagataatattttaaaccacaccttttaaacctgcctccttggtagggagaaaggaaagcattaggagtatctgaattgtaccatggcattagtgaagaatcaacagtgttatcacttgaaatggcatacattatcttccactaaacacttctcagtttagatatgtacccccttttttttggagttgggagttgtcagctcaaagttgcaaaatgaaattgctccaccaagaatttacattctgcggggggaaatccagtctgtcgttagacaactatctacttgagtgggtattagaaatcttattaatagatgtcattattagagtaatcgaggaaaaattccatgaaccaagcatattttagtccatgccgtagtatactttgaggcagtgttcccagtcccacggtggtaggataggatggtgtaatagttgtttctctaagggtttgatatcaaagcattgagttttcataggtgatccccaaaagctgacaggtacctctgaagaatcaaaccaatacagtaataacgcatcttaactgatcacttaaatcgcaacttttaaatccccaaatttttaagtgtcaagtttattattctagaagtatccaacatatccaaaatatactgtgagtctataagagggggtttctgtatataggtttttaaattttaccaaagttggagcacttagtgaagttttaggaactagggaatctagtcgaggttgtattacatgtatttatcagcacatgtacattgagagttttgcaagagcagctgatgtcatcatattttttgtattaatatgtcttgtcctgagttttcagttaaaagagctgaggtcctaactgatcactaccacaattgaagatctctgattcagttttctaccaggagattgtgttagccagatgctggatgttgaagatagatgggtttttatttttcagagtaggtctaaaatagcctctcatggcagtccatctgttaagtccatgggttccagcagcagaatctttggtttaccttttgttacactgaagagcttaaatgttttgcctagtttcattgatgtccttaaaaatagcataattttgtgtttgtattcagtgcttcagttcaccgttgagtaaattgtttgtctttatattgacaaacaagcttgcggttgatttgtctcttagaaaggtatctttgtccattgttacccctccagtgcagaggtttttgccttttggtttaagttagacttaatgtctacgtgtttcaatgtttagaatgctcagtcctgccagatagttgcagaagtaacataaaattgcttggaagttatcaatgaatgctagactttccaaactgtgcaggaatcttttgttcaaatgagagtaaatgaaacatgctgcccctaatgcatggaatggtgtgaaattctgactggtgtgggttcaagagcaaactgaaagggaaatcttaagacagagtatagtacaagtgttgctgaaaatgagactaatagtagtaaggggaaaatggggggtcaaaaagggaggttttttgttgagaaataacatttataggctgaaatgcaatccaggataacagttgatggcaggaaagtgactgctggaactgttttctttctcagagagggtagggttttgcccacaggtgaaaatgttgaccttttgttaggaacctgccgttttcctgtgtaagaaacaagaatacatgggcacgcatgtgttaatgggaagacatggaagcctttggttgctaaattgagacgaaagtaaagaggaagtttgaaaagtttggggcaaagaaccctctagaacagaaaatagagatggtaaatttataagtaataggataacgatcataaattagaagtgagttcacccagcttgactctgtgtttctagccatttgggcatcaggctcaggttgggcagagagttggatttatccagatttggtttatccagatctggtttgatttatccagatctggtttatccagatgaagacactggggtagggattggtcatatgattagtggtagactttatacttggataaagaggggagaaaaggggaaaatgagggttgtttttttttttttaaattgttttgtagaaatggagttgcactgtgttactcaagcagtcttgaactcctgccctcaagtgatcctccccaagtgctaggattacaggtgtgagccactgtgcccaaccttggagtgagatgaataggtgatagaatcgctgtattacaggtcctagattaagaatgagaaaacaataaggaattacctaagaaaaataggaaggtacataattggaaagttgagtggtataattgaaaaaacccaggtagaaaacagctggactgggaggtcagtctgaaagcccaggttattagaagctgttacactcgaaccttagtaataactgcagtaagaaaaagatagtaaatggagcagaatccaaaataagatggaaagcctagtttttagaaactgggagagttgatttagaagccacaataaggttagaacagtcaccactgtagggttgcagagaaaagtcagaacaattttgttgaagattcatcatgagttccaaaagatgtggggaaagagttttagaatgtacaaaggtaaatgtgaatttattcccatgatgactcatggatactaaaggcctggggctttctggagtgctcagagtatgggcagaggaaaggccaggaatccatcatttctgagcactgggggaaagaaaatcccaaaatttagtatctttatcttggtgattaaaagactcaagcctgtaatcccagcactctttgggaggccaaggagggaggatagcttgaggtcaggaattcaagaccagccttggaaacatagcaacacatcgctactaaaaatcagacattaatgagacgtggggggcttgcctatagtcccagttactcaggagtctgaggtgggaagatcacttgagcctgggagattgaggccacagtgagctgtcatcattccatggcactttagtctgggcaacaaagcaagactcttccccctactcagcatccccccccccccaaaaaaaaaaacccatctctttacacaaattgcctacagaccacttgatacagaatgggccagacatggtgagttagttgtgaaccaactggttacactggtgggtgtgttgaagagagaaggttttatcattcttaagtttgacaccgttcattgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccgggtaagcaagcttggatggccatccatttatggcagtcgtgagtggtgaccatttcgttttattaatgcaagagtagaaaaacctcagttccatcagataatgaaagccatgttatttataatgtgttctgccctattcttaattacctaatatttcattttaggaatattgaatatcagagtcatatttggccacccttcagctagttctcaattctgacactggagacctgtattttcatgagtattttgaactattagtgctttctatcaacttttctgaatgaattttatgatttcactagtaaacagaggaaagttttgctagctgtattctgagaaatatgttaattacattattatttatgcattatttcaaaaaggaagtggggatagctgttagaattaacctagatggtgacaaatagagtctgtttggagaaagtggcaacattaatataatcttttaatcatttctaattgttttttttttttgttggtttatgttgttcccggaaaaagacgagagtgtttcgtgtctaaaaaactcctagaatgacacgtggtttatcatggtttatttaaactgcctgtagattaataataataattctctggcagaccacatgatacaattacgttcttgttactttagctcattagctcacttgtttttattacccttaattccaaaattaagggattctttttcatttcgctttttacatgatatcgagaggtacgtgattgttgttccctccaaaattagcattcaaccagtggtgcttttggttttttcccgtttactatttgctggatggcaagagatctgttaatgtctcccaatacacaagtaatgtaaactagggcatgtactacactaaatgaagatcaccatgaattctacatgatcatctttatttttttctttacagtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataat

SEQ ID NO: 2168 - DNA, 34418 bp, Homo sapiens
  source 1..34418: mol_type = genomic DNA
tctccattgcacttttatttgaatgtaatatttgggacaattattcaaaagggccaatatttcccaatttaatctgaggtcataataaaacaagcaacaaaacagtgtttgggatttcagtttctcacccttatcatcaagactcactgcctcccatcatcaatatttattgagcatttacagtgtactaggcacaatagaacatacagaaaacattgtccctgctcttgaggagcttacattctaaaagaaaaaatacaccttttttaaaatggcatttttgtttggtgttttctgcaaagtactgaggaaatattttgtaaagtgagctttgggtataacttagccccatcattatttagagaatagaggaggaagaaagaggaaggattttaaaggcagacaatgacagaccattcaggataggtagggttttaaagggagataaacacagtctcatcaactaaggagagatttgctgcagtaaataggatgagggaaatagtctgtgggatgcaagcaaaggaagcagggtgccttagacactgagtggagccagaaagatcatgcggcctttttccaagtacatggccaccaagtaagaatggttggtgacaagacagaaggctaaaacaggaaggtaatcttgtgcacctgacaaatagaaagaataaaggatcaaaattgaaggcaggctataagagtatcaagaaattcttaaaaaccaaaaagtgatttggaagcacaaaacttacagttaatgctacccaatgtcatgatgggccaagaacattgtggcttcctaagttagaaaatgccatatgccaaaattttaaatggaacacactacatttttttctaatcaatccccccctctcccagaaaaaataggaactcatttttttcagggtggggaggaagagaggggatcatgggacatggaaacagtagttatattagtagtatttttgttatgataaattttgtgtttaaacttggtaagagcccattagctgccaagagggaataaggaataaatttcaaaaaatgtacaatttcctttagagaagtttcagaaccaagactaatttacatgaaaagctgtagagaaagtagttgaaaagtccattcataaaacttttattccacttacatgaatttaatacacgtgttcttaacaattatgcttggattgttcatgaaaatttcataagacattaaacaaagctagccatcatctcaagttatttccctgttaactatttttacagcacatgcatgttaggcaagtatcaaaaaaaaaaaaatcacaaaagcaaaaatcctaaaaaaaagttaaatacatgggtttttgttttactgctgtgcttgatatacatgaagtaatgaataccaagcaattcatttttcctgcatctttacttttacatttgttcttaggttgcctaaaacatttaaatacaaataaaatgagtgtagcaaaaataatgaaagctaacagcaggtaactttacaaataatggaatgtgaaccgtttctgcccttatccagagtaaaatgggtcacaactttgtctaaaggaacacttctgcagctgtagtcaaaggtgtacacattgagtattccacagatatacatggtttaatatgtggtatccatggggtatgattctaccacagccttgtaagtgctccaaaccttaaagtacccacaattactacacctgtgactggaaccaatgatcccttttattccccgccaggacaaaccagtatgtaggcagttttctttgcttagacatggaagcagttttacactggcccttttgaagccacaatgtaccaaaagtactatgccaaacacttataacttgtataaaaattccacatccccatattggccacctcaagatgaaaacagataactccctaaatgttaactggctctactcccctaatattaaacataaaaaccacatgggaaatatagaaattcaaatagaagtaacataaacctgtcataaatcgtaaacaaaaaactatttgtgggacagcatggatgacaaatggtctactgtgtaaattttagaatgaggcagacaaaagttggaaggccggttaattttcccctccttctcctgcttcagcttcgtctccttgggtatccgatgtccacaactggtaaaagaaggaaagatttttcagcaagtttcagtgggatgggggggggggggcgttttcatataagtgccaagatacctgaatgttttagttggaaagcattcttaaaaagatagcagcatcacttagcttcaagatacaaaaacatctcaatatacaaatttactttttttgtaaccactatataagcaggttaagtacaccacagagttgccttcaaataaccttcagatacaggaaagttttggttatccacagaaggtgaagagaaattacaagaaataatactttttttttgagatggagtctcgctctgtcaccaggctggagtgcagtggcgtgatcttggctcaatgaaccctccgcctcccaggttcaagcgattctcctgcctcagcctcctgagtagctgggactacaggcatgtgccaccacacccatctaatttttgtatttttaggagagacggggtttcactatgttggccaagatggtcttgatctgatctcgtgatccacccacctcggcctcccaaagtggtgagattacaggtgtgagccactgtgcccaggccctaaattattttttaaaaactaagcatcaataggtgtcagaacctaaagagccccaatatgaaagatggacgtccaaggtgagtgcaactataccagaagcatctaatttggcccatgctgaaggagctagggttgactactctccactggtagatcttaaagtgactcacactccaaacagaatcctatactccatgaaattcaagaaccagcctcaactctgagctaaactacaaatctagcttttctaacactttaagcttagaaaaacaaacctttatttatcaggttggtgcaaaagtaatcgcagctcttgccattactttaaatggcaaaaccctcaattacttttgcactaccctatcatatgattcaaaataaatgctggacaaaaaccagaaccaaatcttttaacaggtaaaaatgaaagttgtcccataggtggcagggttatgaactctattccacctgctccaatgttaaaaatgttgaagtcttaaccactctctagtgattttcagaggtaattacaaaaggattcaagacaatcttaaattttatatatgacttacacatgaaaacggaggggaaggggaaaatacactaattattatttttatattccccaaatcatccattagcttcatttatctactaagcaaatatatctctggcctggaaaggagactacttccaaggtcatacagatagccaaatgacctcttggaaactgtgtgctcctcctgtcaaacaaggggttttgtaattgcaagatgaaattgtttctaatgtctctttcctgttctaactttcaaggattcttgaattttctgtataaacatgcaaatttgatacaaaatatttctttttctagagtaatgtgttgacagtcttggtcaaccaaattcagaatgaaatattaagttttgggataatttcttttcttgacagataaatgttccaatcaacctataatggtgacagctgacactaataaggctcagagaagacatacaagtagtgacagaattagaatcaaaaccctggttttttcttttctttttttttttttttgagacagagtctcgctcttttgcccaggctggagtgtagcggtgtgatctcagctcactgcaacctctgcctcccgggttcaagcaattctcttcctcagcctcccgagtagctgggattacaggtgcccaccactatgcccagctaatttttgtatttttagtagagatggggtttcaccatcttggccaagctgttcctgaactcctgacctggtgatccgcccgcctcggcctcccaaagtgctgggattacaggcgtgagccaccacgcccggccaaccctggttttcttattgcaatatgcgctcttcatgctatactgatagcaaaattcagttggaagcagacagtagatcagggcctctcaaaaagtgatgtgaacaaaacacagtatctaggtctcaggtcatcactttaaaaatgtcatcacttcaaactagaaaagaaaaatccttaatactaaagttagttaacaaagtgcttcttatgtttgatatataagattctttcattctttactgtggcttgttatcttgactcaagtatcagaaaagtttatagatagctccaaattgtgctaataaagtaattttaggtttaataaacaagtatacaatactattcaaaaaactcttcaagattttcagcactagcatatagaactggtttatagaaaatggcagtggactagaataaagttggaagagaaatgtataaaatgagattacatagtccccaagagaaatggccctagaagtctaacaaaaaaacagtaatacctagattatgatctgcaattcctacctctttacctgacacacagcaaatgcttgataattttttcacctaagcctcaaaatttcaaatctagtatttatctgaaggagaagaatgagaagacctaagaaacaaacgagacatacaaatcaactgcattgtggactgaatttgaatcccaattcaaataacttaaaaaaagagagataattggaattcaagtattatttagatattcaaacattattagggaattatgttgatgttcctggtgtgatagtgacactgtttctttttatacatctgcagtatcccaaggacaatcacgacctttcatattaagtcatttaaaataagaagctaggcaaaatagacttccacttggattctgtagatacctgagattttgtaactcaagttattaattccctaccattatctttaccaatatggaggcaacttgatgggcaagaaaatcattcttaaaggaactaaaacatgtagagtctcagcacacttttgatactaacaaattttaacaagacaggtaactcatcaatgtgtgtattttttagttctcagtctaatatttcagtttctgtaattttccttcataggactttaatagtagctgagatatatttatgagagcctatgaaatgtgttgagaaaaaattttaaaagatgtatttaataaaaaaaaaaattccctagagtaaaacataacctcttcaaccacattcatcactaatgatgctgttatgtacttactgtcaagttgtctctcagtaattgcattattagcgtgctgtctttgtatgactcttcacttaatgtatcaagttcagcaatggcttcatcaaaagcctacgatttaaaaatagtacattacatttcagtgctcaaataataaagactgctaaatttctacgtaacaggtaaaatacatactgtctttgcaagagagcaggctttctctggggagttcagaatctcataatagaacacagagaagttaagggccagacccagtctgataggatgtgttggttgcatttcctttttgctgatttcaaaagcttcttggtatgcttgttgtgactgatcgacaatccctggataagacacaccaaaacgtactgagataaagtgtgcattatatcttcacccctcaaaccaaacctttaatatctcacatatcctttgaaatactaacctgtaacagcttaatatttgttaattgaacaaggtccttttttttttttaaagggagctttctcctggtacacactagccattgatcaatgtcaagataaaacaactttataatctcattattgttatgtttttaaaaaattgacgagttttgacatcccagacccaagcaatcctcccacctcagcctccagattagctgggaccaaaggcttgcaccaccatgcccagctaattttcaaaatattttttgtagagagagatgttgctcaggctggtcacttttcttaaaatcttgaaaaaacatccctgtacacaatattggcttttcagaaagcatttattttagaatagcagtatgaggcagtagatgtgtattctcagaacacaaagagcactgctactccttattcggcactctaagcaattcaaaacaagacattatgtacgcttcagagactcttcctcactatgttatcttatacaagttcaaccaacaggtttaaaaacagcatacctttcttgtcatcaccagcggcaacctcagccaagtaacggtagtaatctcctttcattttcaaatagaagactttgctctctgcttgtgaagcattggggatcaagaacttttccaaaagagacttaagaagaaaagaaacagacatagtgagaataaaacatttacaaaactgaaagaacttgcatttcttaaagaacaaactatagcctaagttataaaacttaaacacccagtcactgtcaatacaattgtgaatgcagctggcacatgaatttgtggtttaaagcagaatgctttgggcagcaatattttaagtttgaagttagtgttcagtttattatttgaggacaataaaattgaacattggtccctgacaatgttatctatttacatgctgacttcatgaatgtggggcatgaccgttcacatttaggaacattttctaatgagctggcaagctttccatctgaagtttcatgtggtcatgacatgaaaatagaaagaacatacgggatgaaccttttgggactctggagaaatgactaaagcagaaaccaataatgtaagacacttaaggagtccatgccagagaaggaggaacaaaataaacttcatttataacaacacaattcaagcaaacctcacaacagataaaaaaaccgttcaaaagttttatttttcctaaagacagtggtaggagacttacagattttaaagagcagacctttaatctcattgaagtcattttcggctagtaagatacacgattacagatcatcccagacaacagataaaattaaaacatcatcctataaaattctgtctaaaactactattacaatctgagtcatttgattaggattttaaaaattacactctttaactgattttaaagcaaaaagattagatcattgtgttggggatgggaagaagtctcaataaatgtgtaatttttttctttccagttaagggggagaaaaataattctagtagtagaattaggtaaacattaaagcaaaaaaaccccaaccacccattctcactaccccacttcctttaaagttcaagtacactctgagaatcaaggtgaagtcaattttcagctgagctaaattccaaatccattcttacaaaaaaaaagtattagtttatatagcacctacttatatataaaatataaatttgaaaaatgcttttaaatggtaactccaactttttgtttacccattatgttccaatgctgggtaggtgaacagttttaacccaacttcttcccccaattttttttttttttttttttacaactcaagctacagataacccagatgaagtggcagtagggccagattgcactgtgctatataaagaggttaaaggtgagaaaagtcaacctgaaatgatgtttcctgcaattattaaccgatatttaaaaatactggcctgaggccgggcacagtggctcatgccagtaatcccagcactctgggaggctagggtggcaggatcacttgaggtgagcctcgtcaacatggtgaaaccctgtctctactaaaaatacaaaaattagccaggcgtggtgacgggcgcctgtaatcccagctgaggcaggagaactgcttgagcccgagagatagaggctgcagtgagccgaggttgcaccactgcactgcagcctggatgacagagcaagactccatctcaaaataaataaaaataaaataaaattactggccggaaatcagaagaacgttttggttaggatagcaacctctgtcttacaccacattcatactttcatattcaaagttctcttagctgcaaaagtgttttgtcctttgaatacaatgctttttaccacctatggttgctctgtggagatctgcctcaaacagtggaagacacttgcatttaaaatagtcaagtgagtctttccacttaaaaacaatggttttaagaaacaaatgaccaggattttcaaaagtttcattgttacacaaattgtattattcattcaactatgggagatggtataaacataagtggctttggggtgagtctggttttgaattacagcactatacaccgtgtgaactacttaatctcaatgattcagttatctcacctgtaaggcagagacctctaagattattgagaaaaaatacaggtaagcacttaggagtaagcacttaaaattttatttctattatcacaataacaccagacaccatgctagaagctggaagcacaatattctggtaattcataatctagctgtagagacaaggctatcattccttccattacaatacactttacaagaattgcagggcacggtggctcactcctgtaatcccaacactttgggaggctgaggtgggaggatcacttcttgagtccaggagtttgagaccaccccggtgaacatgagatcctgcctctacaaaaaaatttaaaagttaaccaggtgtggtggcacacccctatagtcccagctacttggaaggctgagacaggaggatcatctgagtccaggagtttgaggctgcagtgatctgtaattgaattataccactgtactctaggacagggtgacagtgaggctgtctcaaaaagagtaacactgcctaatcacgtctttcacttttcggtaactttaaccccctctatgtatgcagagatgaaggccataaacacatgcagttacttaagagtgaaccagtcacttaagatgtaaaattttaaagctgtactaaaaacttaaatttttttaggaaaggtgttgataaatgctactaaaagtagtaatctatcttttgtaggtagtaactttctacctgggtaatatgctgaactaagcagttccctgggaattaaaatggcagttaagcacttctttccccaaagctgaacactgaattaaccataaaacaactttaaagctatttgttagaacccacaagtaacaggagggctgggtaaacagcagtcaggctgcttactggcctaatgatagaccaaaagaaccaaacaagtggcaagtgtttctggtgagatgctgaccataagagttgagaaaggtggctgggcatggtggctcacgcctgtaatcccaacactttgggaggctgaggtgggcggatcacgaggtcaggagatcgaggccatcctggctaacaaggtgaaaccccggtctctactacaaaaagaaaaaattagccaggtgtggtggcgggcgcctgtagtcccagctactcgggagactgaggcaggagaacagtgtgaacccgggaggcggagcttgcagtgagctgagatagtgccactgcactccagcctgggcaacagagtgagactccgtctcaaaaaaaaagagttgagaaaggcataaatggcctacttctaataaatcgtccaatgacataagctaattaagatttaaaaacccaaaaccaagcaagactggattaaagattaaatttaaaggggctaacactgtagctcaaaaaaagctaactataaaagaacattttctgccaggtgtggtggttcatgcctataatcccagcactttgggaggctgaggcgggtggatcacctgaggtcaggagttcgagaccagcctggccaacacggtaaaacctcgtctctaccaaaaatacaaaaaattagccaggcgtggtggcacacgcctggaatcccaggtactcaggaggctgaggcaggagaatcacttgaacccgggaggcagaggttgcagtgagctgagattgcgccattgcactccagcctgggcaacaagagtgaaactccgtcttaaaaagaaaaaaaaaaaaaggaacatattctcagcctcaatggggtgatatacctactagaaaggacgttattccacaatcaggaatcaaagttatggcgagtatactagaaactgtcaggataatggaaagaacaggacatgaatggctccaagagacaagaccaattaaatttagcaagagggaagatttctgttcagtatgagaaaacttatgagtggtccagtactggaacctgctcagtgaattccctcttttcacataaaggtaaaacaggaaactaaagagggtaacttaggtattttgtagaggagattcataaagaagatgtcatctgtttcttttaaaaaaattttaattgacaaaatagttgtaaatattttgggggtgcatgtgatattgatacatgcatacaatatataatgatcaaatcagagtaactgggatatccatcacctcaaacattgattttttttttttttttttgagacagtcttgctctggcacccaggctggggtgcagtggcgcaatgtcggctcactgcaacctcctcctcctgagttcaagcgtttctcctgccttggcctcctgagtagctgggattacaggcatgtgccaccatacccagctaacttttgtatctttagtaccaatggggtttcgccatgttggccaggctggtcttgaacttctgacttcaggtgatccacctgcctcagcctcccaaagtgctgggaatacaggcgtaaagccactgcacctggcctcaaacattgatcttctatttgtgttaggagcactgcaattcttctagctactttggtagaataaataaatgttaactataatttccctactgtactattgaatactagaacttatttctactatctaaccggatttttgtacacgtggtctttttcaattctaagggaagtcagagttcacagaattaatttaatggtaacataaaagaggcaattaagtatgttgctttgtcaaactgaccgaagaataacaaatccaagttttccagatttggaagccagaagataaaacccaatgtaggaagaatagaaaaaaatgaataaaagaacaaaagaaaaaggaagcagcagttacaacaaagcagaaaaaaacatggaggtgcaccaagtagagaatggaagggaggaaagggctgatagctactttcaaaatatgcaataacttcagagaatatcctgctcaacacagaaataaacctcctaaatttcgttcacctacaatagtacaatgaaagcaatcatgactgaaataaagtctgaagtaaaaaggggagggagtgggcacaccataatataaggaagtatacactaagtgtcacaatttcaaccgtatttagaacgaagtctcgctctgtcgcccaggctggagttcagtggtgtgatcttggctcactgcaacctcagcctccccggttcaagtgattcttctgcctcagtctcccgagtagccgggactgcaggcacatgccatcacacccagctaatttttgtatttttagtagagacagggtttcactgcattggccaggctagtcttgaactcctgacctcatgatccacctgcctcagcctcccaaagtgctgggattacaggtgtgagccaccgcgcccagccaactccaactgtaaaacaagggctaggttgactgaaggttcaacttgtaaaatttttcaattatcacagtaccttaagtttttaaaccaaatctaaatggttttgaggtcaaacaaaattcaagcacatcctacactcaagctaaatcaaggctaaatgttaatctgttgaatcttcctgaaatataatctcatttagaaatccacagtatttcctcagtttacttcaaaatgtggatgtaagttttacttttttccctcccattaatttttttaatttttatttagagatgaggtcttgctctgtcacacaggctggaatgcagtggccccatcatagcttgccctgctcccattaacttttaaatatgttttttcatgacagccactgtcttttaaagatatcatggccaacattttagaaaatacccaagattaatttgctgaattagagttaatgcatttatacagcattcaccctaataatattaagtgggataagaaatcatttactcagcagcaaaatgccacaagaagccggtatctaatactctttggtaaacagctcctaatccagagttaaatatgtgatatgggctctgaagagaggacactaatccttaacctaaccaacaggtaaattacatgaaatttgagattttagagataaaagagatttttctctctactgcaccgtagtataattaacctcttagattgtgaaaacacttccaagagatggggttcaaataacatttttcctcccaagccagtttccaaaagatgccttaatccaaagatagtctatatttacaatgatgttttgtctttaaaattaagtctattaaaattaaggaaccacataaattgacaggtcatctgtttctgatcccttcttggcatagactcaacctgatcccactaatatgaattttataaacactcactcctgcctgtagtcaaatattcctaatgaaaagttaatgaactgagaatctatctctagtgatatgcctttctcactggtctttcagtatgattacccctaaaccaccaaaactgctgcctgagctggtggcaagactttaacctttcgggcattcaacacttgttagaagaaaagcttgatgtaatgcaaatcgtataaactctaaaaccaggcagacttgaaattccaccctaacccattaattttgagaatttacacaatagctaatctttattttctcatctatatgaaaatccacatcaaaaggctgttatgaggtctaaatgaacatataaacaggagggcaccattcacagctcccaaccgagagtaggcattctactcactggttgctcagttatgtgaaaataaagtatggagattctgacattcaaaaatctgctttagtgctcttgtactcttaagtacatcattttggctttggtaatctaaaatttgtataactaggaaaaatggtgaagtaggatgcaaaaaagttttcattcaaaaacacaggattaagacatatcaaagaacaaaagaaaaaagaacaaaagaaaaaaagaacatttcctttagtatttattttctctttttaaacaacagacttgttaggaacacaaactatggagacagactgcttactgcctaaattcaaactctgtcaccttgacaaaactctgaaatcttcctgggtctcagattctcatctgtaaaaggcaaatattagtagtagacataatgcacaaggttgttgtaaggattaaatgaattaacatataataagcatttagcagagtctggcaaatagtaagcaacaaagaagtgctgccatccttttggaaggtgaaagtctagtgtcaaccacattagacttcaagtactgtttgtactgcagtaactgatcttaacccacccactcacccacccaaaaaccaccttagctctgaactccctcttatgtgaaataatttcctaatatttaagtaatattaccttatttctcccaaccatggtacatatatactacctctataaataggtacattttctaggaaaaaaccctaaacggtaacaatacttcaaatttatggcttaaaagtttgtctcaagacacttttacagtcataaaaaagtagaaaactaagatcatggtggtagtaattattttccaaagttctcatttttgctccaaagcttcaattttatctgtcaaaaatatcattttcccttaaagtgagaggctcaattcatttaagatatttgtcgaatacctaggtctgaatacccacagcttatctgcctgcagttctttgaagaaaaaagtgttccataaaaaaagaaaagcagctagtttatctcacaattcaaataactgcaagtgtttttcttagagacaaccactggacttcccattttgcctcactgaaagatgtctatttaagggctattaataaaataatgtttcagattcaaggacattaaaaaaaaagtcttttttctttttaaaagaaacagtgagtgcataatggtaaagaaatacaataatcactagtacagtatagtatcactgccttgattagcgataaggaaccagtaagtttgagcaacccttgggtttgcaccagtgctaaatgtcaacaaagtgataagaatcagtattaacagtatttgccatgaaaatagttgtgacctggctcggcgcagtggctcacacctgtaactccagcactttgggaggccgaggtgggtggatcatgaggtcaggagctcaagaccagcctggccaagatggtgaaagcctgtctctactaaaaatacaaaaattagctgggcatggtggtgtgtgcctataatcccagctactcgggaggctgagacagaagaatcacttgaacctgggaggtggatgttgcagtgagccgagattgtgccactgcactccagcctgggtaacagagtgagcctccgtctcaaaaaaaaaaaaggaagaaaatagttgtgactttttgtgatgtaatagacacctccccaaaggactcccagtggtcggcatatcacttttaacaactgatttaaagtaacctctgctatgttgtacaccttaaatatatattttttttgccaatcgtacctcaataaagctggaaaaataaaatgaaaagaatctgtgctaaatacctctccatacctagctctaatgctatgttctccctaaagctaattattcaaagctattcagcttcatctacattgtctgtacagatagtgtgtagtgtagagctttttaactgaagagaaaaaagggaaatatcctaatttctgtcaataaaggactaacggccaggtgtggtggcttatacctttaatcacaatcactttggaaggctgagctgggaggattgctggaggccaggagttagtgaccagcctaagcaatatagcaagaccccatctctactaaaaataatttaaaaacttagcctagcgtggccaggcgcggtggctaacgcctgtaatcccagcactttgggaggccgaggtgggtggatcacttgaggtcaggagttcaaaaccagcttggccatcatgttgaaaccccatctctactaaaaatacaaaaaatgaggtgggcatggtggtgcacacctgtaatcccagctacttggcaggcttgaggcaggagactcacttgaaccctggaggcggaggttgcagtgagctgagatcgtgccaaagcactccagcctgggcaacaaagctagactcgtctcaaaaaaaaaaaaaaaaaaaaaaaaaaaaattagcctagtgtagtgtgcacttgcactcccagctactccaaaggctgagatgggaggatcacttgagcacaggatgtcatggctgcagtgagtgcaccactgcactccagcatgggggacagagggagaccctatcttttttttttttttttaaaaggagggtctggctaagtaagttgctacatacccaaataatagaatactatacagacattaagagtgaggaggtacgggctggttgtggtggctcacgcctgtaatcccacactttaggaggccaaggtgggtggatcacctgaggtcaggagttcgagaccagcctggctaacatggcgaaactccgtctctactaaaaatacaaaaattagctgggtgtggtggcaggcgcctgtaatcccagctactcaggagactgagacagaagaatcacttgaacccaggaggcagaggttgtgccatctgcactccaacctgggcgatagggcgagactgtctccaaaaaacaaaagagtaaggaggtacctgtcaaaatgaaacataagatatacatcaaagtgtgtagttttgtacaatttaccaaactaagtatatgatccttattcttcaaggacagaattgtttactttgcacataaattcccaggatacacaaaggactaacagagattacctccaagaaggcaggatgaggttacagcagctttattttttccttctacatgctatgctcttaacacctaaattcttaggagcaagtacaatttaaaataaagattaccagcctgggtgacaccccgtctctactgggaaaaaaaaaaaaattggatgtggtggcacacgactgtaatcccagctactcgggaggctgagccaggagaattgcttgaatgaacccgggaggcagaggttgcagtgagccgacattgtgccactgcactccaatgagttagactccatctcaaataaaacaaacaattatggttttgcacctttaacttttcacacacatatatactcttaacctactcataggctctaataaaggcacgttctacacattttaagcactcaaaaatattaaactccctgactgaataatatacgcataactgtaatagcttcatttaaataaaacattttaaaactatcttggaggatattttaatagctcaacatcctaaaaactatttttcagaaagtcttcatcatcaagagtgtattaccttaccaaattcctaaatagttaagacaaaacctgatagaaattcaggttgacactacattcaataatgaatattctgctgtaagagacacaacaatgttctacttctctgaaaacctaagagattgctcatttaaaatatgtgagtgctgaactaaacacatatattcagaaacagcagcaaaggggcaggctaagcacctcctaatatggataagctccaggtttctatgtaatgaacaaagaagaacctaagaaaaatcctgcagagagaactggaagagagtgtgaggttgcaaggcagagtaaacttgttaagaagtcaagggtcctagattatggtactaattctactaactaagaggcaagacaggcatttcaaatacaaaactatgaccagcctcctcctcaccttaatcttcttgtgtttcactacagcattaatttcaaaatctcccttccaatgccaggaaatctcctctaacataatgaatttcccaccccaccactatcccttacatttctttaaattcaagatcactttttttcttaaaaagtaatcagagaatttataaactaagggtccttagaccaaaccccaaaattatgaacaagaactcaatcattaagtatttgtacattcacctcagtcctgaagaatagccaacctgccactatacactcaaaccaccgtgctatgtgctgagatttgggcttgccaactagaacacaagaagccaactaatgaaaataaattcgaaaaaaaattacaagttacagagctgggatcctattttcccctttgaagaagcaacctattcagtataaacagaggcagcttatttaaaaagcactttggcaaaataatttagtttgtaacctttgacaaagtaatcataatcttaaggcatataccttaaaaaagattcaatgggtattttgcaccatggggtgtgttttcagaagtcctaacagcataatgcactatctaaatataattggttaagtaacaggacaacaccacatgcctcctaatataatgcagtgaggaggacaccatatcacttccaggagttctcaccaaaaactggcaacctaaatttaatcatgaagaatcaccagacaggccgggcacggtggctcactccttgggaggctaaggcggccaaatcacttgaggtcaggagtttgagatcagcctggccaacatggtgaaaccccacctctactaaaaacacaaaaattagccaggcatggtggcgggtgcctgtaattccagctactggggaggctgaggcaggtgaatcgcttgaacctgggaggcagaggttgcaaagtgagccaggatagctcgccactgaagtccagcctgggggacagagtgagactccatctcaaaacaaacaaacaaacaaaaaggatcaccagacaaatcgaaactgagagacattctacaaaataaccagccagtactcttgaaaaaagttccaaaatcattagaggcaaagactaaaacaagactgatccacattaaaggagagtaaggagacatgtaagcaaaatgcaaagtgtaattctggatggaattctggagcagaaacaggaaattacagtaaaacaatttgctaaatttaattaagattataggttacataatagtttatcatttactttaatcattttcctgattttaataattatactgtagttattaacatgtggacaatctggcaaaatatatgaaaaactcttcatatttttccaacctctttctaaatctgaaattatttcaaaatgaaaagttaatacattttaaagaagtcccttttaattgtctttatttctgaaagataccctttttcataccctttatatgctttttttttttcaaatttccttatgtggctgatactacttttgtatttaacacagaaatggtacaaaaacaatgatacatttgtaaagaaaaatatgtggggtggagagaaagttctcatcttgtcttaaaacagtatttcaccaactggtcctaatattaaatttaattcgcacaaagataattagacatcgagtgtcattagcaaatagcaaatccccccagaatatcaaagcaaaacaatcaacctctattgagacatttatgaattgaaatttgcgaatacagctgggctaactttgacatgacctcaccaaatatgtgagtgggagaaagatcaagcctccataacccattcttctgttttagattgtactgtcatggctctcttccaaaacaacaaatgaagagagagacattaggacacagacatgcctgctttcatacaaagcatacacacaccagaagttaaaaggttgaggtagcaagtaactgaggcataagagccctcaaaagtgattctcagtaagtacagcaccctaattatagtctgaaacaaaaatcggccgggtgcagtgactcatgccggtaatcccagcactttgggaggccgaggcaggaggatgacctgaggtcaggagttcgagaccagcctgaccaacatggagaaatcccatctctactaaaaatacagaattagctgggcgtggtggcgcatgcctgtaatcccagctatccaggaagctgaggcgggagaatcacttgaacccgggaggcagaggttgcggtgagccaagatcatgccattgtactccagcctgggcaacaagagtcaaactccatctcaaacaacaaaaaaaccccactgttttcaataaaattaaagccacttattttgttattctgacaactcctcatccccccctacaaacccagtatcttgatagcagattaaatgtcatgtttcaatctacaataagatgatactacattaagagactacaaatattaatgcttactgtatgacctcatgtaaatagctgaacccctgagctgcagtgtcttgatctgttaaaataaaaaggctagatcagatgtccctttaaccctaaaattcaatgactcaatgaaatttctgtatacttaaacatatttctacaaatctataaattatgtaaaactcccagtttatattattcaatttaaaaactcacaaaaataccccacaaatgtcattttaataacatcctcattaatagatttaattccaactcttcagcatagtgtagttcaaatttctggtcttgtacaattctcttatgcagagataattttcctataatttttattctgtagagacactgggccttgtataaatcctagatctcttaaaattttaaaaagaaatcatgcaagaagcccataatctgtcacacattaggggcccatagatttaatctcttactcccccttgtggccggagtggcttccattctttgatttgcaatttcctcacttgctttcaaccaattagaaaagtgctccaccagaaatgctaatgattaggaggtgtcaagaactaatttattaagtcttttagacattttgactttaaattattacctttctatgcaatgtggcctaacagaataagattttaagctgtgaacatatgttctataaataaggtcatctataagcaggcttgtgcctaatcacttaacgcattttccattaatagatggcaaatctgcacttttaatcaacaagaaatctggcaaagcaagatgttcctgatgttcaagaactgttaaagccagcctaaaactttattaatataattcctgttaaaagagtagctgctccctgatatttaccccaaaacaaaagatacctacactaaacaatgctgatagaaagccccatctgttctgttctaaaactttttttttttaatcaactgggtgaaagggctagcaggaagtgagaataaaaactgccaaattaaatcaggttcagagaattgtctccctccgaatcatgaatgctagcaaaataatcctagaaggaatcagtgttttaagaacatctaacgctgggcacggtggctcacacctgtaatcaatcccactttggaggccgaggcgggtggatcatctgaggtcaggagttcaagaccagccttaccaacatggagaaaccccatctctactaaaatacaaaaatcagctgggcgtggtggtgcatgcctgtaatcccagctactcaggaggccgaggcaggagaatcgcttgaacccaggagacggaggatgtggtgagccaagatcacgccattgcactccagcctgggcaacaagagtgaaactccatctcaaaaaaaataaaaataaaaaaaggaacatctgaaaacaaattttgaaatgttgttcctaaagattaaaagtgaaatactaggccaggtgcagtggctcatgcctgtaatctcagcactttgggaggccgaggcaggcggatcacgaggttaggagatcgagaccaacctggctaacctggtgaaacctcatctctactaaaaaatacaaaagaattagccgggcgtggtggcggccacctgtagtcccagctactagggaggctgagacaggagaatggtgtgaacctggaaggcggagcttgcagtgagccgagatcgcgccactgcactccagcctgggggacagagcgagactccgcgccactgcactccagcctgggggacagagcgagactccgtctcaaaaaaaaaaaaaaaaagtgaaacactaacaagtatcaaaaagaacttatatcaaaaagaacttaatgagtagttaagtataaacttaaaaattattgacactcactgaaggcgttcctcttctcccctcccccaggatctaggcctgcgctgaagtttctcacaaaccaaggcccaatttaccagtatttccctcacgatgctttttgttgttggtggtggtggtagttaaaacgcctcatttttcatagggctttttagcttgtaagtggcacgctatgtattatggataaactacatgggggactatattttatcagcccctttttaaaaaaggctaaagaccagcttttctatgttcaatgaatttgcagtacttttccctctttgacttgtattatttgtgcacgtctatttccctctccagactgaagagcaggggcttttacatttatttttgtaatagcccagggcttataaaatagcaagttgtcaaatattaaataaaaaatttcagctttctaaagttctcttaaatttaatccaaaatttataaatgaaaccacaataaagtgatatcacagaggtacaaaaggtaaagcagtgtatttgctatttaacaccaccacaggggtgtgttaattcaacaatttcctcaaaacatcctagaggtagatagtattattcccattttgaagatgtggaaacagagtcacagacaaatgcagtaaaacttgccccaaatcacacaatgaatcaaaaattcaaaaagactgcatggctcatgctaagttttatcacctctcttaaagtaaggtagtatacactttagtatcctttatttttagaaatgttacacagggatatgcttaaagttttatctctgctccaattaaagaaaaagagcctgatgctagtcctccattagatggcaacaatcaaagggcaactgggaaggaaaagtcgttactcttacaaaaagcagattgcttgagttgtcttatttctaaacatcttcctaacacaatgctaaaggactcatcaaattgttgaattgagaacttgcctgttctaggcaagaactacagcttgcctatataatactaccttcaactgtcaattccacagaatcacattttaagtaggtattttgcataatattttcatcaagtgtctcttggttgaatgtggtccaagtatgtcattctaaactggacaatgtttattacgtttaaggagcaaaaaaattataagctgagtgttcataagtcttggatcaacaaataggtctgtctcagaaaagcgtttgtaattaatcacttagatgagaaacattccgcataccagtgggttccttggtataacgctaatttttaaaaactctagatcccaaaaattgtttgcaagttagaaattaactgccactaaaaaacatttctaggccgggtatggtggctcacgactgtaatcccagcactttgggaggccggggtgggtggatcacctgaggtcaggagttcaagaccagcccggccaacatggcgaaaccccgtctctactaaaaatacaaaaattagccaggcatggtggtgggcgcctgtagtcccagctacctgggaggctgaggagggagaatcgcttgaacccggaaggtggaggctgcagtgaggcgagattgtgccactgcactccagcctggacgacaaggtgagactgctatctcagaaaaaaacaaaacaaaaaacgacaaaaaaaaaaaaaaacatctctaacttcccaactcattaaacgattaaaataaaatactaatacaacaaaaattgggcagtccctgcaaatttaatgcaataatccttcttagattttaaaattcaacacatgcatacaggccaacccattaagcaaatcttatgttggtccgcttaactttatagattaatacttggctgaaactatccttatattcttttacctgttgttaccactgtaagcacatttttatttggggaaggaaggctcacaacaaatcctgtcaaaagaaatccacaagagcttacatgctgaaactttttaataacctatccaatgtaaacaaaagggcaggtgtcacacaaaatgatcttactgatatcaagtcagctatattcatccacatggctttggtgcctgaatggcaatagaaaaaaaaactagtgaaatctgccaatatgtaaaactctatcctacactacactactacttctatcacattataccttaccagaaaacaaaactaaatcaatgacaactgctattgcacagtaactttcacatatacaagcttttcataattaaatggaattactgactagagaacaagtgaatgatcggttacatagaaatacacataataaaaaagagagaactgctgatacgaccgttcttcccacaccaaaatttacatttgtgccatctaaatatcaaagcatatactccttcagtgtactttacaaatacacaaatgttttcaaggagaaaagaacagagccaatcttctgatgctgaaagacagataatcaagattaaaataagtcctaaatcgagtaatgaagcagaaaccctcaggccataaagatggtaattagcaacagtttgtatcagggatagtgagacgaccaaactaaagctaaaagcctcttgcagggaattctggcaaggatcaagcaaatagatggaatgaaatcagcattttagaaagattagaataagaaatacatgcaacatagaactgaaaaaggaaaaataagagtaacaagtccaagtgaatgaccacaagcagcagtaaaaagatgtttataatttagcttttgtccattaaaagcacatcaagtttatccatacagtatcattttcctatttggcaatgtgcacttttctgagtataatcctgggaactatacaattcagcgtgaatgtaaaggatagggaaccaatgatatgggaaacatcaacagcttgtaatctgaaaattaagtcaaagttgagtccaacatgtcgtgtgattaagtctagaaaacatgctaaaattgggtagttataaagaacaggcagtttcaaaaggaaaaggaatgctggctttgagtatattgaaactgacagcagttctaagtcccctaaaaccttgagcggtgtttattctctatgtggaactgtcaagagtaaagcaaaagctatgggaactagaatgaaatcacaatagggaaccaggaattctacaaaaaattctaagaaacttattagaatttcaataaactatatgctaacttttaaaacttacttgatatcagaacacctgtcattctgacttaaaaattctcacacacacattcaatataaatatgccaagagtaacttattttggaatcaaaaatttgagaaattaatccaaaagtccaatgacatttaattcagtattataaagacagagctagtttcccttcccatcaaacagcaaaggcctctacacctttccattccctttcctttattttcatcatttccacttcatatacctcagactttttgtatttgtacaaaatatgtcattgggtgtggcactttacattaaaaaaaactgaactttattaccaaagacactgtccaggccgggcgcggtggctcacgcctgtaatcccagcactttgggaggccgaggcaggtggatcacgaggtcaggagaccaagaccatcttggctaacacggtgaaaccccatctctactaaaaatacaatacaattagctgggtgtggtggcgggcacctgtagtcccagctactcgggaggctgaggcaggagaatggcgtgagcccggaaggcagagcttgcagtgagccgagatcgttccattgcactccagcctaggcgacagagcaagactccgtctcaaaaaaaaaaagaaaaaagaaaaaaagaaaaaaaagacactgtccaattttttccttcctgagaccacagaactgggattatttatactttgaaacataccaaaaccatgaagacatgtaaatatacagtatatcttaataaaatgaaatagtaacaatagatataaccctacagagttctttggagaagcccttattccaatgagctgtctagtgattttcatcttaaaaactgctaactctacatagcagtttttaaagcccaaggcacgtaataatatattcagactaaaacggacccaaagccgcttgctttcttatttctgtttaatggtagttctgtgggctggagataaaaatcagtgacccataaccacaacttaaaattgccctgagcaaataaaaacgtagagcagcaataaaatagaactcagtcaaattaacagaatcactattaagattactcaactgcagttgccaactgttataaatgttagacacacaattttacactgcttcctctcggagacctcctatataaagtcattctctgcctacagcagtggattttaaattttaaaatgaaacctttgaaaatttgatggttggcatggaccttctgccccacaaaaatacacaattttaaaggcttcttcaatcttcgaaattccattcatggactgtaagttaagagacccctgcactattataggcaggctcacacttttaaatagaactgaaaagctaagataaacaggacacagaaggtagtcaaggtgctttacctgactctcattccccacaaccctgtgggatgagtattattcctatttaattgagcttagttttctcagagggactgagtgatttcctcaggccatgcatctattaaatggtaaaactagtttgactcagtatcttgagctccattattcacctcgacatacttctttgagtttgaaagaggcttcctagactgtatttccttggtattcatttcatcatgtgcaagataaaaactacccaatttttggctgccatctttcaggtttaaagaggtactagtgttgagtccctccccaactaccaagagagcttttgtctaagcatctggcaggaaaggcagattgcattagttcacatattgcagtttgaaattaacacgtggaagagaagaaacccaagttcttttacataatgcaaagtccacattgtgaagagcatgccagtgaccacttcccgccataatgctctatttactcttgtaatatgcaacatggtccaagctctttgcttattaaatggttaaacaatagataaatacatataaccagaatgggttactaaagagctcttcagaaaaactcagaactttggagattagctgctttttgtaggaagaaagtttattttcatagctattataaaataggtgctcaatataaaaaatctggttatcactaatgccacaagccaatactattatttctgcaaagggacacctgcttatttttctcaaattaaaaaatatatatatcaaagcccagaaaaggctggagtaataaaaaattataattgattttttatcatgtaagatcttaaaaatataatttaaaatatttttactaatcattaataatgattcaataactttttctagtagaaatatcagttctgctacattttattcttccatctcacagaaagggcagaaggaattttatgcaatatgtttccagagtcgatgtgacctatttgaaaaagatggtaggaaaaagaagcctattatcggtaaatatcaaattttcccaagcagaaaaagaaaaagctagggaaattttgcagtgctgctgacctaattctatgctctttctctaaagaagcctttctgcttgtttaacaaatatttgagcatctattacacgttgagtatgcaaagatcactaagtcttactcctgaaaagaccaaggctggaagcaaaagcttgtttagaattctcttcaaagccatttgtatagtaaagaaattaaactctcatttatccaaactttcaaagtgtaaataccattaaaactttttgggaagccagtgctattctggagggtaacgatgtgggtagggaccagagtgaacttccttaataatcataacaagaagaaactatttatatgaagagattatcttgttatcctcatctactggttctatgcaaacaaagtttcttcataaggaaactaaagggaagcatagtcaaaactgctacaagttgggctggacgtggtggctcactcctgtaatcccagcactttgggaggccaaggcgagtggatcacctgaggtcaagagttagacgtgacctggtcaccagcctggccgacaaggtgaaaccccatctttactaaaagtacaaaaattagctgggcgtgctggtgcacgcccagtaatcccagctactcgggaggtcaaggcagaagaattgcttgaacacgggaggcggaagttgcagtgagctgagatggtgccattgcactccagcctgggtgacaagagcaaaactcagtctcaaaacaaacaaacaaacaaacatacacaaaaaacaaacctgctacaagtcttttccttggaaaagactcacaatgacaggaacttttatactttgtatatggaaaacatgcacatacctacctggtattgcaaataagcgtgttagtaaaaggtaaatgttacattcctttttattcctaaaattgacttttgtcttaagggaaatgttaatgtgtaacacaccctttgaagccaaaataaaaacttttcgatcaggtgtaataattgggaaaaacactccagactgaacaaaactgaattacacatacacagatattagttagtaaggtgagcaaaaaaaaaaaacaaaaaaaacaaaaaaacccaatacattttttattatagaaaaaaaaaatcacattttcaaaatttaaatatttggccgggcgcggtggctcaagcctgtaatcccagcactttgggaggctgaggagggcggatcacgaggtcaggagatcgagaccatcctggctaacatggtgaaaccccgtctctactaaaaatacaaaaaaattagccgggcgcagtggcaggcgcctgtagtctcagctattcgggaggctgaggcaggagaatggcgtgaacccgggaggcggagcttgcagtgagccgagatcgcgccactgcactccagcctgggcaacagagcaagactccgtctcaaaaaaaaaaaaaaacaaaaaacaaaatttaaatattcttattaccttagcaaaatcacaaaacagacatttgtcacttggccccaataaaagcaagatattccttttttcaacttagatacaaatagtagctatcattctaaaggtttcaataagcaaagaacaaaaaaatgccccaagacagatgcctcattgagtttgtggctgtgaacccaaataagcatgtttaaaaaatcactattctttaaaaagacagtgtcaagtaagtatcatttgagaaaattacagtttaggaactgatgctattccattagtaaatacaaatgtaaagaaatgatagtatcatcacaactttaacaaaaaccccaaacccacaaccacatcagacattatcctattgctcattatagcacttcttccataaacaaggttcatatagtaagtaacaaacctggatttccatactgagttccagattcagtaatctgtccagaaaaatcgagatgctgcccctctttgtatatcagagcccttccatactggttaagtgtaaccatttagtaaaaccactttaaatattattccaaaaactgccagcttggttggattctctactggtttatcctcaaatttaaactattcttgatcaaaaagccctactttatatgacagattaaaattaaccaaaatgtagtttaattcttttaagcgcagtgcttcaacacagtaagtactgaatacttaaaatactcgattcaaactggaaaatcaagcttgagttgttcataacctttcatcatggttgtgagtgttcaaaatttaccttcaagaattcaatgcaggaagaggtttcatagttgtgacgccagagttttctgcatggttgactcattacattaacattatagcggctaatcctgagaagagtactatttctacaatgagtatcctattacatctctcttacctaaagtatgtaaaattcctttatccacagatgtacatttaagataaccagctatagagctactacaaatattctaaccataagtaaaacagtaacacaattagtttatattttcaattaatataaaatacaatactaaagtctgttatttttaacaaaactgaactgtttcataatcattgttgcaattattttacatacacgtatctataattgtcttaacatctttttagtcatgacaccatgaagacttttaaatttggaacacacaatgtttagaaggaaaagaaaaaccaaacaaaaagttaagagtaatgtaactgatactcatagggaccctacagtataatgaagccagactgaattgattctcaccagtacatcattgcagatatctcttagctccgtctcaattttctctctgtattctcgagccatctgctgttttttctcagcaccttccgtcttttgttcaatacttgagacgaccctccaagatgacctacgggctcctacaacatttttataagcaactgagagaagattcctctcctcattggataattcagctccttgctcagttacagacttcatgcaggctgccatgtcatcatatcgctcagcctgctcggccagtttggccttctgaaccagctcatttttatccatgactggatgttctgcaggggggaaaaaaggagtatttaaaatttttcccatcaaaataaacagactcaaaattatacctgtggtaaatgagttttttaaacctgaaacctaactgcctgtgaaagactgttcacatgaggaattaaaatgcagcctcacaaaaggatagtcaaaaaagggaaaaaaatttagcatactcagcatcagaggtaaacttacagccattaacacatcagtgtagcaaaacttaaaatttgttcagaagacccaaatttcacatgtcaaaattacttccaaaagctgcctcaaaaactacccctaatcttacctgatcaaaatctcaactcatttccaataccactaagtgatccaaaattaagcagcttttcttcctttagtaaaagcattgtttacagagaacatctggatttctatcatatttccagaatcataattcatatcagtttaatgtaactcacgtctttttactttcataatactcttgtcaagagtgattacattttagctttagtgttacccctaccccaaacctactagatctctgcaacaactgccagccaataatagcataacaatttgggggggaatgaccaactgtttgttttcagatattttgagtataaatccaccacaaaggatcaatatctgaccctaatgtctcaactctttatcttgttatatgtccacatgctttaaaaatatccgcaagtcatgacacttcaactcttactgtgagtactagaatatatcacattggaagtacttaatttataagtgtttccaatgtcatcgctccagttgaaatgcagaagtgctgcattttgcttctagccatcataatgtaattggatgttaccactcaagctgtcctttaccatgactacccatctaattctctttccctcgcattttagtttcctggaccttttcgatttacctcagctacatttttctggaaagatacccttttgcaagttgccgaacagcacaaagatactaatccacacagtgacaccacagaataaatgacttcagaggaaaatacacaccctgaatgaagtgcacttttaagttagaaggtgaacagaagagtccaccttggcagctggctcccgaatattaatcatcttttaccttcccagggaaatcccacaatatttttttaaccaaatgagagaacaggtcgccacattttaaacaaataattaaccactttggatgcaaggtactggctcaatacgtaaactatttaacctttatgacggcattattttcgtcaggtctctaaattactgatttttcccttaggatctcagaaacgctctctggttatttctgcttctaacaaaaaatgatttaagccagtacaaaggattctctccccaatcacttcggtacaagaggaagtggataaggtttctcacacagtaacgagtgctccaaggcctcgcctctacactgcgggcaggactcaccgcacccatttaacccttacctgacttgagacgtcggttactgtgaaacgaaaacgggcagacccggactttaaagtgcaaattctccggtccgcgtatcgcaaccacccccctccaggctccgcccaagtcggagccacggctcaagtccccgactctcctcctttgtcatggcggatctgtgtcagggagcccaacctactgcagagtgttaattcctccccccgaccggagccagagggaggagcagcccgcgcccccgcccaagccgtgggggggggggagagatggggagcgaagccgcccgaccccggggcagagacgccacagcagcccgcagaagcggaaccactaccagccccgccgcggacacaccccgctctcccacccagcgccttccccgccaccgatcagcgccggtgaccgtgtacagcgtctctaagggaccgacagctgcaggtgggggaggggacgagagccacacccagccgagcgggccaccagcggctatgctcaggctcacccgcccccaaagcaggatatgcgtccccaaaccgagcgcagggaccctccagttctagtccatcaagcacgggagccgactgcgggctcaccaccctgttctctaccccgacctggacttgcagcccccgtccacacctcccccgcccgttcacaaggagcaaaaaaagtcagacccatcccccacccccaccaggaaaattcaagtccttcctcccaccgcggagcccaggaaattcagctctaggtcccaggcgagccccaccccaaaacctcaccccgcagtggactcccctcccgccggcgcgcagcctcgccccggtctacctggcgggcgccgccgcgccaggcctgggctccggcccgctctcggccaggcctttccctcgcgcttgggtccccgaggcccccggcccctccccgccgcgccaccgcctcccggggtgggggagggccgggtcccgccgccgcagcgcccagcgcggaggctgcgcgagggggagggaaaggagggggcggccgagggagaggggagggggcggcctcacctgcgccactgcgatgcccgccgccgccgccgccgagtcattatctcgggcggaagcgagaagggcggcgagggagggggtggaagcccgcagagacaagggtggggatggatcgcggccggcggcgccccggccatgcctcgtccaccttcgggagccggcgacagggagatccccagggatctcgcgtgtgggcgccctacccacccccgggggcaggacgggggagcgagcaccgatcggcgccggggcgtcgatgcggaagcaaggagccggaggcggccgctagccgccctcccgagcccagcggaagaggagccgccgcccgtgtccgctgaggagactccgcctcagcccggcgccgccaccgcggggcgagtggggatgaggggacggagcgaggacggctcccacgcgttcggaaggctggcctgggacaggaagcgaggcgcggcggcggccgggttcctcacctgtgtccggagtgggtggtggcggcggacggacgggctcagcagtctctgggcggcggcggcggcagcagcggcgaggctgagactctgtccctggatctcgctgctcacaggctacagccgctccgcagacacggggtttcctccaatcaccagccccggcagcaggggcaccacacgcacgatgacgtcaaacgctgctatggcaaccgttgattggtgcccacagcgatcggggccccgcgtaaccgccgctccccggcgctcgtcctgcccgcccgcgctggagggcgagcggaggcgcgcgcgtcctcgcccgcagccgccactcctcccaccccgctcggcttccagctcctctacgcttgtcccgagtgcacctagggcaggaggctgcttttttccttttcctccccaacgcaaatcccccactcctcgccttccctttgggtccccaacgccctctctctccctctcccctgcagcctctgccggcccactcttcctctcagccggcgggaaggcgttctctccctacccccaccttagctttcgctcagcccgtctgcgcttgccccagtcactccctctggaaggggctcccgttcagcaacatccgggacctttcacatccccccacccctccccgaggcccggcccgccccaccctccgtgcttcgcggtagtaactgccccagggccgtccccgggcaggatgacaagggtggctcggcggctccggcattgtgatcaggacttgcggggcgggggccccggggcgggggcagggcgcggtcgcacggcaagggagggttgtgtgtggtgcgctgccccccgccccgcccgccgctccccttccccggctgggccgaccggggcgcgcggcccctcccggcctccctcccgccgccgcggctttacctgctggctcgggggaagcggtcctagaccttttatggctcggaaacgggagtgaggcgtccagcccctgagtgtggctgagtgatggggaggcgttccaatcgagagcgcgggatctgcgctcggtgactgcgcgaggggaca

SEQ ID NO: 2169 - DNA, 32757 bp, Homo sapiens
  source 1..32757: mol_type = genomic DNA
tctccattgcacttttatttgaatgtaatatttgggacaattattcaaaagggccaatatttcccaatttaatctgaggtcataataaaacaagcaacaaaacagtgtttgggatttcagtttctcacccttatcatcaagactcactgcctcccatcatcaatatttattgagcatttacagtgtactaggcacaatagaacatacagaaaacattgtccctgctcttgaggagcttacattctaaaagaaaaaatacaccttttttaaaatggcatttttgtttggtgttttctgcaaagtactgaggaaatattttgtaaagtgagctttgggtataacttagccccatcattatttagagaatagaggaggaagaaagaggaaggattttaaaggcagacaatgacagaccattcaggataggtagggttttaaagggagataaacacagtctcatcaactaaggagagatttgctgcagtaaataggatgagggaaatagtctgtgggatgcaagcaaaggaagcagggtgccttagacactgagtggagccagaaagatcatgcggcctttttccaagtacatggccaccaagtaagaatggttggtgacaagacagaaggctaaaacaggaaggtaatcttgtgcacctgacaaatagaaagaataaaggatcaaaattgaaggcaggctataagagtatcaagaaattcttaaaaaccaaaaagtgatttggaagcacaaaacttacagttaatgctacccaatgtcatgatgggccaagaacattgtggcttcctaagttagaaaatgccatatgccaaaattttaaatggaacacactacatttttttctaatcaatccccccctctcccagaaaaaataggaactcatttttttcagggtggggaggaagagaggggatcatgggacatggaaacagtagttatattagtagtatttttgttatgataaattttgtgtttaaacttggtaagagcccattagctgccaagagggaataaggaataaatttcaaaaaatgtacaatttcctttagagaagtttcagaaccaagactaatttacatgaaaagctgtagagaaagtagttgaaaagtccattcataaaacttttattccacttacatgaatttaatacacgtgttcttaacaattatgcttggattgttcatgaaaatttcataagacattaaacaaagctagccatcatctcaagttatttccctgttaactatttttacagcacatgcatgttaggcaagtatcaaaaaaaaaaaaatcacaaaagcaaaaatcctaaaaaaaagttaaatacatgggtttttgttttactgctgtgcttgatatacatgaagtaatgaataccaagcaattcatttttcctgcatctttacttttacatttgttcttaggttgcctaaaacatttaaatacaaataaaatgagtgtagcaaaaataatgaaagctaacagcaggtaactttacaaataatggaatgtgaaccgtttctgcccttatccagagtaaaatgggtcacaactttgtctaaaggaacacttctgcagctgtagtcaaaggtgtacacattgagtattccacagatatacatggtttaatatgtggtatccatggggtatgattctaccacagccttgtaagtgctccaaaccttaaagtacccacaattactacacctgtgactggaaccaatgatcccttttattccccgccaggacaaaccagtatgtaggcagttttctttgcttagacatggaagcagttttacactggcccttttgaagccacaatgtaccaaaagtactatgccaaacacttataacttgtataaaaattccacatccccatattggccacctcaagatgaaaacagataactccctaaatgttaactggctctactcccctaatattaaacataaaaaccacatgggaaatatagaaattcaaatagaagtaacataaacctgtcataaatcgtaaacaaaaaactatttgtgggacagcatggatgacaaatggtctactgtgtaaattttagaatgaggcagacaaaagttggaaggccggttaattttcccctccttctcctgcttcagcttcgtctccttgggtatccgatgtccacaactggtaaaagaaggaaagatttttcagcaagtttcagtgggatgggggggggggggcgttttcatataagtgccaagatacctgaatgttttagttggaaagcattcttaaaaagatagcagcatcacttagcttcaagatacaaaaacatctcaatatacaaatttactttttttgtaaccactatataagcaggttaagtacaccacagagttgccttcaaataaccttcagatacaggaaagttttggttatccacagaaggtgaagagaaattacaagaaataatactttttttttgagatggagtctcgctctgtcaccaggctggagtgcagtggcgtgatcttggctcaatgaaccctccgcctcccaggttcaagcgattctcctgcctcagcctcctgagtagctgggactacaggcatgtgccaccacacccatctaatttttgtatttttaggagagacggggtttcactatgttggccaagatggtcttgatctgatctcgtgatccacccacctcggcctcccaaagtggtgagattacaggtgtgagccactgtgcccaggccctaaattattttttaaaaactaagcatcaataggtgtcagaacctaaagagccccaatatgaaagatggacgtccaaggtgagtgcaactataccagaagcatctaatttggcccatgctgaaggagctagggttgactactctccactggtagatcttaaagtgactcacactccaaacagaatcctatactccatgaaattcaagaaccagcctcaactctgagctaaactacaaatctagcttttctaacactttaagcttagaaaaacaaacctttatttatcaggttggtgcaaaagtaatcgcagctcttgccattactttaaatggcaaaaccctcaattacttttgcactaccctatcatatgattcaaaataaatgctggacaaaaaccagaaccaaatcttttaacaggtaaaaatgaaagttgtcccataggtggcagggttatgaactctattccacctgctccaatgttaaaaatgttgaagtcttaaccactctctagtgattttcagaggtaattacaaaaggattcaagacaatcttaaattttatatatgacttacacatgaaaacggaggggaaggggaaaatacactaattattatttttatattccccaaatcatccattagcttcatttatctactaagcaaatatatctctggcctggaaaggagactacttccaaggtcatacagatagccaaatgacctcttggaaactgtgtgctcctcctgtcaaacaaggggttttgtaattgcaagatgaaattgtttctaatgtctctttcctgttctaactttcaaggattcttgaattttctgtataaacatgcaaatttgatacaaaatatttctttttctagagtaatgtgttgacagtcttggtcaaccaaattcagaatgaaatattaagttttgggataatttcttttcttgacagataaatgttccaatcaacctataatggtgacagctgacactaataaggctcagagaagacatacaagtagtgacagaattagaatcaaaaccctggttttttcttttctttttttttttttttgagacagagtctcgctcttttgcccaggctggagtgtagcggtgtgatctcagctcactgcaacctctgcctcccgggttcaagcaattctcttcctcagcctcccgagtagctgggattacaggtgcccaccactatgcccagctaatttttgtatttttagtagagatggggtttcaccatcttggccaagctgttcctgaactcctgacctggtgatccgcccgcctcggcctcccaaagtgctgggattacaggcgtgagccaccacgcccggccaaccctggttttcttattgcaatatgcgctcttcatgctatactgatagcaaaattcagttggaagcagacagtagatcagggcctctcaaaaagtgatgtgaacaaaacacagtatctaggtctcaggtcatcactttaaaaatgtcatcacttcaaactagaaaagaaaaatccttaatactaaagttagttaacaaagtgcttcttatgtttgatatataagattctttcattctttactgtggcttgttatcttgactcaagtatcagaaaagtttatagatagctccaaattgtgctaataaagtaattttaggtttaataaacaagtatacaatactattcaaaaaactcttcaagattttcagcactagcatatagaactggtttatagaaaatggcagtggactagaataaagttggaagagaaatgtataaaatgagattacatagtccccaagagaaatggccctagaagtctaacaaaaaaacagtaatacctagattatgatctgcaattcctacctctttacctgacacacagcaaatgcttgataattttttcacctaagcctcaaaatttcaaatctagtatttatctgaaggagaagaatgagaagacctaagaaacaaacgagacatacaaatcaactgcattgtggactgaatttgaatcccaattcaaataacttaaaaaaagagagataattggaattcaagtattatttagatattcaaacattattagggaattatgttgatgttcctggtgtgatagtgacactgtttctttttatacatctgcagtatcccaaggacaatcacgacctttcatattaagtcatttaaaataagaagctaggcaaaatagacttccacttggattctgtagatacctgagattttgtaactcaagttattaattccctaccattatctttaccaatatggaggcaacttgatgggcaagaaaatcattcttaaaggaactaaaacatgtagagtctcagcacacttttgatactaacaaattttaacaagacaggtaactcatcaatgtgtgtattttttagttctcagtctaatatttcagtttctgtaattttccttcataggactttaatagtagctgagatatatttatgagagcctatgaaatgtgttgagaaaaaattttaaaagatgtatttaataaaaaaaaaaattccctagagtaaaacataacctcttcaaccacattcatcactaatgatgctgttatgtacttactgtcaagttgtctctcagtaattgcattattagcgtgctgtctttgtatgactcttcacttaatgtatcaagttcagcaatggcttcatcaaaagcctacgatttaaaaatagtacattacatttcagtgctcaaataataaagactgctaaatttctacgtaacaggtaaaatacatactgtctttgcaagagagcaggctttctctggggagttcagaatctcataatagaacacagagaagttaagggccagacccagtctgataggatgtgttggttgcatttcctttttgctgatttcaaaagcttcttggtatgcttgttgtgactgatcgacaatccctggataagacacaccaaaacgtactgagataaagtgtgcattatatcttcacccctcaaaccaaacctttaatatctcacatatcctttgaaatactaacctgtaacagcttaatatttgttaattgaacaaggtccttttttttttttaaagggagctttctcctggtacacactagccattgatcaatgtcaagataaaacaactttataatctcattattgttatgtttttaaaaaattgacgagttttgacatcccagacccaagcaatcctcccacctcagcctccagattagctgggaccaaaggcttgcaccaccatgcccagctaattttcaaaatattttttgtagagagagatgttgctcaggctggtcacttttcttaaaatcttgaaaaaacatccctgtacacaatattggcttttcagaaagcatttattttagaatagcagtatgaggcagtagatgtgtattctcagaacacaaagagcactgctactccttattcggcactctaagcaattcaaaacaagacattatgtacgcttcagagactcttcctcactatgttatcttatacaagttcaaccaacaggtttaaaaacagcatacctttcttgtcatcaccagcggcaacctcagccaagtaacggtagtaatctcctttcattttcaaatagaagactttgctctctgcttgtgaagcattggggatcaagaacttttccaaaagagacttaagaagaaaagaaacagacatagtgagaataaaacatttacaaaactgaaagaacttgcatttcttaaagaacaaactatagcctaagttataaaacttaaacacccagtcactgtcaatacaattgtgaatgcagctggcacatgaatttgtggtttaaagcagaatgctttgggcagcaatattttaagtttgaagttagtgttcagtttattatttgaggacaataaaattgaacattggtccctgacaatgttatctatttacatgctgacttcatgaatgtggggcatgaccgttcacatttaggaacattttctaatgagctggcaagctttccatctgaagtttcatgtggtcatgacatgaaaatagaaagaacatacgggatgaaccttttgggactctggagaaatgactaaagcagaaaccaataatgtaagacacttaaggagtccatgccagagaaggaggaacaaaataaacttcatttataacaacacaattcaagcaaacctcacaacagataaaaaaaccgttcaaaagttttatttttcctaaagacagtggtaggagacttacagattttaaagagcagacctttaatctcattgaagtcattttcggctagtaagatacacgattacagatcatcccagacaacagataaaattaaaacatcatcctataaaattctgtctaaaactactattacaatctgagtcatttgattaggattttaaaaattacactctttaactgattttaaagcaaaaagattagatcattgtgttggggatgggaagaagtctcaataaatgtgtaatttttttctttccagttaagggggagaaaaataattctagtagtagaattaggtaaacattaaagcaaaaaaaccccaaccacccattctcactaccccacttcctttaaagttcaagtacactctgagaatcaaggtgaagtcaattttcagctgagctaaattccaaatccattcttacaaaaaaaaagtattagtttatatagcacctacttatatataaaatataaatttgaaaaatgcttttaaatggtaactccaactttttgtttacccattatgttccaatgctgggtaggtgaacagttttaacccaacttcttcccccaattttttttttttttttttttacaactcaagctacagataacccagatgaagtggcagtagggccagattgcactgtgctatataaagaggttaaaggtgagaaaagtcaacctgaaatgatgtttcctgcaattattaaccgatatttaaaaatactggcctgaggccgggcacagtggctcatgccagtaatcccagcactctgggaggctagggtggcaggatcacttgaggtgagcctcgtcaacatggtgaaaccctgtctctactaaaaatacaaaaattagccaggcgtggtgacgggcgcctgtaatcccagctgaggcaggagaactgcttgagcccgagagatagaggctgcagtgagccgaggttgcaccactgcactgcagcctggatgacagagcaagactccatctcaaaataaataaaaataaaataaaattactggccggaaatcagaagaacgttttggttaggatagcaacctctgtcttacaccacattcatactttcatattcaaagttctcttagctgcaaaagtgttttgtcctttgaatacaatgctttttaccacctatggttgctctgtggagatctgcctcaaacagtggaagacacttgcatttaaaatagtcaagtgagtctttccacttaaaaacaatggttttaagaaacaaatgaccaggattttcaaaagtttcattgttacacaaattgtattattcattcaactatgggagatggtataaacataagtggctttggggtgagtctggttttgaattacagcactatacaccgtgtgaactacttaatctcaatgattcagttatctcacctgtaaggcagagacctctaagattattgagaaaaaatacaggtaagcacttaggagtaagcacttaaaattttatttctattatcacaataacaccagacaccatgctagaagctggaagcacaatattctggtaattcataatctagctgtagagacaaggctatcattccttccattacaatacactttacaagaattgcagggcacggtggctcactcctgtaatcccaacactttgggaggctgaggtgggaggatcacttcttgagtccaggagtttgagaccaccccggtgaacatgagatcctgcctctacaaaaaaatttaaaagttaaccaggtgtggtggcacacccctatagtcccagctacttggaaggctgagacaggaggatcatctgagtccaggagtttgaggctgcagtgatctgtaattgaattataccactgtactctaggacagggtgacagtgaggctgtctcaaaaagagtaacactgcctaatcacgtctttcacttttcggtaactttaaccccctctatgtatgcagagatgaaggccataaacacatgcagttacttaagagtgaaccagtcacttaagatgtaaaattttaaagctgtactaaaaacttaaatttttttaggaaaggtgttgataaatgctactaaaagtagtaatctatcttttgtaggtagtaactttctacctgggtaatatgctgaactaagcagttccctgggaattaaaatggcagttaagcacttctttccccaaagctgaacactgaattaaccataaaacaactttaaagctatttgttagaacccacaagtaacaggagggctgggtaaacagcagtcaggctgcttactggcctaatgatagaccaaaagaaccaaacaagtggcaagtgtttctggtgagatgctgaccataagagttgagaaaggtggctgggcatggtggctcacgcctgtaatcccaacactttgggaggctgaggtgggcggatcacgaggtcaggagatcgaggccatcctggctaacaaggtgaaaccccggtctctactacaaaaagaaaaaattagccaggtgtggtggcgggcgcctgtagtcccagctactcgggagactgaggcaggagaacagtgtgaacccgggaggcggagcttgcagtgagctgagatagtgccactgcactccagcctgggcaacagagtgagactccgtctcaaaaaaaaagagttgagaaaggcataaatggcctacttctaataaatcgtccaatgacataagctaattaagatttaaaaacccaaaaccaagcaagactggattaaagattaaatttaaaggggctaacactgtagctcaaaaaaagctaactataaaagaacattttctgccaggtgtggtggttcatgcctataatcccagcactttgggaggctgaggcgggtggatcacctgaggtcaggagttcgagaccagcctggccaacacggtaaaacctcgtctctaccaaaaatacaaaaaattagccaggcgtggtggcacacgcctggaatcccaggtactcaggaggctgaggcaggagaatcacttgaacccgggaggcagaggttgcagtgagctgagattgcgccattgcactccagcctgggcaacaagagtgaaactccgtcttaaaaagaaaaaaaaaaaaaggaacatattctcagcctcaatggggtgatatacctactagaaaggacgttattccacaatcaggaatcaaagttatggcgagtatactagaaactgtcaggataatggaaagaacaggacatgaatggctccaagagacaagaccaattaaatttagcaagagggaagatttctgttcagtatgagaaaacttatgagtggtccagtactggaacctgctcagtgaattccctcttttcacataaaggtaaaacaggaaactaaagagggtaacttaggtattttgtagaggagattcataaagaagatgtcatctgtttcttttaaaaaaattttaattgacaaaatagttgtaaatattttgggggtgcatgtgatattgatacatgcatacaatatataatgatcaaatcagagtaactgggatatccatcacctcaaacattgattttttttttttttttttgagacagtcttgctctggcacccaggctggggtgcagtggcgcaatgtcggctcactgcaacctcctcctcctgagttcaagcgtttctcctgccttggcctcctgagtagctgggattacaggcatgtgccaccatacccagctaacttttgtatctttagtaccaatggggtttcgccatgttggccaggctggtcttgaacttctgacttcaggtgatccacctgcctcagcctcccaaagtgctgggaatacaggcgtaaagccactgcacctggcctcaaacattgatcttctatttgtgttaggagcactgcaattcttctagctactttggtagaataaataaatgttaactataatttccctactgtactattgaatactagaacttatttctactatctaaccggatttttgtacacgtggtctttttcaattctaagggaagtcagagttcacagaattaatttaatggtaacataaaagaggcaattaagtatgttgctttgtcaaactgaccgaagaataacaaatccaagttttccagatttggaagccagaagataaaacccaatgtaggaagaatagaaaaaaatgaataaaagaacaaaagaaaaaggaagcagcagttacaacaaagcagaaaaaaacatggaggtgcaccaagtagagaatggaagggaggaaagggctgatagctactttcaaaatatgcaataacttcagagaatatcctgctcaacacagaaataaacctcctaaatttcgttcacctacaatagtacaatgaaagcaatcatgactgaaataaagtctgaagtaaaaaggggagggagtgggcacaccataatataaggaagtatacactaagtgtcacaatttcaaccgtatttagaacgaagtctcgctctgtcgcccaggctggagttcagtggtgtgatcttggctcactgcaacctcagcctccccggttcaagtgattcttctgcctcagtctcccgagtagccgggactgcaggcacatgccatcacacccagctaatttttgtatttttagtagagacagggtttcactgcattggccaggctagtcttgaactcctgacctcatgatccacctgcctcagcctcccaaagtgctgggattacaggtgtgagccaccgcgcccagccaactccaactgtaaaacaagggctaggttgactgaaggttcaacttgtaaaatttttcaattatcacagtaccttaagtttttaaaccaaatctaaatggttttgaggtcaaacaaaattcaagcacatcctacactcaagctaaatcaaggctaaatgttaatctgttgaatcttcctgaaatataatctcatttagaaatccacagtatttcctcagtttacttcaaaatgtggatgtaagttttacttttttccctcccattaatttttttaatttttatttagagatgaggtcttgctctgtcacacaggctggaatgcagtggccccatcatagcttgccctgctcccattaacttttaaatatgttttttcatgacagccactgtcttttaaagatatcatggccaacattttagaaaatacccaagattaatttgctgaattagagttaatgcatttatacagcattcaccctaataatattaagtgggataagaaatcatttactcagcagcaaaatgccacaagaagccggtatctaatactctttggtaaacagctcctaatccagagttaaatatgtgatatgggctctgaagagaggacactaatccttaacctaaccaacaggtaaattacatgaaatttgagattttagagataaaagagatttttctctctactgcaccgtagtataattaacctcttagattgtgaaaacacttccaagagatggggttcaaataacatttttcctcccaagccagtttccaaaagatgccttaatccaaagatagtctatatttacaatgatgttttgtctttaaaattaagtctattaaaattaaggaaccacataaattgacaggtcatctgtttctgatcccttcttggcatagactcaacctgatcccactaatatgaattttataaacactcactcctgcctgtagtcaaatattcctaatgaaaagttaatgaactgagaatctatctctagtgatatgcctttctcactggtctttcagtatgattacccctaaaccaccaaaactgctgcctgagctggtggcaagactttaacctttcgggcattcaacacttgttagaagaaaagcttgatgtaatgcaaatcgtataaactctaaaaccaggcagacttgaaattccaccctaacccattaattttgagaatttacacaatagctaatctttattttctcatctatatgaaaatccacatcaaaaggctgttatgaggtctaaatgaacatataaacaggagggcaccattcacagctcccaaccgagagtaggcattctactcactggttgctcagttatgtgaaaataaagtatggagattctgacattcaaaaatctgctttagtgctcttgtactcttaagtacatcattttggctttggtaatctaaaatttgtataactaggaaaaatggtgaagtaggatgcaaaaaagttttcattcaaaaacacaggattaagacatatcaaagaacaaaagaaaaaagaacaaaagaaaaaaagaacatttcctttagtatttattttctctttttaaacaacagacttgttaggaacacaaactatggagacagactgcttactgcctaaattcaaactctgtcaccttgacaaaactctgaaatcttcctgggtctcagattctcatctgtaaaaggcaaatattagtagtagacataatgcacaaggttgttgtaaggattaaatgaattaacatataataagcatttagcagagtctggcaaatagtaagcaacaaagaagtgctgccatccttttggaaggtgaaagtctagtgtcaaccacattagacttcaagtactgtttgtactgcagtaactgatcttaacccacccactcacccacccaaaaaccaccttagctctgaactccctcttatgtgaaataatttcctaatatttaagtaatattaccttatttctcccaaccatggtacatatatactacctctataaataggtacattttctaggaaaaaaccctaaacggtaacaatacttcaaatttatggcttaaaagtttgtctcaagacacttttacagtcataaaaaagtagaaaactaagatcatggtggtagtaattattttccaaagttctcatttttgctccaaagcttcaattttatctgtcaaaaatatcattttcccttaaagtgagaggctcaattcatttaagatatttgtcgaatacctaggtctgaatacccacagcttatctgcctgcagttctttgaagaaaaaagtgttccataaaaaaagaaaagcagctagtttatctcacaattcaaataactgcaagtgtttttcttagagacaaccactggacttcccattttgcctcactgaaagatgtctatttaagggctattaataaaataatgtttcagattcaaggacattaaaaaaaaagtcttttttctttttaaaagaaacagtgagtgcataatggtaaagaaatacaataatcactagtacagtatagtatcactgccttgattagcgataaggaaccagtaagtttgagcaacccttgggtttgcaccagtgctaaatgtcaacaaagtgataagaatcagtattaacagtatttgccatgaaaatagttgtgacctggctcggcgcagtggctcacacctgtaactccagcactttgggaggccgaggtgggtggatcatgaggtcaggagctcaagaccagcctggccaagatggtgaaagcctgtctctactaaaaatacaaaaattagctgggcatggtggtgtgtgcctataatcccagctactcgggaggctgagacagaagaatcacttgaacctgggaggtggatgttgcagtgagccgagattgtgccactgcactccagcctgggtaacagagtgagcctccgtctcaaaaaaaaaaaaggaagaaaatagttgtgactttttgtgatgtaatagacacctccccaaaggactcccagtggtcggcatatcacttttaacaactgatttaaagtaacctctgctatgttgtacaccttaaatatatattttttttgccaatcgtacctcaataaagctggaaaaataaaatgaaaagaatctgtgctaaatacctctccatacctagctctaatgctatgttctccctaaagctaattattcaaagctattcagcttcatctacattgtctgtacagatagtgtgtagtgtagagctttttaactgaagagaaaaaagggaaatatcctaatttctgtcaataaaggactaacggccaggtgtggtggcttatacctttaatcacaatcactttggaaggctgagctgggaggattgctggaggccaggagttagtgaccagcctaagcaatatagcaagaccccatctctactaaaaataatttaaaaacttagcctagcgtggccaggcgcggtggctaacgcctgtaatcccagcactttgggaggccgaggtgggtggatcacttgaggtcaggagttcaaaaccagcttggccatcatgttgaaaccccatctctactaaaaatacaaaaaatgaggtgggcatggtggtgcacacctgtaatcccagctacttggcaggcttgaggcaggagactcacttgaaccctggaggcggaggttgcagtgagctgagatcgtgccaaagcactccagcctgggcaacaaagctagactcgtctcaaaaaaaaaaaaaaaaaaaaaaaaaaaaattagcctagtgtagtgtgcacttgcactcccagctactccaaaggctgagatgggaggatcacttgagcacaggatgtcatggctgcagtgagtgcaccactgcactccagcatgggggacagagggagaccctatcttttttttttttttttaaaaggagggtctggctaagtaagttgctacatacccaaataatagaatactatacagacattaagagtgaggaggtacgggctggttgtggtggctcacgcctgtaatcccacactttaggaggccaaggtgggtggatcacctgaggtcaggagttcgagaccagcctggctaacatggcgaaactccgtctctactaaaaatacaaaaattagctgggtgtggtggcaggcgcctgtaatcccagctactcaggagactgagacagaagaatcacttgaacccaggaggcagaggttgtgccatctgcactccaacctgggcgatagggcgagactgtctccaaaaaacaaaagagtaaggaggtacctgtcaaaatgaaacataagatatacatcaaagtgtgtagttttgtacaatttaccaaactaagtatatgatccttattcttcaaggacagaattgtttactttgcacataaattcccaggatacacaaaggactaacagagattacctccaagaaggcaggatgaggttacagcagctttattttttccttctacatgctatgctcttaacacctaaattcttaggagcaagtacaatttaaaataaagattaccagcctgggtgacaccccgtctctactgggaaaaaaaaaaaaattggatgtggtggcacacgactgtaatcccagctactcgggaggctgagccaggagaattgcttgaatgaacccgggaggcagaggttgcagtgagccgacattgtgccactgcactccaatgagttagactccatctcaaataaaacaaacaattatggttttgcacctttaacttttcacacacatatatactcttaacctactcataggctctaataaaggcacgttctacacattttaagcactcaaaaatattaaactccctgactgaataatatacgcataactgtaatagcttcatttaaataaaacattttaaaactatcttggaggatattttaatagctcaacatcctaaaaactatttttcagaaagtcttcatcatcaagagtgtattaccttaccaaattcctaaatagttaagacaaaacctgatagaaattcaggttgacactacattcaataatgaatattctgctgtaagagacacaacaatgttctacttctctgaaaacctaagagattgctcatttaaaatatgtgagtgctgaactaaacacatatattcagaaacagcagcaaaggggcaggctaagcacctcctaatatggataagctccaggtttctatgtaatgaacaaagaagaacctaagaaaaatcctgcagagagaactggaagagagtgtgaggttgcaaggcagagtaaacttgttaagaagtcaagggtcctagattatggtactaattctactaactaagaggcaagacaggcatttcaaatacaaaactatgaccagcctcctcctcaccttaatcttcttgtgtttcactacagcattaatttcaaaatctcccttccaatgccaggaaatctcctctaacataatgaatttcccaccccaccactatcccttacatttctttaaattcaagatcactttttttcttaaaaagtaatcagagaatttataaactaagggtccttagaccaaaccccaaaattatgaacaagaactcaatcattaagtatttgtacattcacctcagtcctgaagaatagccaacctgccactatacactcaaaccaccgtgctatgtgctgagatttgggcttgccaactagaacacaagaagccaactaatgaaaataaattcgaaaaaaaattacaagttacagagctgggatcctattttcccctttgaagaagcaacctattcagtataaacagaggcagcttatttaaaaagcactttggcaaaataatttagtttgtaacctttgacaaagtaatcataatcttaaggcatataccttaaaaaagattcaatgggtattttgcaccatggggtgtgttttcagaagtcctaacagcataatgcactatctaaatataattggttaagtaacaggacaacaccacatgcctcctaatataatgcagtgaggaggacaccatatcacttccaggagttctcaccaaaaactggcaacctaaatttaatcatgaagaatcaccagacaggccgggcacggtggctcactccttgggaggctaaggcggccaaatcacttgaggtcaggagtttgagatcagcctggccaacatggtgaaaccccacctctactaaaaacacaaaaattagccaggcatggtggcgggtgcctgtaattccagctactggggaggctgaggcaggtgaatcgcttgaacctgggaggcagaggttgcaaagtgagccaggatagctcgccactgaagtccagcctgggggacagagtgagactccatctcaaaacaaacaaacaaacaaaaaggatcaccagacaaatcgaaactgagagacattctacaaaataaccagccagtactcttgaaaaaagttccaaaatcattagaggcaaagactaaaacaagactgatccacattaaaggagagtaaggagacatgtaagcaaaatgcaaagtgtaattctggatggaattctggagcagaaacaggaaattacagtaaaacaatttgctaaatttaattaagattataggttacataatagtttatcatttactttaatcattttcctgattttaataattatactgtagttattaacatgtggacaatctggcaaaatatatgaaaaactcttcatatttttccaacctctttctaaatctgaaattatttcaaaatgaaaagttaatacattttaaagaagtcccttttaattgtctttatttctgaaagataccctttttcataccctttatatgctttttttttttcaaatttccttatgtggctgatactacttttgtatttaacacagaaatggtacaaaaacaatgatacatttgtaaagaaaaatatgtggggtggagagaaagttctcatcttgtcttaaaacagtatttcaccaactggtcctaatattaaatttaattcgcacaaagataattagacatcgagtgtcattagcaaatagcaaatccccccagaatatcaaagcaaaacaatcaacctctattgagacatttatgaattgaaatttgcgaatacagctgggctaactttgacatgacctcaccaaatatgtgagtgggagaaagatcaagcctccataacccattcttctgttttagattgtactgtcatggctctcttccaaaacaacaaatgaagagagagacattaggacacagacatgcctgctttcatacaaagcatacacacaccagaagttaaaaggttgaggtagcaagtaactgaggcataagagccctcaaaagtgattctcagtaagtacagcaccctaattatagtctgaaacaaaaatcggccgggtgcagtgactcatgccggtaatcccagcactttgggaggccgaggcaggaggatgacctgaggtcaggagttcgagaccagcctgaccaacatggagaaatcccatctctactaaaaatacagaattagctgggcgtggtggcgcatgcctgtaatcccagctatccaggaagctgaggcgggagaatcacttgaacccgggaggcagaggttgcggtgagccaagatcatgccattgtactccagcctgggcaacaagagtcaaactccatctcaaacaacaaaaaaaccccactgttttcaataaaattaaagccacttattttgttattctgacaactcctcatccccccctacaaacccagtatcttgatagcagattaaatgtcatgtttcaatctacaataagatgatactacattaagagactacaaatattaatgcttactgtatgacctcatgtaaatagctgaacccctgagctgcagtgtcttgatctgttaaaataaaaaggctagatcagatgtccctttaaccctaaaattcaatgactcaatgaaatttctgtatacttaaacatatttctacaaatctataaattatgtaaaactcccagtttatattattcaatttaaaaactcacaaaaataccccacaaatgtcattttaataacatcctcattaatagatttaattccaactcttcagcatagtgtagttcaaatttctggtcttgtacaattctcttatgcagagataattttcctataatttttattctgtagagacactgggccttgtataaatcctagatctcttaaaattttaaaaagaaatcatgcaagaagcccataatctgtcacacattaggggcccatagatttaatctcttactcccccttgtggccggagtggcttccattctttgatttgcaatttcctcacttgctttcaaccaattagaaaagtgctccaccagaaatgctaatgattaggaggtgtcaagaactaatttattaagtcttttagacattttgactttaaattattacctttctatgcaatgtggcctaacagaataagattttaagctgtgaacatatgttctataaataaggtcatctataagcaggcttgtgcctaatcacttaacgcattttccattaatagatggcaaatctgcacttttaatcaacaagaaatctggcaaagcaagatgttcctgatgttcaagaactgttaaagccagcctaaaactttattaatataattcctgttaaaagagtagctgctccctgatatttaccccaaaacaaaagatacctacactaaacaatgctgatagaaagccccatctgttctgttctaaaactttttttttttaatcaactgggtgaaagggctagcaggaagtgagaataaaaactgccaaattaaatcaggttcagagaattgtctccctccgaatcatgaatgctagcaaaataatcctagaaggaatcagtgttttaagaacatctaacgctgggcacggtggctcacacctgtaatcaatcccactttggaggccgaggcgggtggatcatctgaggtcaggagttcaagaccagccttaccaacatggagaaaccccatctctactaaaatacaaaaatcagctgggcgtggtggtgcatgcctgtaatcccagctactcaggaggccgaggcaggagaatcgcttgaacccaggagacggaggatgtggtgagccaagatcacgccattgcactccagcctgggcaacaagagtgaaactccatctcaaaaaaaataaaaataaaaaaaggaacatctgaaaacaaattttgaaatgttgttcctaaagattaaaagtgaaatactaggccaggtgcagtggctcatgcctgtaatctcagcactttgggaggccgaggcaggcggatcacgaggttaggagatcgagaccaacctggctaacctggtgaaacctcatctctactaaaaaatacaaaagaattagccgggcgtggtggcggccacctgtagtcccagctactagggaggctgagacaggagaatggtgtgaacctggaaggcggagcttgcagtgagccgagatcgcgccactgcactccagcctgggggacagagcgagactccgcgccactgcactccagcctgggggacagagcgagactccgtctcaaaaaaaaaaaaaaaaagtgaaacactaacaagtatcaaaaagaacttatatcaaaaagaacttaatgagtagttaagtataaacttaaaaattattgacactcactgaaggcgttcctcttctcccctcccccaggatctaggcctgcgctgaagtttctcacaaaccaaggcccaatttaccagtatttccctcacgatgctttttgttgttggtggtggtggtagttaaaacgcctcatttttcatagggctttttagcttgtaagtggcacgctatgtattatggataaactacatgggggactatattttatcagcccctttttaaaaaaggctaaagaccagcttttctatgttcaatgaatttgcagtacttttccctctttgacttgtattatttgtgcacgtctatttccctctccagactgaagagcaggggcttttacatttatttttgtaatagcccagggcttataaaatagcaagttgtcaaatattaaataaaaaatttcagctttctaaagttctcttaaatttaatccaaaatttataaatgaaaccacaataaagtgatatcacagaggtacaaaaggtaaagcagtgtatttgctatttaacaccaccacaggggtgtgttaattcaacaatttcctcaaaacatcctagaggtagatagtattattcccattttgaagatgtggaaacagagtcacagacaaatgcagtaaaacttgccccaaatcacacaatgaatcaaaaattcaaaaagactgcatggctcatgctaagttttatcacctctcttaaagtaaggtagtatacactttagtatcctttatttttagaaatgttacacagggatatgcttaaagttttatctctgctccaattaaagaaaaagagcctgatgctagtcctccattagatggcaacaatcaaagggcaactgggaaggaaaagtcgttactcttacaaaaagcagattgcttgagttgtcttatttctaaacatcttcctaacacaatgctaaaggactcatcaaattgttgaattgagaacttgcctgttctaggcaagaactacagcttgcctatataatactaccttcaactgtcaattccacagaatcacattttaagtaggtattttgcataatattttcatcaagtgtctcttggttgaatgtggtccaagtatgtcattctaaactggacaatgtttattacgtttaaggagcaaaaaaattataagctgagtgttcataagtcttggatcaacaaataggtctgtctcagaaaagcgtttgtaattaatcacttagatgagaaacattccgcataccagtgggttccttggtataacgctaatttttaaaaactctagatcccaaaaattgtttgcaagttagaaattaactgccactaaaaaacatttctaggccgggtatggtggctcacgactgtaatcccagcactttgggaggccggggtgggtggatcacctgaggtcaggagttcaagaccagcccggccaacatggcgaaaccccgtctctactaaaaatacaaaaattagccaggcatggtggtgggcgcctgtagtcccagctacctgggaggctgaggagggagaatcgcttgaacccggaaggtggaggctgcagtgaggcgagattgtgccactgcactccagcctggacgacaaggtgagactgctatctcagaaaaaaacaaaacaaaaaacgacaaaaaaaaaaaaaaacatctctaacttcccaactcattaaacgattaaaataaaatactaatacaacaaaaattgggcagtccctgcaaatttaatgcaataatccttcttagattttaaaattcaacacatgcatacaggccaacccattaagcaaatcttatgttggtccgcttaactttatagattaatacttggctgaaactatccttatattcttttacctgttgttaccactgtaagcacatttttatttggggaaggaaggctcacaacaaatcctgtcaaaagaaatccacaagagcttacatgctgaaactttttaataacctatccaatgtaaacaaaagggcaggtgtcacacaaaatgatcttactgatatcaagtcagctatattcatccacatggctttggtgcctgaatggcaatagaaaaaaaaactagtgaaatctgccaatatgtaaaactctatcctacactacactactacttctatcacattataccttaccagaaaacaaaactaaatcaatgacaactgctattgcacagtaactttcacatatacaagcttttcataattaaatggaattactgactagagaacaagtgaatgatcggttacatagaaatacacataataaaaaagagagaactgctgatacgaccgttcttcccacaccaaaatttacatttgtgccatctaaatatcaaagcatatactccttcagtgtactttacaaatacacaaatgttttcaaggagaaaagaacagagccaatcttctgatgctgaaagacagataatcaagattaaaataagtcctaaatcgagtaatgaagcagaaaccctcaggccataaagatggtaattagcaacagtttgtatcagggatagtgagacgaccaaactaaagctaaaagcctcttgcagggaattctggcaaggatcaagcaaatagatggaatgaaatcagcattttagaaagattagaataagaaatacatgcaacatagaactgaaaaaggaaaaataagagtaacaagtccaagtgaatgaccacaagcagcagtaaaaagatgtttataatttagcttttgtccattaaaagcacatcaagtttatccatacagtatcattttcctatttggcaatgtgcacttttctgagtataatcctgggaactatacaattcagcgtgaatgtaaaggatagggaaccaatgatatgggaaacatcaacagcttgtaatctgaaaattaagtcaaagttgagtccaacatgtcgtgtgattaagtctagaaaacatgctaaaattgggtagttataaagaacaggcagtttcaaaaggaaaaggaatgctggctttgagtatattgaaactgacagcagttctaagtcccctaaaaccttgagcggtgtttattctctatgtggaactgtcaagagtaaagcaaaagctatgggaactagaatgaaatcacaatagggaaccaggaattctacaaaaaattctaagaaacttattagaatttcaataaactatatgctaacttttaaaacttacttgatatcagaacacctgtcattctgacttaaaaattctcacacacacattcaatataaatatgccaagagtaacttattttggaatcaaaaatttgagaaattaatccaaaagtccaatgacatttaattcagtattataaagacagagctagtttcccttcccatcaaacagcaaaggcctctacacctttccattccctttcctttattttcatcatttccacttcatatacctcagactttttgtatttgtacaaaatatgtcattgggtgtggcactttacattaaaaaaaactgaactttattaccaaagacactgtccaggccgggcgcggtggctcacgcctgtaatcccagcactttgggaggccgaggcaggtggatcacgaggtcaggagaccaagaccatcttggctaacacggtgaaaccccatctctactaaaaatacaatacaattagctgggtgtggtggcgggcacctgtagtcccagctactcgggaggctgaggcaggagaatggcgtgagcccggaaggcagagcttgcagtgagccgagatcgttccattgcactccagcctaggcgacagagcaagactccgtctcaaaaaaaaaaagaaaaaagaaaaaaagaaaaaaaagacactgtccaattttttccttcctgagaccacagaactgggattatttatactttgaaacataccaaaaccatgaagacatgtaaatatacagtatatcttaataaaatgaaatagtaacaatagatataaccctacagagttctttggagaagcccttattccaatgagctgtctagtgattttcatcttaaaaactgctaactctacatagcagtttttaaagcccaaggcacgtaataatatattcagactaaaacggacccaaagccgcttgctttcttatttctgtttaatggtagttctgtgggctggagataaaaatcagtgacccataaccacaacttaaaattgccctgagcaaataaaaacgtagagcagcaataaaatagaactcagtcaaattaacagaatcactattaagattactcaactgcagttgccaactgttataaatgttagacacacaattttacactgcttcctctcggagacctcctatataaagtcattctctgcctacagcagtggattttaaattttaaaatgaaacctttgaaaatttgatggttggcatggaccttctgccccacaaaaatacacaattttaaaggcttcttcaatcttcgaaattccattcatggactgtaagttaagagacccctgcactattataggcaggctcacacttttaaatagaactgaaaagctaagataaacaggacacagaaggtagtcaaggtgctttacctgactctcattccccacaaccctgtgggatgagtattattcctatttaattgagcttagttttctcagagggactgagtgatttcctcaggccatgcatctattaaatggtaaaactagtttgactcagtatcttgagctccattattcacctcgacatacttctttgagtttgaaagaggcttcctagactgtatttccttggtattcatttcatcatgtgcaagataaaaactacccaatttttggctgccatctttcaggtttaaagaggtactagtgttgagtccctccccaactaccaagagagcttttgtctaagcatctggcaggaaaggcagattgcattagttcacatattgcagtttgaaattaacacgtggaagagaagaaacccaagttcttttacataatgcaaagtccacattgtgaagagcatgccagtgaccacttcccgccataatgctctatttactcttgtaatatgcaacatggtccaagctctttgcttattaaatggttaaacaatagataaatacatataaccagaatgggttactaaagagctcttcagaaaaactcagaactttggagattagctgctttttgtaggaagaaagtttattttcatagctattataaaataggtgctcaatataaaaaatctggttatcactaatgccacaagccaatactattatttctgcaaagggacacctgcttatttttctcaaattaaaaaatatatatatcaaagcccagaaaaggctggagtaataaaaaattataattgattttttatcatgtaagatcttaaaaatataatttaaaatatttttactaatcattaataatgattcaataactttttctagtagaaatatcagttctgctacattttattcttccatctcacagaaagggcagaaggaattttatgcaatatgtttccagagtcgatgtgacctatttgaaaaagatggtaggaaaaagaagcctattatcggtaaatatcaaattttcccaagcagaaaaagaaaaagctagggaaattttgcagtgctgctgacctaattctatgctctttctctaaagaagcctttctgcttgtttaacaaatatttgagcatctattacacgttgagtatgcaaagatcactaagtcttactcctgaaaagaccaaggctggaagcaaaagcttgtttagaattctcttcaaagccatttgtatagtaaagaaattaaactctcatttatccaaactttcaaagtgtaaataccattaaaactttttgggaagccagtgctattctggagggtaacgatgtgggtagggaccagagtgaacttccttaataatcataacaagaagaaactatttatatgaagagattatcttgttatcctcatctactggttctatgcaaacaaagtttcttcataaggaaactaaagggaagcatagtcaaaactgctacaagttgggctggacgtggtggctcactcctgtaatcccagcactttgggaggccaaggcgagtggatcacctgaggtcaagagttagacgtgacctggtcaccagcctggccgacaaggtgaaaccccatctttactaaaagtacaaaaattagctgggcgtgctggtgcacgcccagtaatcccagctactcgggaggtcaaggcagaagaattgcttgaacacgggaggcggaagttgcagtgagctgagatggtgccattgcactccagcctgggtgacaagagcaaaactcagtctcaaaacaaacaaacaaacaaacatacacaaaaaacaaacctgctacaagtcttttccttggaaaagactcacaatgacaggaacttttatactttgtatatggaaaacatgcacatacctacctggtattgcaaataagcgtgttagtaaaaggtaaatgttacattcctttttattcctaaaattgacttttgtcttaagggaaatgttaatgtgtaacacaccctttgaagccaaaataaaaacttttcgatcaggtgtaataattgggaaaaacactccagactgaacaaaactgaattacacatacacagatattagttagtaaggtgagcaaaaaaaaaaaacaaaaaaaacaaaaaaacccaatacattttttattatagaaaaaaaaaatcacattttcaaaatttaaatatttggccgggcgcggtggctcaagcctgtaatcccagcactttgggaggctgaggagggcggatcacgaggtcaggagatcgagaccatcctggctaacatggtgaaaccccgtctctactaaaaatacaaaaaaattagccgggcgcagtggcaggcgcctgtagtctcagctattcgggaggctgaggcaggagaatggcgtgaacccgggaggcggagcttgcagtgagccgagatcgcgccactgcactccagcctgggcaacagagcaagactccgtctcaaaaaaaaaaaaaaacaaaaaacaaaatttaaatattcttattaccttagcaaaatcacaaaacagacatttgtcacttggccccaataaaagcaagatattccttttttcaacttagatacaaatagtagctatcattctaaaggtttcaataagcaaagaacaaaaaaatgccccaagacagatgcctcattgagtttgtggctgtgaacccaaataagcatgtttaaaaaatcactattctttaaaaagacagtgtcaagtaagtatcatttgagaaaattacagtttaggaactgatgctattccattagtaaatacaaatgtaaagaaatgatagtatcatcacaactttaacaaaaaccccaaacccacaaccacatcagacattatcctattgctcattatagcacttcttccataaacaaggttcatatagtaagtaacaaacctggatttccatactgagttccagattcagtaatctgtccagaaaaatcgagatgctgcccctctttgtatatcagagcccttccatactggttaagtgtaaccatttagtaaaaccactttaaatattattccaaaaactgccagcttggttggattctctactggtttatcctcaaatttaaactattcttgatcaaaaagccctactttatatgacagattaaaattaaccaaaatgtagtttaattcttttaagcgcagtgcttcaacacagtaagtactgaatacttaaaatactcgattcaaactggaaaatcaagcttgagttgttcataacctttcatcatggttgtgagtgttcaaaatttaccttcaagaattcaatgcaggaagaggtttcatagttgtgacgccagagttttctgcatggttgactcattacattaacattatagcggctaatcctgagaagagtactatttctacaatgagtatcctattacatctctcttacctaaagtatgtaaaattcctttatccacagatgtacatttaagataaccagctatagagctactacaaatattctaaccataagtaaaacagtaacacaattagtttatattttcaattaatataaaatacaatactaaagtctgttatttttaacaaaactgaactgtttcataatcattgttgcaattattttacatacacgtatctataattgtcttaacatctttttagtcatgacaccatgaagacttttaaatttggaacacacaatgtttagaaggaaaagaaaaaccaaacaaaaagttaagagtaatgtaactgatactcatagggaccctacagtataatgaagccagactgaattgattctcaccagtacatcattgcagatatctcttagctccgtctcaattttctctctgtattctcgagccatctgctgttttttctcagcaccttccgtcttttgttcaatacttgagacgaccctccaagatgacctacgggctcctacaacatttttataagcaactgagagaagattcctctcctcattggataattcagctccttgctcagttacagacttcatgcaggctgccatgtcatcatatcgctcagcctgctcggccagtttggccttctgaaccagctcatttttatccatgactggatgttctgcaggggggaaaaaaggagtatttaaaatttttcccatcaaaataaacagactcaaaattatacctgtggtaaatgagttttttaaacctgaaacctaactgcctgtgaaagactgttcacatgaggaattaaaatgcagcctcacaaaaggatagtcaaaaaagggaaaaaaatttagcatactcagcatcagaggtaaacttacagccattaacacatcagtgtagcaaaacttaaaatttgttcagaagacccaaatttcacatgtcaaaattacttccaaaagctgcctcaaaaactacccctaatcttacctgatcaaaatctcaactcatttccaataccactaagtgatccaaaattaagcagcttttcttcctttagtaaaagcattgtttacagagaacatctggatttctatcatatttccagaatcataattcatatcagtttaatgtaactcacgtctttttactttcataatactcttgtcaagagtgattacattttagctttagtgttacccctaccccaaacctactagatctctgcaacaactgccagccaataatagcataacaatttgggggggaatgaccaactgtttgttttcagatattttgagtataaatccaccacaaaggatcaatatctgaccctaatgtctcaactctttatcttgttatatgtccacatgctttaaaaatatccgcaagtcatgacacttcaactcttactgtgagtactagaatatatcacattggaagtacttaatttataagtgtttccaatgtcatcgctccagttgaaatgcagaagtgctgcattttgcttctagccatcataatgtaattggatgttaccactcaagctgtcctttaccatgactacccatctaattctctttccctcgcattttagtttcctggaccttttcgatttacctcagctacatttttctggaaagatacccttttgcaagttgccgaacagcacaaagatactaatccacacagtgacaccacagaataaatgacttcagaggaaaatacacaccctgaatgaagtgcacttttaagttagaaggtgaacagaagagtccaccttggcagctggctcccgaatattaatcatcttttaccttcccagggaaatcccacaatatttttttaaccaaatgagagaacaggtcgccacattttaaacaaataattaaccactttggatgcaaggtactggctcaatacgtaaactatttaacctttatgacggcattattttcgtcaggtctctaaattactgatttttcccttaggatctcagaaacgctctctggttatttctgcttctaacaaaaaatgatttaagccagtacaaaggattctctccccaatcacttcggtacaagaggaagtggataaggtttctcacacagtaacgagtgctccaaggcctcgcctctacactgcgggcaggactcaccgcacccatttaacccttacctgacttgagacgtcggttactgtgaaacgaaaacgggcagacccggactttaaagtgcaaattctccggtccgcgtatcgcaaccacccccctccaggctccgcccaagtcggagccacggctcaagtccccgactctcctcctttgtcatggcggatctgtgtcagggagcccaacctactgcagagtgttaattcctccccccgaccggagccagagggaggagcagcccgcgcccccgcccaagccgtgggggggggggagagatggggagcgaagccgcccgaccccggggcagagacgccacagcagcccgcagaagcggaaccactaccagccccgccgcggacacaccccgctctcccacccagcgccttccccgccaccgatcagcgccggtgaccgtgtacagcgtctctaagggaccgacagctgcaggtgggggaggggacgagagccacacccagccgagcgggccaccagcggctatgctcaggctcacccgcccccaaagcaggatatgcgtccccaaaccgagcgcagggaccctccagttctagtccatcaagcacgggagccgactgcgggctcaccaccctgttctctaccccgacctggacttgcagcccccgtccacacctcccccgcccgttcacaaggagcaaaaaaagtcagacccatcccccacccccaccaggaaaattcaagtccttcctcccaccgcggagcccaggaaattcagctctaggtcccaggcgagccccaccccaaaacctcaccccgcagtggactcccctcccgccggcgcgcagcctcgccccggtctacctggcgggcgccgccgcgccaggcctgggctccggcccgctctcggccaggcctttccctcgcgcttgggtccccgaggcccccggcccctccccgcc

SEQ ID NO: 2170 - DNA, 32757 bp, Homo sapiens; identical to SEQ ID NO: 2169
  source 1..32757: mol_type = genomic DNA

SEQ ID NO: 2171 - DNA, 31996 bp, Homo sapiens
  source 1..31996: mol_type = genomic DNA
tctccattgcacttttatttgaatgtaatatttgggacaattattcaaaagggccaatatttcccaatttaatctgaggtcataataaaacaagcaacaaaacagtgtttgggatttcagtttctcacccttatcatcaagactcactgcctcccatcatcaatatttattgagcatttacagtgtactaggcacaatagaacatacagaaaacattgtccctgctcttgaggagcttacattctaaaagaaaaaatacaccttttttaaaatggcatttttgtttggtgttttctgcaaagtactgaggaaatattttgtaaagtgagctttgggtataacttagccccatcattatttagagaatagaggaggaagaaagaggaaggattttaaaggcagacaatgacagaccattcaggataggtagggttttaaagggagataaacacagtctcatcaactaaggagagatttgctgcagtaaataggatgagggaaatagtctgtgggatgcaagcaaaggaagcagggtgccttagacactgagtggagccagaaagatcatgcggcctttttccaagtacatggccaccaagtaagaatggttggtgacaagacagaaggctaaaacaggaaggtaatcttgtgcacctgacaaatagaaagaataaaggatcaaaattgaaggcaggctataagagtatcaagaaattcttaaaaaccaaaaagtgatttggaagcacaaaacttacagttaatgctacccaatgtcatgatgggccaagaacattgtggcttcctaagttagaaaatgccatatgccaaaattttaaatggaacacactacatttttttctaatcaatccccccctctcccagaaaaaataggaactcatttttttcagggtggggaggaagagaggggatcatgggacatggaaacagtagttatattagtagtatttttgttatgataaattttgtgtttaaacttggtaagagcccattagctgccaagagggaataaggaataaatttcaaaaaatgtacaatttcctttagagaagtttcagaaccaagactaatttacatgaaaagctgtagagaaagtagttgaaaagtccattcataaaacttttattccacttacatgaatttaatacacgtgttcttaacaattatgcttggattgttcatgaaaatttcataagacattaaacaaagctagccatcatctcaagttatttccctgttaactatttttacagcacatgcatgttaggcaagtatcaaaaaaaaaaaaatcacaaaagcaaaaatcctaaaaaaaagttaaatacatgggtttttgttttactgctgtgcttgatatacatgaagtaatgaataccaagcaattcatttttcctgcatctttacttttacatttgttcttaggttgcctaaaacatttaaatacaaataaaatgagtgtagcaaaaataatgaaagctaacagcaggtaactttacaaataatggaatgtgaaccgtttctgcccttatccagagtaaaatgggtcacaactttgtctaaaggaacacttctgcagctgtagtcaaaggtgtacacattgagtattccacagatatacatggtttaatatgtggtatccatggggtatgattctaccacagccttgtaagtgctccaaaccttaaagtacccacaattactacacctgtgactggaaccaatgatcccttttattccccgccaggacaaaccagtatgtaggcagttttctttgcttagacatggaagcagttttacactggcccttttgaagccacaatgtaccaaaagtactatgccaaacacttataacttgtataaaaattccacatccccatattggccacctcaagatgaaaacagataactccctaaatgttaactggctctactcccctaatattaaacataaaaaccacatgggaaatatagaaattcaaatagaagtaacataaacctgtcataaatcgtaaacaaaaaactatttgtgggacagcatggatgacaaatggtctactgtgtaaattttagaatgaggcagacaaaagttggaaggccggttaattttcccctccttctcctgcttcagcttcgtctccttgggtatccgatgtccacaactggtaaaagaaggaaagatttttcagcaagtttcagtgggatgggggggggggggcgttttcatataagtgccaagatacctgaatgttttagttggaaagcattcttaaaaagatagcagcatcacttagcttcaagatacaaaaacatctcaatatacaaatttactttttttgtaaccactatataagcaggttaagtacaccacagagttgccttcaaataaccttcagatacaggaaagttttggttatccacagaaggtgaagagaaattacaagaaataatactttttttttgagatggagtctcgctctgtcaccaggctggagtgcagtggcgtgatcttggctcaatgaaccctccgcctcccaggttcaagcgattctcctgcctcagcctcctgagtagctgggactacaggcatgtgccaccacacccatctaatttttgtatttttaggagagacggggtttcactatgttggccaagatggtcttgatctgatctcgtgatccacccacctcggcctcccaaagtggtgagattacaggtgtgagccactgtgcccaggccctaaattattttttaaaaactaagcatcaataggtgtcagaacctaaagagccccaatatgaaagatggacgtccaaggtgagtgcaactataccagaagcatctaatttggcccatgctgaaggagctagggttgactactctccactggtagatcttaaagtgactcacactccaaacagaatcctatactccatgaaattcaagaaccagcctcaactctgagctaaactacaaatctagcttttctaacactttaagcttagaaaaacaaacctttatttatcaggttggtgcaaaagtaatcgcagctcttgccattactttaaatggcaaaaccctcaattacttttgcactaccctatcatatgattcaaaataaatgctggacaaaaaccagaaccaaatcttttaacaggtaaaaatgaaagttgtcccataggtggcagggttatgaactctattccacctgctccaatgttaaaaatgttgaagtcttaaccactctctagtgattttcagaggtaattacaaaaggattcaagacaatcttaaattttatatatgacttacacatgaaaacggaggggaaggggaaaatacactaattattatttttatattccccaaatcatccattagcttcatttatctactaagcaaatatatctctggcctggaaaggagactacttccaaggtcatacagatagccaaatgacctcttggaaactgtgtgctcctcctgtcaaacaaggggttttgtaattgcaagatgaaattgtttctaatgtctctttcctgttctaactttcaaggattcttgaattttctgtataaacatgcaaatttgatacaaaatatttctttttctagagtaatgtgttgacagtcttggtcaaccaaattcagaatgaaatattaagttttgggataatttcttttcttgacagataaatgttccaatcaacctataatggtgacagctgacactaataaggctcagagaagacatacaagtagtgacagaattagaatcaaaaccctggttttttcttttctttttttttttttttgagacagagtctcgctcttttgcccaggctggagtgtagcggtgtgatctcagctcactgcaacctctgcctcccgggttcaagcaattctcttcctcagcctcccgagtagctgggattacaggtgcccaccactatgcccagctaatttttgtatttttagtagagatggggtttcaccatcttggccaagctgttcctgaactcctgacctggtgatccgcccgcctcggcctcccaaagtgctgggattacaggcgtgagccaccacgcccggccaaccctggttttcttattgcaatatgcgctcttcatgctatactgatagcaaaattcagttggaagcagacagtagatcagggcctctcaaaaagtgatgtgaacaaaacacagtatctaggtctcaggtcatcactttaaaaatgtcatcacttcaaactagaaaagaaaaatccttaatactaaagttagttaacaaagtgcttcttatgtttgatatataagattctttcattctttactgtggcttgttatcttgactcaagtatcagaaaagtttatagatagctccaaattgtgctaataaagtaattttaggtttaataaacaagtatacaatactattcaaaaaactcttcaagattttcagcactagcatatagaactggtttatagaaaatggcagtggactagaataaagttggaagagaaatgtataaaatgagattacatagtccccaagagaaatggccctagaagtctaacaaaaaaacagtaatacctagattatgatctgcaattcctacctctttacctgacacacagcaaatgcttgataattttttcacctaagcctcaaaatttcaaatctagtatttatctgaaggagaagaatgagaagacctaagaaacaaacgagacatacaaatcaactgcattgtggactgaatttgaatcccaattcaaataacttaaaaaaagagagataattggaattcaagtattatttagatattcaaacattattagggaattatgttgatgttcctggtgtgatagtgacactgtttctttttatacatctgcagtatcccaaggacaatcacgacctttcatattaagtcatttaaaataagaagctaggcaaaatagacttccacttggattctgtagatacctgagattttgtaactcaagttattaattccctaccattatctttaccaatatggaggcaacttgatgggcaagaaaatcattcttaaaggaactaaaacatgtagagtctcagcacacttttgatactaacaaattttaacaagacaggtaactcatcaatgtgtgtattttttagttctcagtctaatatttcagtttctgtaattttccttcataggactttaatagtagctgagatatatttatgagagcctatgaaatgtgttgagaaaaaattttaaaagatgtatttaataaaaaaaaaaattccctagagtaaaacataacctcttcaaccacattcatcactaatgatgctgttatgtacttactgtcaagttgtctctcagtaattgcattattagcgtgctgtctttgtatgactcttcacttaatgtatcaagttcagcaatggcttcatcaaaagcctacgatttaaaaatagtacattacatttcagtgctcaaataataaagactgctaaatttctacgtaacaggtaaaatacatactgtctttgcaagagagcaggctttctctggggagttcagaatctcataatagaacacagagaagttaagggccagacccagtctgataggatgtgttggttgcatttcctttttgctgatttcaaaagcttcttggtatgcttgttgtgactgatcgacaatccctggataagacacaccaaaacgtactgagataaagtgtgcattatatcttcacccctcaaaccaaacctttaatatctcacatatcctttgaaatactaacctgtaacagcttaatatttgttaattgaacaaggtccttttttttttttaaagggagctttctcctggtacacactagccattgatcaatgtcaagataaaacaactttataatctcattattgttatgtttttaaaaaattgacgagttttgacatcccagacccaagcaatcctcccacctcagcctccagattagctgggaccaaaggcttgcaccaccatgcccagctaattttcaaaatattttttgtagagagagatgttgctcaggctggtcacttttcttaaaatcttgaaaaaacatccctgtacacaatattggcttttcagaaagcatttattttagaatagcagtatgaggcagtagatgtgtattctcagaacacaaagagcactgctactccttattcggcactctaagcaattcaaaacaagacattatgtacgcttcagagactcttcctcactatgttatcttatacaagttcaaccaacaggtttaaaaacagcatacctttcttgtcatcaccagcggcaacctcagccaagtaacggtagtaatctcctttcattttcaaatagaagactttgctctctgcttgtgaagcattggggatcaagaacttttccaaaagagacttaagaagaaaagaaacagacatagtgagaataaaacatttacaaaactgaaagaacttgcatttcttaaagaacaaactatagcctaagttataaaacttaaacacccagtcactgtcaatacaattgtgaatgcagctggcacatgaatttgtggtttaaagcagaatgctttgggcagcaatattttaagtttgaagttagtgttcagtttattatttgaggacaataaaattgaacattggtccctgacaatgttatctatttacatgctgacttcatgaatgtggggcatgaccgttcacatttaggaacattttctaatgagctggcaagctttccatctgaagtttcatgtggtcatgacatgaaaatagaaagaacatacgggatgaaccttttgggactctggagaaatgactaaagcagaaaccaataatgtaagacacttaaggagtccatgccagagaaggaggaacaaaataaacttcatttataacaacacaattcaagcaaacctcacaacagataaaaaaaccgttcaaaagttttatttttcctaaagacagtggtaggagacttacagattttaaagagcagacctttaatctcattgaagtcattttcggctagtaagatacacgattacagatcatcccagacaacagataaaattaaaacatcatcctataaaattctgtctaaaactactattacaatctgagtcatttgattaggattttaaaaattacactctttaactgattttaaagcaaaaagattagatcattgtgttggggatgggaagaagtctcaataaatgtgtaatttttttctttccagttaagggggagaaaaataattctagtagtagaattaggtaaacattaaagcaaaaaaaccccaaccacccattctcactaccccacttcctttaaagttcaagtacactctgagaatcaaggtgaagtcaattttcagctgagctaaattccaaatccattcttacaaaaaaaaagtattagtttatatagcacctacttatatataaaatataaatttgaaaaatgcttttaaatggtaactccaactttttgtttacccattatgttccaatgctgggtaggtgaacagttttaacccaacttcttcccccaattttttttttttttttttttacaactcaagctacagataacccagatgaagtggcagtagggccagattgcactgtgctatataaagaggttaaaggtgagaaaagtcaacctgaaatgatgtttcctgcaattattaaccgatatttaaaaatactggcctgaggccgggcacagtggctcatgccagtaatcccagcactctgggaggctagggtggcaggatcacttgaggtgagcctcgtcaacatggtgaaaccctgtctctactaaaaatacaaaaattagccaggcgtggtgacgggcgcctgtaatcccagctgaggcaggagaactgcttgagcccgagagatagaggctgcagtgagccgaggttgcaccactgcactgcagcctggatgacagagcaagactccatctcaaaataaataaaaataaaataaaattactggccggaaatcagaagaacgttttggttaggatagcaacctctgtcttacaccacattcatactttcatattcaaagttctcttagctgcaaaagtgttttgtcctttgaatacaatgctttttaccacctatggttgctctgtggagatctgcctcaaacagtggaagacacttgcatttaaaatagtcaagtgagtctttccacttaaaaacaatggttttaagaaacaaatgaccaggattttcaaaagtttcattgttacacaaattgtattattcattcaactatgggagatggtataaacataagtggctttggggtgagtctggttttgaattacagcactatacaccgtgtgaactacttaatctcaatgattcagttatctcacctgtaaggcagagacctctaagattattgagaaaaaatacaggtaagcacttaggagtaagcacttaaaattttatttctattatcacaataacaccagacaccatgctagaagctggaagcacaatattctggtaattcataatctagctgtagagacaaggctatcattccttccattacaatacactttacaagaattgcagggcacggtggctcactcctgtaatcccaacactttgggaggctgaggtgggaggatcacttcttgagtccaggagtttgagaccaccccggtgaacatgagatcctgcctctacaaaaaaatttaaaagttaaccaggtgtggtggcacacccctatagtcccagctacttggaaggctgagacaggaggatcatctgagtccaggagtttgaggctgcagtgatctgtaattgaattataccactgtactctaggacagggtgacagtgaggctgtctcaaaaagagtaacactgcctaatcacgtctttcacttttcggtaactttaaccccctctatgtatgcagagatgaaggccataaacacatgcagttacttaagagtgaaccagtcacttaagatgtaaaattttaaagctgtactaaaaacttaaatttttttaggaaaggtgttgataaatgctactaaaagtagtaatctatcttttgtaggtagtaactttctacctgggtaatatgctgaactaagcagttccctgggaattaaaatggcagttaagcacttctttccccaaagctgaacactgaattaaccataaaacaactttaaagctatttgttagaacccacaagtaacaggagggctgggtaaacagcagtcaggctgcttactggcctaatgatagaccaaaagaaccaaacaagtggcaagtgtttctggtgagatgctgaccataagagttgagaaaggtggctgggcatggtggctcacgcctgtaatcccaacactttgggaggctgaggtgggcggatcacgaggtcaggagatcgaggccatcctggctaacaaggtgaaaccccggtctctactacaaaaagaaaaaattagccaggtgtggtggcgggcgcctgtagtcccagctactcgggagactgaggcaggagaacagtgtgaacccgggaggcggagcttgcagtgagctgagatagtgccactgcactccagcctgggcaacagagtgagactccgtctcaaaaaaaaagagttgagaaaggcataaatggcctacttctaataaatcgtccaatgacataagctaattaagatttaaaaacccaaaaccaagcaagactggattaaagattaaatttaaaggggctaacactgtagctcaaaaaaagctaactataaaagaacattttctgccaggtgtggtggttcatgcctataatcccagcactttgggaggctgaggcgggtggatcacctgaggtcaggagttcgagaccagcctggccaacacggtaaaacctcgtctctaccaaaaatacaaaaaattagccaggcgtggtggcacacgcctggaatcccaggtactcaggaggctgaggcaggagaatcacttgaacccgggaggcagaggttgcagtgagctgagattgcgccattgcactccagcctgggcaacaagagtgaaactccgtcttaaaaagaaaaaaaaaaaaaggaacatattctcagcctcaatggggtgatatacctactagaaaggacgttattccacaatcaggaatcaaagttatggcgagtatactagaaactgtcaggataatggaaagaacaggacatgaatggctccaagagacaagaccaattaaatttagcaagagggaagatttctgttcagtatgagaaaacttatgagtggtccagtactggaacctgctcagtgaattccctcttttcacataaaggtaaaacaggaaactaaagagggtaacttaggtattttgtagaggagattcataaagaagatgtcatctgtttcttttaaaaaaattttaattgacaaaatagttgtaaatattttgggggtgcatgtgatattgatacatgcatacaatatataatgatcaaatcagagtaactgggatatccatcacctcaaacattgattttttttttttttttttgagacagtcttgctctggcacccaggctggggtgcagtggcgcaatgtcggctcactgcaacctcctcctcctgagttcaagcgtttctcctgccttggcctcctgagtagctgggattacaggcatgtgccaccatacccagctaacttttgtatctttagtaccaatggggtttcgccatgttggccaggctggtcttgaacttctgacttcaggtgatccacctgcctcagcctcccaaagtgctgggaatacaggcgtaaagccactgcacctggcctcaaacattgatcttctatttgtgttaggagcactgcaattcttctagctactttggtagaataaataaatgttaactataatttccctactgtactattgaatactagaacttatttctactatctaaccggatttttgtacacgtggtctttttcaattctaagggaagtcagagttcacagaattaatttaatggtaacataaaagaggcaattaagtatgttgctttgtcaaactgaccgaagaataacaaatccaagttttccagatttggaagccagaagataaaacccaatgtaggaagaatagaaaaaaatgaataaaagaacaaaagaaaaaggaagcagcagttacaacaaagcagaaaaaaacatggaggtgcaccaagtagagaatggaagggaggaaagggctgatagctactttcaaaatatgcaataacttcagagaatatcctgctcaacacagaaataaacctcctaaatttcgttcacctacaatagtacaatgaaagcaatcatgactgaaataaagtctgaagtaaaaaggggagggagtgggcacaccataatataaggaagtatacactaagtgtcacaatttcaaccgtatttagaacgaagtctcgctctgtcgcccaggctggagttcagtggtgtgatcttggctcactgcaacctcagcctccccggttcaagtgattcttctgcctcagtctcccgagtagccgggactgcaggcacatgccatcacacccagctaatttttgtatttttagtagagacagggtttcactgcattggccaggctagtcttgaactcctgacctcatgatccacctgcctcagcctcccaaagtgctgggattacaggtgtgagccaccgcgcccagccaactccaactgtaaaacaagggctaggttgactgaaggttcaacttgtaaaatttttcaattatcacagtaccttaagtttttaaaccaaatctaaatggttttgaggtcaaacaaaattcaagcacatcctacactcaagctaaatcaaggctaaatgttaatctgttgaatcttcctgaaatataatctcatttagaaatccacagtatttcctcagtttacttcaaaatgtggatgtaagttttacttttttccctcccattaatttttttaatttttatttagagatgaggtcttgctctgtcacacaggctggaatgcagtggccccatcatagcttgccctgctcccattaacttttaaatatgttttttcatgacagccactgtcttttaaagatatcatggccaacattttagaaaatacccaagattaatttgctgaattagagttaatgcatttatacagcattcaccctaataatattaagtgggataagaaatcatttactcagcagcaaaatgccacaagaagccggtatctaatactctttggtaaacagctcctaatccagagttaaatatgtgatatgggctctgaagagaggacactaatccttaacctaaccaacaggtaaattacatgaaatttgagattttagagataaaagagatttttctctctactgcaccgtagtataattaacctcttagattgtgaaaacacttccaagagatggggttcaaataacatttttcctcccaagccagtttccaaaagatgccttaatccaaagatagtctatatttacaatgatgttttgtctttaaaattaagtctattaaaattaaggaaccacataaattgacaggtcatctgtttctgatcccttcttggcatagactcaacctgatcccactaatatgaattttataaacactcactcctgcctgtagtcaaatattcctaatgaaaagttaatgaactgagaatctatctctagtgatatgcctttctcactggtctttcagtatgattacccctaaaccaccaaaactgctgcctgagctggtggcaagactttaacctttcgggcattcaacacttgttagaagaaaagcttgatgtaatgcaaatcgtataaactctaaaaccaggcagacttgaaattccaccctaacccattaattttgagaatttacacaatagctaatctttattttctcatctatatgaaaatccacatcaaaaggctgttatgaggtctaaatgaacatataaacaggagggcaccattcacagctcccaaccgagagtaggcattctactcactggttgctcagttatgtgaaaataaagtatggagattctgacattcaaaaatctgctttagtgctcttgtactcttaagtacatcattttggctttggtaatctaaaatttgtataactaggaaaaatggtgaagtaggatgcaaaaaagttttcattcaaaaacacaggattaagacatatcaaagaacaaaagaaaaaagaacaaaagaaaaaaagaacatttcctttagtatttattttctctttttaaacaacagacttgttaggaacacaaactatggagacagactgcttactgcctaaattcaaactctgtcaccttgacaaaactctgaaatcttcctgggtctcagattctcatctgtaaaaggcaaatattagtagtagacataatgcacaaggttgttgtaaggattaaatgaattaacatataataagcatttagcagagtctggcaaatagtaagcaacaaagaagtgctgccatccttttggaaggtgaaagtctagtgtcaaccacattagacttcaagtactgtttgtactgcagtaactgatcttaacccacccactcacccacccaaaaaccaccttagctctgaactccctcttatgtgaaataatttcctaatatttaagtaatattaccttatttctcccaaccatggtacatatatactacctctataaataggtacattttctaggaaaaaaccctaaacggtaacaatacttcaaatttatggcttaaaagtttgtctcaagacacttttacagtcataaaaaagtagaaaactaagatcatggtggtagtaattattttccaaagttctcatttttgctccaaagcttcaattttatctgtcaaaaatatcattttcccttaaagtgagaggctcaattcatttaagatatttgtcgaatacctaggtctgaatacccacagcttatctgcctgcagttctttgaagaaaaaagtgttccataaaaaaagaaaagcagctagtttatctcacaattcaaataactgcaagtgtttttcttagagacaaccactggacttcccattttgcctcactgaaagatgtctatttaagggctattaataaaataatgtttcagattcaaggacattaaaaaaaaagtcttttttctttttaaaagaaacagtgagtgcataatggtaaagaaatacaataatcactagtacagtatagtatcactgccttgattagcgataaggaaccagtaagtttgagcaacccttgggtttgcaccagtgctaaatgtcaacaaagtgataagaatcagtattaacagtatttgccatgaaaatagttgtgacctggctcggcgcagtggctcacacctgtaactccagcactttgggaggccgaggtgggtggatcatgaggtcaggagctcaagaccagcctggccaagatggtgaaagcctgtctctactaaaaatacaaaaattagctgggcatggtggtgtgtgcctataatcccagctactcgggaggctgagacagaagaatcacttgaacctgggaggtggatgttgcagtgagccgagattgtgccactgcactccagcctgggtaacagagtgagcctccgtctcaaaaaaaaaaaaggaagaaaatagttgtgactttttgtgatgtaatagacacctccccaaaggactcccagtggtcggcatatcacttttaacaactgatttaaagtaacctctgctatgttgtacaccttaaatatatattttttttgccaatcgtacctcaataaagctggaaaaataaaatgaaaagaatctgtgctaaatacctctccatacctagctctaatgctatgttctccctaaagctaattattcaaagctattcagcttcatctacattgtctgtacagatagtgtgtagtgtagagctttttaactgaagagaaaaaagggaaatatcctaatttctgtcaataaaggactaacggccaggtgtggtggcttatacctttaatcacaatcactttggaaggctgagctgggaggattgctggaggccaggagttagtgaccagcctaagcaatatagcaagaccccatctctactaaaaataatttaaaaacttagcctagcgtggccaggcgcggtggctaacgcctgtaatcccagcactttgggaggccgaggtgggtggatcacttgaggtcaggagttcaaaaccagcttggccatcatgttgaaaccccatctctactaaaaatacaaaaaatgaggtgggcatggtggtgcacacctgtaatcccagctacttggcaggcttgaggcaggagactcacttgaaccctggaggcggaggttgcagtgagctgagatcgtgccaaagcactccagcctgggcaacaaagctagactcgtctcaaaaaaaaaaaaaaaaaaaaaaaaaaaaattagcctagtgtagtgtgcacttgcactcccagctactccaaaggctgagatgggaggatcacttgagcacaggatgtcatggctgcagtgagtgcaccactgcactccagcatgggggacagagggagaccctatcttttttttttttttttaaaaggagggtctggctaagtaagttgctacatacccaaataatagaatactatacagacattaagagtgaggaggtacgggctggttgtggtggctcacgcctgtaatcccacactttaggaggccaaggtgggtggatcacctgaggtcaggagttcgagaccagcctggctaacatggcgaaactccgtctctactaaaaatacaaaaattagctgggtgtggtggcaggcgcctgtaatcccagctactcaggagactgagacagaagaatcacttgaacccaggaggcagaggttgtgccatctgcactccaacctgggcgatagggcgagactgtctccaaaaaacaaaagagtaaggaggtacctgtcaaaatgaaacataagatatacatcaaagtgtgtagttttgtacaatttaccaaactaagtatatgatccttattcttcaaggacagaattgtttactttgcacataaattcccaggatacacaaaggactaacagagattacctccaagaaggcaggatgaggttacagcagctttattttttccttctacatgctatgctcttaacacctaaattcttaggagcaagtacaatttaaaataaagattaccagcctgggtgacaccccgtctctactgggaaaaaaaaaaaaattggatgtggtggcacacgactgtaatcccagctactcgggaggctgagccaggagaattgcttgaatgaacccgggaggcagaggttgcagtgagccgacattgtgccactgcactccaatgagttagactccatctcaaataaaacaaacaattatggttttgcacctttaacttttcacacacatatatactcttaacctactcataggctctaataaaggcacgttctacacattttaagcactcaaaaatattaaactccctgactgaataatatacgcataactgtaatagcttcatttaaataaaacattttaaaactatcttggaggatattttaatagctcaacatcctaaaaactatttttcagaaagtcttcatcatcaagagtgtattaccttaccaaattcctaaatagttaagacaaaacctgatagaaattcaggttgacactacattcaataatgaatattctgctgtaagagacacaacaatgttctacttctctgaaaacctaagagattgctcatttaaaatatgtgagtgctgaactaaacacatatattcagaaacagcagcaaaggggcaggctaagcacctcctaatatggataagctccaggtttctatgtaatgaacaaagaagaacctaagaaaaatcctgcagagagaactggaagagagtgtgaggttgcaaggcagagtaaacttgttaagaagtcaagggtcctagattatggtactaattctactaactaagaggcaagacaggcatttcaaatacaaaactatgaccagcctcctcctcaccttaatcttcttgtgtttcactacagcattaatttcaaaatctcccttccaatgccaggaaatctcctctaacataatgaatttcccaccccaccactatcccttacatttctttaaattcaagatcactttttttcttaaaaagtaatcagagaatttataaactaagggtccttagaccaaaccccaaaattatgaacaagaactcaatcattaagtatttgtacattcacctcagtcctgaagaatagccaacctgccactatacactcaaaccaccgtgctatgtgctgagatttgggcttgccaactagaacacaagaagccaactaatgaaaataaattcgaaaaaaaattacaagttacagagctgggatcctattttcccctttgaagaagcaacctattcagtataaacagaggcagcttatttaaaaagcactttggcaaaataatttagtttgtaacctttgacaaagtaatcataatcttaaggcatataccttaaaaaagattcaatgggtattttgcaccatggggtgtgttttcagaagtcctaacagcataatgcactatctaaatataattggttaagtaacaggacaacaccacatgcctcctaatataatgcagtgaggaggacaccatatcacttccaggagttctcaccaaaaactggcaacctaaatttaatcatgaagaatcaccagacaggccgggcacggtggctcactccttgggaggctaaggcggccaaatcacttgaggtcaggagtttgagatcagcctggccaacatggtgaaaccccacctctactaaaaacacaaaaattagccaggcatggtggcgggtgcctgtaattccagctactggggaggctgaggcaggtgaatcgcttgaacctgggaggcagaggttgcaaagtgagccaggatagctcgccactgaagtccagcctgggggacagagtgagactccatctcaaaacaaacaaacaaacaaaaaggatcaccagacaaatcgaaactgagagacattctacaaaataaccagccagtactcttgaaaaaagttccaaaatcattagaggcaaagactaaaacaagactgatccacattaaaggagagtaaggagacatgtaagcaaaatgcaaagtgtaattctggatggaattctggagcagaaacaggaaattacagtaaaacaatttgctaaatttaattaagattataggttacataatagtttatcatttactttaatcattttcctgattttaataattatactgtagttattaacatgtggacaatctggcaaaatatatgaaaaactcttcatatttttccaacctctttctaaatctgaaattatttcaaaatgaaaagttaatacattttaaagaagtcccttttaattgtctttatttctgaaagataccctttttcataccctttatatgctttttttttttcaaatttccttatgtggctgatactacttttgtatttaacacagaaatggtacaaaaacaatgatacatttgtaaagaaaaatatgtggggtggagagaaagttctcatcttgtcttaaaacagtatttcaccaactggtcctaatattaaatttaattcgcacaaagataattagacatcgagtgtcattagcaaatagcaaatccccccagaatatcaaagcaaaacaatcaacctctattgagacatttatgaattgaaatttgcgaatacagctgggctaactttgacatgacctcaccaaatatgtgagtgggagaaagatcaagcctccataacccattcttctgttttagattgtactgtcatggctctcttccaaaacaacaaatgaagagagagacattaggacacagacatgcctgctttcatacaaagcatacacacaccagaagttaaaaggttgaggtagcaagtaactgaggcataagagccctcaaaagtgattctcagtaagtacagcaccctaattatagtctgaaacaaaaatcggccgggtgcagtgactcatgccggtaatcccagcactttgggaggccgaggcaggaggatgacctgaggtcaggagttcgagaccagcctgaccaacatggagaaatcccatctctactaaaaatacagaattagctgggcgtggtggcgcatgcctgtaatcccagctatccaggaagctgaggcgggagaatcacttgaacccgggaggcagaggttgcggtgagccaagatcatgccattgtactccagcctgggcaacaagagtcaaactccatctcaaacaacaaaaaaaccccactgttttcaataaaattaaagccacttattttgttattctgacaactcctcatccccccctacaaacccagtatcttgatagcagattaaatgtcatgtttcaatctacaataagatgatactacattaagagactacaaatattaatgcttactgtatgacctcatgtaaatagctgaacccctgagctgcagtgtcttgatctgttaaaataaaaaggctagatcagatgtccctttaaccctaaaattcaatgactcaatgaaatttctgtatacttaaacatatttctacaaatctataaattatgtaaaactcccagtttatattattcaatttaaaaactcacaaaaataccccacaaatgtcattttaataacatcctcattaatagatttaattccaactcttcagcatagtgtagttcaaatttctggtcttgtacaattctcttatgcagagataattttcctataatttttattctgtagagacactgggccttgtataaatcctagatctcttaaaattttaaaaagaaatcatgcaagaagcccataatctgtcacacattaggggcccatagatttaatctcttactcccccttgtggccggagtggcttccattctttgatttgcaatttcctcacttgctttcaaccaattagaaaagtgctccaccagaaatgctaatgattaggaggtgtcaagaactaatttattaagtcttttagacattttgactttaaattattacctttctatgcaatgtggcctaacagaataagattttaagctgtgaacatatgttctataaataaggtcatctataagcaggcttgtgcctaatcacttaacgcattttccattaatagatggcaaatctgcacttttaatcaacaagaaatctggcaaagcaagatgttcctgatgttcaagaactgttaaagccagcctaaaactttattaatataattcctgttaaaagagtagctgctccctgatatttaccccaaaacaaaagatacctacactaaacaatgctgatagaaagccccatctgttctgttctaaaactttttttttttaatcaactgggtgaaagggctagcaggaagtgagaataaaaactgccaaattaaatcaggttcagagaattgtctccctccgaatcatgaatgctagcaaaataatcctagaaggaatcagtgttttaagaacatctaacgctgggcacggtggctcacacctgtaatcaatcccactttggaggccgaggcgggtggatcatctgaggtcaggagttcaagaccagccttaccaacatggagaaaccccatctctactaaaatacaaaaatcagctgggcgtggtggtgcatgcctgtaatcccagctactcaggaggccgaggcaggagaatcgcttgaacccaggagacggaggatgtggtgagccaagatcacgccattgcactccagcctgggcaacaagagtgaaactccatctcaaaaaaaataaaaataaaaaaaggaacatctgaaaacaaattttgaaatgttgttcctaaagattaaaagtgaaatactaggccaggtgcagtggctcatgcctgtaatctcagcactttgggaggccgaggcaggcggatcacgaggttaggagatcgagaccaacctggctaacctggtgaaacctcatctctactaaaaaatacaaaagaattagccgggcgtggtggcggccacctgtagtcccagctactagggaggctgagacaggagaatggtgtgaacctggaaggcggagcttgcagtgagccgagatcgcgccactgcactccagcctgggggacagagcgagactccgcgccactgcactccagcctgggggacagagcgagactccgtctcaaaaaaaaaaaaaaaaagtgaaacactaacaagtatcaaaaagaacttatatcaaaaagaacttaatgagtagttaagtataaacttaaaaattattgacactcactgaaggcgttcctcttctcccctcccccaggatctaggcctgcgctgaagtttctcacaaaccaaggcccaatttaccagtatttccctcacgatgctttttgttgttggtggtggtggtagttaaaacgcctcatttttcatagggctttttagcttgtaagtggcacgctatgtattatggataaactacatgggggactatattttatcagcccctttttaaaaaaggctaaagaccagcttttctatgttcaatgaatttgcagtacttttccctctttgacttgtattatttgtgcacgtctatttccctctccagactgaagagcaggggcttttacatttatttttgtaatagcccagggcttataaaatagcaagttgtcaaatattaaataaaaaatttcagctttctaaagttctcttaaatttaatccaaaatttataaatgaaaccacaataaagtgatatcacagaggtacaaaaggtaaagcagtgtatttgctatttaacaccaccacaggggtgtgttaattcaacaatttcctcaaaacatcctagaggtagatagtattattcccattttgaagatgtggaaacagagtcacagacaaatgcagtaaaacttgccccaaatcacacaatgaatcaaaaattcaaaaagactgcatggctcatgctaagttttatcacctctcttaaagtaaggtagtatacactttagtatcctttatttttagaaatgttacacagggatatgcttaaagttttatctctgctccaattaaagaaaaagagcctgatgctagtcctccattagatggcaacaatcaaagggcaactgggaaggaaaagtcgttactcttacaaaaagcagattgcttgagttgtcttatttctaaacatcttcctaacacaatgctaaaggactcatcaaattgttgaattgagaacttgcctgttctaggcaagaactacagcttgcctatataatactaccttcaactgtcaattccacagaatcacattttaagtaggtattttgcataatattttcatcaagtgtctcttggttgaatgtggtccaagtatgtcattctaaactggacaatgtttattacgtttaaggagcaaaaaaattataagctgagtgttcataagtcttggatcaacaaataggtctgtctcagaaaagcgtttgtaattaatcacttagatgagaaacattccgcataccagtgggttccttggtataacgctaatttttaaaaactctagatcccaaaaattgtttgcaagttagaaattaactgccactaaaaaacatttctaggccgggtatggtggctcacgactgtaatcccagcactttgggaggccggggtgggtggatcacctgaggtcaggagttcaagaccagcccggccaacatggcgaaaccccgtctctactaaaaatacaaaaattagccaggcatggtggtgggcgcctgtagtcccagctacctgggaggctgaggagggagaatcgcttgaacccggaaggtggaggctgcagtgaggcgagattgtgccactgcactccagcctggacgacaaggtgagactgctatctcagaaaaaaacaaaacaaaaaacgacaaaaaaaaaaaaaaacatctctaacttcccaactcattaaacgattaaaataaaatactaatacaacaaaaattgggcagtccctgcaaatttaatgcaataatccttcttagattttaaaattcaacacatgcatacaggccaacccattaagcaaatcttatgttggtccgcttaactttatagattaatacttggctgaaactatccttatattcttttacctgttgttaccactgtaagcacatttttatttggggaaggaaggctcacaacaaatcctgtcaaaagaaatccacaagagcttacatgctgaaactttttaataacctatccaatgtaaacaaaagggcaggtgtcacacaaaatgatcttactgatatcaagtcagctatattcatccacatggctttggtgcctgaatggcaatagaaaaaaaaactagtgaaatctgccaatatgtaaaactctatcctacactacactactacttctatcacattataccttaccagaaaacaaaactaaatcaatgacaactgctattgcacagtaactttcacatatacaagcttttcataattaaatggaattactgactagagaacaagtgaatgatcggttacatagaaatacacataataaaaaagagagaactgctgatacgaccgttcttcccacaccaaaatttacatttgtgccatctaaatatcaaagcatatactccttcagtgtactttacaaatacacaaatgttttcaaggagaaaagaacagagccaatcttctgatgctgaaagacagataatcaagattaaaataagtcctaaatcgagtaatgaagcagaaaccctcaggccataaagatggtaattagcaacagtttgtatcagggatagtgagacgaccaaactaaagctaaaagcctcttgcagggaattctggcaaggatcaagcaaatagatggaatgaaatcagcattttagaaagattagaataagaaatacatgcaacatagaactgaaaaaggaaaaataagagtaacaagtccaagtgaatgaccacaagcagcagtaaaaagatgtttataatttagcttttgtccattaaaagcacatcaagtttatccatacagtatcattttcctatttggcaatgtgcacttttctgagtataatcctgggaactatacaattcagcgtgaatgtaaaggatagggaaccaatgatatgggaaacatcaacagcttgtaatctgaaaattaagtcaaagttgagtccaacatgtcgtgtgattaagtctagaaaacatgctaaaattgggtagttataaagaacaggcagtttcaaaaggaaaaggaatgctggctttgagtatattgaaactgacagcagttctaagtcccctaaaaccttgagcggtgtttattctctatgtggaactgtcaagagtaaagcaaaagctatgggaactagaatgaaatcacaatagggaaccaggaattctacaaaaaattctaagaaacttattagaatttcaataaactatatgctaacttttaaaacttacttgatatcagaacacctgtcattctgacttaaaaattctcacacacacattcaatataaatatgccaagagtaacttattttggaatcaaaaatttgagaaattaatccaaaagtccaatgacatttaattcagtattataaagacagagctagtttcccttcccatcaaacagcaaaggcctctacacctttccattccctttcctttattttcatcatttccacttcatatacctcagactttttgtatttgtacaaaatatgtcattgggtgtggcactttacattaaaaaaaactgaactttattaccaaagacactgtccaggccgggcgcggtggctcacgcctgtaatcccagcactttgggaggccgaggcaggtggatcacgaggtcaggagaccaagaccatcttggctaacacggtgaaaccccatctctactaaaaatacaatacaattagctgggtgtggtggcgggcacctgtagtcccagctactcgggaggctgaggcaggagaatggcgtgagcccggaaggcagagcttgcagtgagccgagatcgttccattgcactccagcctaggcgacagagcaagactccgtctcaaaaaaaaaaagaaaaaagaaaaaaagaaaaaaaagacactgtccaattttttccttcctgagaccacagaactgggattatttatactttgaaacataccaaaaccatgaagacatgtaaatatacagtatatcttaataaaatgaaatagtaacaatagatataaccctacagagttctttggagaagcccttattccaatgagctgtctagtgattttcatcttaaaaactgctaactctacatagcagtttttaaagcccaaggcacgtaataatatattcagactaaaacggacccaaagccgcttgctttcttatttctgtttaatggtagttctgtgggctggagataaaaatcagtgacccataaccacaacttaaaattgccctgagcaaataaaaacgtagagcagcaataaaatagaactcagtcaaattaacagaatcactattaagattactcaactgcagttgccaactgttataaatgttagacacacaattttacactgcttcctctcggagacctcctatataaagtcattctctgcctacagcagtggattttaaattttaaaatgaaacctttgaaaatttgatggttggcatggaccttctgccccacaaaaatacacaattttaaaggcttcttcaatcttcgaaattccattcatggactgtaagttaagagacccctgcactattataggcaggctcacacttttaaatagaactgaaaagctaagataaacaggacacagaaggtagtcaaggtgctttacctgactctcattccccacaaccctgtgggatgagtattattcctatttaattgagcttagttttctcagagggactgagtgatttcctcaggccatgcatctattaaatggtaaaactagtttgactcagtatcttgagctccattattcacctcgacatacttctttgagtttgaaagaggcttcctagactgtatttccttggtattcatttcatcatgtgcaagataaaaactacccaatttttggctgccatctttcaggtttaaagaggtactagtgttgagtccctccccaactaccaagagagcttttgtctaagcatctggcaggaaaggcagattgcattagttcacatattgcagtttgaaattaacacgtggaagagaagaaacccaagttcttttacataatgcaaagtccacattgtgaagagcatgccagtgaccacttcccgccataatgctctatttactcttgtaatatgcaacatggtccaagctctttgcttattaaatggttaaacaatagataaatacatataaccagaatgggttactaaagagctcttcagaaaaactcagaactttggagattagctgctttttgtaggaagaaagtttattttcatagctattataaaataggtgctcaatataaaaaatctggttatcactaatgccacaagccaatactattatttctgcaaagggacacctgcttatttttctcaaattaaaaaatatatatatcaaagcccagaaaaggctggagtaataaaaaattataattgattttttatcatgtaagatcttaaaaatataatttaaaatatttttactaatcattaataatgattcaataactttttctagtagaaatatcagttctgctacattttattcttccatctcacagaaagggcagaaggaattttatgcaatatgtttccagagtcgatgtgacctatttgaaaaagatggtaggaaaaagaagcctattatcggtaaatatcaaattttcccaagcagaaaaagaaaaagctagggaaattttgcagtgctgctgacctaattctatgctctttctctaaagaagcctttctgcttgtttaacaaatatttgagcatctattacacgttgagtatgcaaagatcactaagtcttactcctgaaaagaccaaggctggaagcaaaagcttgtttagaattctcttcaaagccatttgtatagtaaagaaattaaactctcatttatccaaactttcaaagtgtaaataccattaaaactttttgggaagccagtgctattctggagggtaacgatgtgggtagggaccagagtgaacttccttaataatcataacaagaagaaactatttatatgaagagattatcttgttatcctcatctactggttctatgcaaacaaagtttcttcataaggaaactaaagggaagcatagtcaaaactgctacaagttgggctggacgtggtggctcactcctgtaatcccagcactttgggaggccaaggcgagtggatcacctgaggtcaagagttagacgtgacctggtcaccagcctggccgacaaggtgaaaccccatctttactaaaagtacaaaaattagctgggcgtgctggtgcacgcccagtaatcccagctactcgggaggtcaaggcagaagaattgcttgaacacgggaggcggaagttgcagtgagctgagatggtgccattgcactccagcctgggtgacaagagcaaaactcagtctcaaaacaaacaaacaaacaaacatacacaaaaaacaaacctgctacaagtcttttccttggaaaagactcacaatgacaggaacttttatactttgtatatggaaaacatgcacatacctacctggtattgcaaataagcgtgttagtaaaaggtaaatgttacattcctttttattcctaaaattgacttttgtcttaagggaaatgttaatgtgtaacacaccctttgaagccaaaataaaaacttttcgatcaggtgtaataattgggaaaaacactccagactgaacaaaactgaattacacatacacagatattagttagtaaggtgagcaaaaaaaaaaaacaaaaaaaacaaaaaaacccaatacattttttattatagaaaaaaaaaatcacattttcaaaatttaaatatttggccgggcgcggtggctcaagcctgtaatcccagcactttgggaggctgaggagggcggatcacgaggtcaggagatcgagaccatcctggctaacatggtgaaaccccgtctctactaaaaatacaaaaaaattagccgggcgcagtggcaggcgcctgtagtctcagctattcgggaggctgaggcaggagaatggcgtgaacccgggaggcggagcttgcagtgagccgagatcgcgccactgcactccagcctgggcaacagagcaagactccgtctcaaaaaaaaaaaaaaacaaaaaacaaaatttaaatattcttattaccttagcaaaatcacaaaacagacatttgtcacttggccccaataaaagcaagatattccttttttcaacttagatacaaatagtagctatcattctaaaggtttcaataagcaaagaacaaaaaaatgccccaagacagatgcctcattgagtttgtggctgtgaacccaaataagcatgtttaaaaaatcactattctttaaaaagacagtgtcaagtaagtatcatttgagaaaattacagtttaggaactgatgctattccattagtaaatacaaatgtaaagaaatgatagtatcatcacaactttaacaaaaaccccaaacccacaaccacatcagacattatcctattgctcattatagcacttcttccataaacaaggttcatatagtaagtaacaaacctggatttccatactgagttccagattcagtaatctgtccagaaaaatcgagatgctgcccctctttgtatatcagagcccttccatactggttaagtgtaaccatttagtaaaaccactttaaatattattccaaaaactgccagcttggttggattctctactggtttatcctcaaatttaaactattcttgatcaaaaagccctactttatatgacagattaaaattaaccaaaatgtagtttaattcttttaagcgcagtgcttcaacacagtaagtactgaatacttaaaatactcgattcaaactggaaaatcaagcttgagttgttcataacctttcatcatggttgtgagtgttcaaaatttaccttcaagaattcaatgcaggaagaggtttcatagttgtgacgccagagttttctgcatggttgactcattacattaacattatagcggctaatcctgagaagagtactatttctacaatgagtatcctattacatctctcttacctaaagtatgtaaaattcctttatccacagatgtacatttaagataaccagctatagagctactacaaatattctaaccataagtaaaacagtaacacaattagtttatattttcaattaatataaaatacaatactaaagtctgttatttttaacaaaactgaactgtttcataatcattgttgcaattattttacatacacgtatctataattgtcttaacatctttttagtcatgacaccatgaagacttttaaatttggaacacacaatgtttagaaggaaaagaaaaaccaaacaaaaagttaagagtaatgtaactgatactcatagggaccctacagtataatgaagccagactgaattgattctcaccagtacatcattgcagatatctcttagctccgtctcaattttctctctgtattctcgagccatctgctgttttttctcagcaccttccgtcttttgttcaatacttgagacgaccctccaagatgacctacgggctcctacaacatttttataagcaactgagagaagattcctctcctcattggataattcagctccttgctcagttacagacttcatgcaggctgccatgtcatcatatcgctcagcctgctcggccagtttggccttctgaaccagctcatttttatccatgactggatgttctgcaggggggaaaaaaggagtatttaaaatttttcccatcaaaataaacagactcaaaattatacctgtggtaaatgagttttttaaacctgaaacctaactgcctgtgaaagactgttcacatgaggaattaaaatgcagcctcacaaaaggatagtcaaaaaagggaaaaaaatttagcatactcagcatcagaggtaaacttacagccattaacacatcagtgtagcaaaacttaaaatttgttcagaagacccaaatttcacatgtcaaaattacttccaaaagctgcctcaaaaactacccctaatcttacctgatcaaaatctcaactcatttccaataccactaagtgatccaaaattaagcagcttttcttcctttagtaaaagcattgtttacagagaacatctggatttctatcatatttccagaatcataattcatatcagtttaatgtaactcacgtctttttactttcataatactcttgtcaagagtgattacattttagctttagtgttacccctaccccaaacctactagatctctgcaacaactgccagccaataatagcataacaatttgggggggaatgaccaactgtttgttttcagatattttgagtataaatccaccacaaaggatcaatatctgaccctaatgtctcaactctttatcttgttatatgtccacatgctttaaaaatatccgcaagtcatgacacttcaactcttactgtgagtactagaatatatcacattggaagtacttaatttataagtgtttccaatgtcatcgctccagttgaaatgcagaagtgctgcattttgcttctagccatcataatgtaattggatgttaccactcaagctgtcctttaccatgactacccatctaattctctttccctcgcattttagtttcctggaccttttcgatttacctcagctacatttttctggaaagatacccttttgcaagttgccgaacagcacaaagatactaatccacacagtgacaccacagaataaatgacttcagaggaaaatacacaccctgaatgaagtgcacttttaagttagaaggtgaacagaagagtccaccttggcagctggctcccgaatattaatcatcttttaccttcccagggaaatcccacaatatttttttaaccaaatgagagaacaggtcgccacattttaaacaaataattaaccactttggatgcaaggtactggctcaatacgtaaactatttaacctttatgacggcattattttcgtcaggtctctaaattactgatttttcccttaggatctcagaaacgctctctggttatttctgcttctaacaaaaaatgatttaagccagtacaaaggattctctccccaatcacttcggtacaagaggaagtggataaggtttctcacacagtaacgagtgctccaaggcctcgcctctacactgcgggcaggactcaccgcacccatttaacccttacctgacttgagacgtcggttactgtgaaacgaaaacgggcagacccggactttaaagtgcaaattctccggtccgcgtatcgcaaccacccccctccaggctccgcccaagtcggagccacggctcaagtccccgactctcctcctttgtcatggcggatctgtgtc

SEQ ID NO: 2172 - DNA, 34820 bp, Homo sapiens
  source 1..34820: mol_type = genomic DNA
tctccattgcacttttatttgaatgtaatatttgggacaattattcaaaagggccaatatttcccaatttaatctgaggtcataataaaacaagcaacaaaacagtgtttgggatttcagtttctcacccttatcatcaagactcactgcctcccatcatcaatatttattgagcatttacagtgtactaggcacaatagaacatacagaaaacattgtccctgctcttgaggagcttacattctaaaagaaaaaatacaccttttttaaaatggcatttttgtttggtgttttctgcaaagtactgaggaaatattttgtaaagtgagctttgggtataacttagccccatcattatttagagaatagaggaggaagaaagaggaaggattttaaaggcagacaatgacagaccattcaggataggtagggttttaaagggagataaacacagtctcatcaactaaggagagatttgctgcagtaaataggatgagggaaatagtctgtgggatgcaagcaaaggaagcagggtgccttagacactgagtggagccagaaagatcatgcggcctttttccaagtacatggccaccaagtaagaatggttggtgacaagacagaaggctaaaacaggaaggtaatcttgtgcacctgacaaatagaaagaataaaggatcaaaattgaaggcaggctataagagtatcaagaaattcttaaaaaccaaaaagtgatttggaagcacaaaacttacagttaatgctacccaatgtcatgatgggccaagaacattgtggcttcctaagttagaaaatgccatatgccaaaattttaaatggaacacactacatttttttctaatcaatccccccctctcccagaaaaaataggaactcatttttttcagggtggggaggaagagaggggatcatgggacatggaaacagtagttatattagtagtatttttgttatgataaattttgtgtttaaacttggtaagagcccattagctgccaagagggaataaggaataaatttcaaaaaatgtacaatttcctttagagaagtttcagaaccaagactaatttacatgaaaagctgtagagaaagtagttgaaaagtccattcataaaacttttattccacttacatgaatttaatacacgtgttcttaacaattatgcttggattgttcatgaaaatttcataagacattaaacaaagctagccatcatctcaagttatttccctgttaactatttttacagcacatgcatgttaggcaagtatcaaaaaaaaaaaaatcacaaaagcaaaaatcctaaaaaaaagttaaatacatgggtttttgttttactgctgtgcttgatatacatgaagtaatgaataccaagcaattcatttttcctgcatctttacttttacatttgttcttaggttgcctaaaacatttaaatacaaataaaatgagtgtagcaaaaataatgaaagctaacagcaggtaactttacaaataatggaatgtgaaccgtttctgcccttatccagagtaaaatgggtcacaactttgtctaaaggaacacttctgcagctgtagtcaaaggtgtacacattgagtattccacagatatacatggtttaatatgtggtatccatggggtatgattctaccacagccttgtaagtgctccaaaccttaaagtacccacaattactacacctgtgactggaaccaatgatcccttttattccccgccaggacaaaccagtatgtaggcagttttctttgcttagacatggaagcagttttacactggcccttttgaagccacaatgtaccaaaagtactatgccaaacacttataacttgtataaaaattccacatccccatattggccacctcaagatgaaaacagataactccctaaatgttaactggctctactcccctaatattaaacataaaaaccacatgggaaatatagaaattcaaatagaagtaacataaacctgtcataaatcgtaaacaaaaaactatttgtgggacagcatggatgacaaatggtctactgtgtaaattttagaatgaggcagacaaaagttggaaggccggttaattttcccctccttctcctgcttcagcttcgtctccttgggtatccgatgtccacaactggtaaaagaaggaaagatttttcagcaagtttcagtgggatgggggggggggggcgttttcatataagtgccaagatacctgaatgttttagttggaaagcattcttaaaaagatagcagcatcacttagcttcaagatacaaaaacatctcaatatacaaatttactttttttgtaaccactatataagcaggttaagtacaccacagagttgccttcaaataaccttcagatacaggaaagttttggttatccacagaaggtgaagagaaattacaagaaataatactttttttttgagatggagtctcgctctgtcaccaggctggagtgcagtggcgtgatcttggctcaatgaaccctccgcctcccaggttcaagcgattctcctgcctcagcctcctgagtagctgggactacaggcatgtgccaccacacccatctaatttttgtatttttaggagagacggggtttcactatgttggccaagatggtcttgatctgatctcgtgatccacccacctcggcctcccaaagtggtgagattacaggtgtgagccactgtgcccaggccctaaattattttttaaaaactaagcatcaataggtgtcagaacctaaagagccccaatatgaaagatggacgtccaaggtgagtgcaactataccagaagcatctaatttggcccatgctgaaggagctagggttgactactctccactggtagatcttaaagtgactcacactccaaacagaatcctatactccatgaaattcaagaaccagcctcaactctgagctaaactacaaatctagcttttctaacactttaagcttagaaaaacaaacctttatttatcaggttggtgcaaaagtaatcgcagctcttgccattactttaaatggcaaaaccctcaattacttttgcactaccctatcatatgattcaaaataaatgctggacaaaaaccagaaccaaatcttttaacaggtaaaaatgaaagttgtcccataggtggcagggttatgaactctattccacctgctccaatgttaaaaatgttgaagtcttaaccactctctagtgattttcagaggtaattacaaaaggattcaagacaatcttaaattttatatatgacttacacatgaaaacggaggggaaggggaaaatacactaattattatttttatattccccaaatcatccattagcttcatttatctactaagcaaatatatctctggcctggaaaggagactacttccaaggtcatacagatagccaaatgacctcttggaaactgtgtgctcctcctgtcaaacaaggggttttgtaattgcaagatgaaattgtttctaatgtctctttcctgttctaactttcaaggattcttgaattttctgtataaacatgcaaatttgatacaaaatatttctttttctagagtaatgtgttgacagtcttggtcaaccaaattcagaatgaaatattaagttttgggataatttcttttcttgacagataaatgttccaatcaacctataatggtgacagctgacactaataaggctcagagaagacatacaagtagtgacagaattagaatcaaaaccctggttttttcttttctttttttttttttttgagacagagtctcgctcttttgcccaggctggagtgtagcggtgtgatctcagctcactgcaacctctgcctcccgggttcaagcaattctcttcctcagcctcccgagtagctgggattacaggtgcccaccactatgcccagctaatttttgtatttttagtagagatggggtttcaccatcttggccaagctgttcctgaactcctgacctggtgatccgcccgcctcggcctcccaaagtgctgggattacaggcgtgagccaccacgcccggccaaccctggttttcttattgcaatatgcgctcttcatgctatactgatagcaaaattcagttggaagcagacagtagatcagggcctctcaaaaagtgatgtgaacaaaacacagtatctaggtctcaggtcatcactttaaaaatgtcatcacttcaaactagaaaagaaaaatccttaatactaaagttagttaacaaagtgcttcttatgtttgatatataagattctttcattctttactgtggcttgttatcttgactcaagtatcagaaaagtttatagatagctccaaattgtgctaataaagtaattttaggtttaataaacaagtatacaatactattcaaaaaactcttcaagattttcagcactagcatatagaactggtttatagaaaatggcagtggactagaataaagttggaagagaaatgtataaaatgagattacatagtccccaagagaaatggccctagaagtctaacaaaaaaacagtaatacctagattatgatctgcaattcctacctctttacctgacacacagcaaatgcttgataattttttcacctaagcctcaaaatttcaaatctagtatttatctgaaggagaagaatgagaagacctaagaaacaaacgagacatacaaatcaactgcattgtggactgaatttgaatcccaattcaaataacttaaaaaaagagagataattggaattcaagtattatttagatattcaaacattattagggaattatgttgatgttcctggtgtgatagtgacactgtttctttttatacatctgcagtatcccaaggacaatcacgacctttcatattaagtcatttaaaataagaagctaggcaaaatagacttccacttggattctgtagatacctgagattttgtaactcaagttattaattccctaccattatctttaccaatatggaggcaacttgatgggcaagaaaatcattcttaaaggaactaaaacatgtagagtctcagcacacttttgatactaacaaattttaacaagacaggtaactcatcaatgtgtgtattttttagttctcagtctaatatttcagtttctgtaattttccttcataggactttaatagtagctgagatatatttatgagagcctatgaaatgtgttgagaaaaaattttaaaagatgtatttaataaaaaaaaaaattccctagagtaaaacataacctcttcaaccacattcatcactaatgatgctgttatgtacttactgtcaagttgtctctcagtaattgcattattagcgtgctgtctttgtatgactcttcacttaatgtatcaagttcagcaatggcttcatcaaaagcctacgatttaaaaatagtacattacatttcagtgctcaaataataaagactgctaaatttctacgtaacaggtaaaatacatactgtctttgcaagagagcaggctttctctggggagttcagaatctcataatagaacacagagaagttaagggccagacccagtctgataggatgtgttggttgcatttcctttttgctgatttcaaaagcttcttggtatgcttgttgtgactgatcgacaatccctggataagacacaccaaaacgtactgagataaagtgtgcattatatcttcacccctcaaaccaaacctttaatatctcacatatcctttgaaatactaacctgtaacagcttaatatttgttaattgaacaaggtccttttttttttttaaagggagctttctcctggtacacactagccattgatcaatgtcaagataaaacaactttataatctcattattgttatgtttttaaaaaattgacgagttttgacatcccagacccaagcaatcctcccacctcagcctccagattagctgggaccaaaggcttgcaccaccatgcccagctaattttcaaaatattttttgtagagagagatgttgctcaggctggtcacttttcttaaaatcttgaaaaaacatccctgtacacaatattggcttttcagaaagcatttattttagaatagcagtatgaggcagtagatgtgtattctcagaacacaaagagcactgctactccttattcggcactctaagcaattcaaaacaagacattatgtacgcttcagagactcttcctcactatgttatcttatacaagttcaaccaacaggtttaaaaacagcatacctttcttgtcatcaccagcggcaacctcagccaagtaacggtagtaatctcctttcattttcaaatagaagactttgctctctgcttgtgaagcattggggatcaagaacttttccaaaagagacttaagaagaaaagaaacagacatagtgagaataaaacatttacaaaactgaaagaacttgcatttcttaaagaacaaactatagcctaagttataaaacttaaacacccagtcactgtcaatacaattgtgaatgcagctggcacatgaatttgtggtttaaagcagaatgctttgggcagcaatattttaagtttgaagttagtgttcagtttattatttgaggacaataaaattgaacattggtccctgacaatgttatctatttacatgctgacttcatgaatgtggggcatgaccgttcacatttaggaacattttctaatgagctggcaagctttccatctgaagtttcatgtggtcatgacatgaaaatagaaagaacatacgggatgaaccttttgggactctggagaaatgactaaagcagaaaccaataatgtaagacacttaaggagtccatgccagagaaggaggaacaaaataaacttcatttataacaacacaattcaagcaaacctcacaacagataaaaaaaccgttcaaaagttttatttttcctaaagacagtggtaggagacttacagattttaaagagcagacctttaatctcattgaagtcattttcggctagtaagatacacgattacagatcatcccagacaacagataaaattaaaacatcatcctataaaattctgtctaaaactactattacaatctgagtcatttgattaggattttaaaaattacactctttaactgattttaaagcaaaaagattagatcattgtgttggggatgggaagaagtctcaataaatgtgtaatttttttctttccagttaagggggagaaaaataattctagtagtagaattaggtaaacattaaagcaaaaaaaccccaaccacccattctcactaccccacttcctttaaagttcaagtacactctgagaatcaaggtgaagtcaattttcagctgagctaaattccaaatccattcttacaaaaaaaaagtattagtttatatagcacctacttatatataaaatataaatttgaaaaatgcttttaaatggtaactccaactttttgtttacccattatgttccaatgctgggtaggtgaacagttttaacccaacttcttcccccaattttttttttttttttttttacaactcaagctacagataacccagatgaagtggcagtagggccagattgcactgtgctatataaagaggttaaaggtgagaaaagtcaacctgaaatgatgtttcctgcaattattaaccgatatttaaaaatactggcctgaggccgggcacagtggctcatgccagtaatcccagcactctgggaggctagggtggcaggatcacttgaggtgagcctcgtcaacatggtgaaaccctgtctctactaaaaatacaaaaattagccaggcgtggtgacgggcgcctgtaatcccagctgaggcaggagaactgcttgagcccgagagatagaggctgcagtgagccgaggttgcaccactgcactgcagcctggatgacagagcaagactccatctcaaaataaataaaaataaaataaaattactggccggaaatcagaagaacgttttggttaggatagcaacctctgtcttacaccacattcatactttcatattcaaagttctcttagctgcaaaagtgttttgtcctttgaatacaatgctttttaccacctatggttgctctgtggagatctgcctcaaacagtggaagacacttgcatttaaaatagtcaagtgagtctttccacttaaaaacaatggttttaagaaacaaatgaccaggattttcaaaagtttcattgttacacaaattgtattattcattcaactatgggagatggtataaacataagtggctttggggtgagtctggttttgaattacagcactatacaccgtgtgaactacttaatctcaatgattcagttatctcacctgtaaggcagagacctctaagattattgagaaaaaatacaggtaagcacttaggagtaagcacttaaaattttatttctattatcacaataacaccagacaccatgctagaagctggaagcacaatattctggtaattcataatctagctgtagagacaaggctatcattccttccattacaatacactttacaagaattgcagggcacggtggctcactcctgtaatcccaacactttgggaggctgaggtgggaggatcacttcttgagtccaggagtttgagaccaccccggtgaacatgagatcctgcctctacaaaaaaatttaaaagttaaccaggtgtggtggcacacccctatagtcccagctacttggaaggctgagacaggaggatcatctgagtccaggagtttgaggctgcagtgatctgtaattgaattataccactgtactctaggacagggtgacagtgaggctgtctcaaaaagagtaacactgcctaatcacgtctttcacttttcggtaactttaaccccctctatgtatgcagagatgaaggccataaacacatgcagttacttaagagtgaaccagtcacttaagatgtaaaattttaaagctgtactaaaaacttaaatttttttaggaaaggtgttgataaatgctactaaaagtagtaatctatcttttgtaggtagtaactttctacctgggtaatatgctgaactaagcagttccctgggaattaaaatggcagttaagcacttctttccccaaagctgaacactgaattaaccataaaacaactttaaagctatttgttagaacccacaagtaacaggagggctgggtaaacagcagtcaggctgcttactggcctaatgatagaccaaaagaaccaaacaagtggcaagtgtttctggtgagatgctgaccataagagttgagaaaggtggctgggcatggtggctcacgcctgtaatcccaacactttgggaggctgaggtgggcggatcacgaggtcaggagatcgaggccatcctggctaacaaggtgaaaccccggtctctactacaaaaagaaaaaattagccaggtgtggtggcgggcgcctgtagtcccagctactcgggagactgaggcaggagaacagtgtgaacccgggaggcggagcttgcagtgagctgagatagtgccactgcactccagcctgggcaacagagtgagactccgtctcaaaaaaaaagagttgagaaaggcataaatggcctacttctaataaatcgtccaatgacataagctaattaagatttaaaaacccaaaaccaagcaagactggattaaagattaaatttaaaggggctaacactgtagctcaaaaaaagctaactataaaagaacattttctgccaggtgtggtggttcatgcctataatcccagcactttgggaggctgaggcgggtggatcacctgaggtcaggagttcgagaccagcctggccaacacggtaaaacctcgtctctaccaaaaatacaaaaaattagccaggcgtggtggcacacgcctggaatcccaggtactcaggaggctgaggcaggagaatcacttgaacccgggaggcagaggttgcagtgagctgagattgcgccattgcactccagcctgggcaacaagagtgaaactccgtcttaaaaagaaaaaaaaaaaaaggaacatattctcagcctcaatggggtgatatacctactagaaaggacgttattccacaatcaggaatcaaagttatggcgagtatactagaaactgtcaggataatggaaagaacaggacatgaatggctccaagagacaagaccaattaaatttagcaagagggaagatttctgttcagtatgagaaaacttatgagtggtccagtactggaacctgctcagtgaattccctcttttcacataaaggtaaaacaggaaactaaagagggtaacttaggtattttgtagaggagattcataaagaagatgtcatctgtttcttttaaaaaaattttaattgacaaaatagttgtaaatattttgggggtgcatgtgatattgatacatgcatacaatatataatgatcaaatcagagtaactgggatatccatcacctcaaacattgattttttttttttttttttgagacagtcttgctctggcacccaggctggggtgcagtggcgcaatgtcggctcactgcaacctcctcctcctgagttcaagcgtttctcctgccttggcctcctgagtagctgggattacaggcatgtgccaccatacccagctaacttttgtatctttagtaccaatggggtttcgccatgttggccaggctggtcttgaacttctgacttcaggtgatccacctgcctcagcctcccaaagtgctgggaatacaggcgtaaagccactgcacctggcctcaaacattgatcttctatttgtgttaggagcactgcaattcttctagctactttggtagaataaataaatgttaactataatttccctactgtactattgaatactagaacttatttctactatctaaccggatttttgtacacgtggtctttttcaattctaagggaagtcagagttcacagaattaatttaatggtaacataaaagaggcaattaagtatgttgctttgtcaaactgaccgaagaataacaaatccaagttttccagatttggaagccagaagataaaacccaatgtaggaagaatagaaaaaaatgaataaaagaacaaaagaaaaaggaagcagcagttacaacaaagcagaaaaaaacatggaggtgcaccaagtagagaatggaagggaggaaagggctgatagctactttcaaaatatgcaataacttcagagaatatcctgctcaacacagaaataaacctcctaaatttcgttcacctacaatagtacaatgaaagcaatcatgactgaaataaagtctgaagtaaaaaggggagggagtgggcacaccataatataaggaagtatacactaagtgtcacaatttcaaccgtatttagaacgaagtctcgctctgtcgcccaggctggagttcagtggtgtgatcttggctcactgcaacctcagcctccccggttcaagtgattcttctgcctcagtctcccgagtagccgggactgcaggcacatgccatcacacccagctaatttttgtatttttagtagagacagggtttcactgcattggccaggctagtcttgaactcctgacctcatgatccacctgcctcagcctcccaaagtgctgggattacaggtgtgagccaccgcgcccagccaactccaactgtaaaacaagggctaggttgactgaaggttcaacttgtaaaatttttcaattatcacagtaccttaagtttttaaaccaaatctaaatggttttgaggtcaaacaaaattcaagcacatcctacactcaagctaaatcaaggctaaatgttaatctgttgaatcttcctgaaatataatctcatttagaaatccacagtatttcctcagtttacttcaaaatgtggatgtaagttttacttttttccctcccattaatttttttaatttttatttagagatgaggtcttgctctgtcacacaggctggaatgcagtggccccatcatagcttgccctgctcccattaacttttaaatatgttttttcatgacagccactgtcttttaaagatatcatggccaacattttagaaaatacccaagattaatttgctgaattagagttaatgcatttatacagcattcaccctaataatattaagtgggataagaaatcatttactcagcagcaaaatgccacaagaagccggtatctaatactctttggtaaacagctcctaatccagagttaaatatgtgatatgggctctgaagagaggacactaatccttaacctaaccaacaggtaaattacatgaaatttgagattttagagataaaagagatttttctctctactgcaccgtagtataattaacctcttagattgtgaaaacacttccaagagatggggttcaaataacatttttcctcccaagccagtttccaaaagatgccttaatccaaagatagtctatatttacaatgatgttttgtctttaaaattaagtctattaaaattaaggaaccacataaattgacaggtcatctgtttctgatcccttcttggcatagactcaacctgatcccactaatatgaattttataaacactcactcctgcctgtagtcaaatattcctaatgaaaagttaatgaactgagaatctatctctagtgatatgcctttctcactggtctttcagtatgattacccctaaaccaccaaaactgctgcctgagctggtggcaagactttaacctttcgggcattcaacacttgttagaagaaaagcttgatgtaatgcaaatcgtataaactctaaaaccaggcagacttgaaattccaccctaacccattaattttgagaatttacacaatagctaatctttattttctcatctatatgaaaatccacatcaaaaggctgttatgaggtctaaatgaacatataaacaggagggcaccattcacagctcccaaccgagagtaggcattctactcactggttgctcagttatgtgaaaataaagtatggagattctgacattcaaaaatctgctttagtgctcttgtactcttaagtacatcattttggctttggtaatctaaaatttgtataactaggaaaaatggtgaagtaggatgcaaaaaagttttcattcaaaaacacaggattaagacatatcaaagaacaaaagaaaaaagaacaaaagaaaaaaagaacatttcctttagtatttattttctctttttaaacaacagacttgttaggaacacaaactatggagacagactgcttactgcctaaattcaaactctgtcaccttgacaaaactctgaaatcttcctgggtctcagattctcatctgtaaaaggcaaatattagtagtagacataatgcacaaggttgttgtaaggattaaatgaattaacatataataagcatttagcagagtctggcaaatagtaagcaacaaagaagtgctgccatccttttggaaggtgaaagtctagtgtcaaccacattagacttcaagtactgtttgtactgcagtaactgatcttaacccacccactcacccacccaaaaaccaccttagctctgaactccctcttatgtgaaataatttcctaatatttaagtaatattaccttatttctcccaaccatggtacatatatactacctctataaataggtacattttctaggaaaaaaccctaaacggtaacaatacttcaaatttatggcttaaaagtttgtctcaagacacttttacagtcataaaaaagtagaaaactaagatcatggtggtagtaattattttccaaagttctcatttttgctccaaagcttcaattttatctgtcaaaaatatcattttcccttaaagtgagaggctcaattcatttaagatatttgtcgaatacctaggtctgaatacccacagcttatctgcctgcagttctttgaagaaaaaagtgttccataaaaaaagaaaagcagctagtttatctcacaattcaaataactgcaagtgtttttcttagagacaaccactggacttcccattttgcctcactgaaagatgtctatttaagggctattaataaaataatgtttcagattcaaggacattaaaaaaaaagtcttttttctttttaaaagaaacagtgagtgcataatggtaaagaaatacaataatcactagtacagtatagtatcactgccttgattagcgataaggaaccagtaagtttgagcaacccttgggtttgcaccagtgctaaatgtcaacaaagtgataagaatcagtattaacagtatttgccatgaaaatagttgtgacctggctcggcgcagtggctcacacctgtaactccagcactttgggaggccgaggtgggtggatcatgaggtcaggagctcaagaccagcctggccaagatggtgaaagcctgtctctactaaaaatacaaaaattagctgggcatggtggtgtgtgcctataatcccagctactcgggaggctgagacagaagaatcacttgaacctgggaggtggatgttgcagtgagccgagattgtgccactgcactccagcctgggtaacagagtgagcctccgtctcaaaaaaaaaaaaggaagaaaatagttgtgactttttgtgatgtaatagacacctccccaaaggactcccagtggtcggcatatcacttttaacaactgatttaaagtaacctctgctatgttgtacaccttaaatatatattttttttgccaatcgtacctcaataaagctggaaaaataaaatgaaaagaatctgtgctaaatacctctccatacctagctctaatgctatgttctccctaaagctaattattcaaagctattcagcttcatctacattgtctgtacagatagtgtgtagtgtagagctttttaactgaagagaaaaaagggaaatatcctaatttctgtcaataaaggactaacggccaggtgtggtggcttatacctttaatcacaatcactttggaaggctgagctgggaggattgctggaggccaggagttagtgaccagcctaagcaatatagcaagaccccatctctactaaaaataatttaaaaacttagcctagcgtggccaggcgcggtggctaacgcctgtaatcccagcactttgggaggccgaggtgggtggatcacttgaggtcaggagttcaaaaccagcttggccatcatgttgaaaccccatctctactaaaaatacaaaaaatgaggtgggcatggtggtgcacacctgtaatcccagctacttggcaggcttgaggcaggagactcacttgaaccctggaggcggaggttgcagtgagctgagatcgtgccaaagcactccagcctgggcaacaaagctagactcgtctcaaaaaaaaaaaaaaaaaaaaaaaaaaaaattagcctagtgtagtgtgcacttgcactcccagctactccaaaggctgagatgggaggatcacttgagcacaggatgtcatggctgcagtgagtgcaccactgcactccagcatgggggacagagggagaccctatcttttttttttttttttaaaaggagggtctggctaagtaagttgctacatacccaaataatagaatactatacagacattaagagtgaggaggtacgggctggttgtggtggctcacgcctgtaatcccacactttaggaggccaaggtgggtggatcacctgaggtcaggagttcgagaccagcctggctaacatggcgaaactccgtctctactaaaaatacaaaaattagctgggtgtggtggcaggcgcctgtaatcccagctactcaggagactgagacagaagaatcacttgaacccaggaggcagaggttgtgccatctgcactccaacctgggcgatagggcgagactgtctccaaaaaacaaaagagtaaggaggtacctgtcaaaatgaaacataagatatacatcaaagtgtgtagttttgtacaatttaccaaactaagtatatgatccttattcttcaaggacagaattgtttactttgcacataaattcccaggatacacaaaggactaacagagattacctccaagaaggcaggatgaggttacagcagctttattttttccttctacatgctatgctcttaacacctaaattcttaggagcaagtacaatttaaaataaagattaccagcctgggtgacaccccgtctctactgggaaaaaaaaaaaaattggatgtggtggcacacgactgtaatcccagctactcgggaggctgagccaggagaattgcttgaatgaacccgggaggcagaggttgcagtgagccgacattgtgccactgcactccaatgagttagactccatctcaaataaaacaaacaattatggttttgcacctttaacttttcacacacatatatactcttaacctactcataggctctaataaaggcacgttctacacattttaagcactcaaaaatattaaactccctgactgaataatatacgcataactgtaatagcttcatttaaataaaacattttaaaactatcttggaggatattttaatagctcaacatcctaaaaactatttttcagaaagtcttcatcatcaagagtgtattaccttaccaaattcctaaatagttaagacaaaacctgatagaaattcaggttgacactacattcaataatgaatattctgctgtaagagacacaacaatgttctacttctctgaaaacctaagagattgctcatttaaaatatgtgagtgctgaactaaacacatatattcagaaacagcagcaaaggggcaggctaagcacctcctaatatggataagctccaggtttctatgtaatgaacaaagaagaacctaagaaaaatcctgcagagagaactggaagagagtgtgaggttgcaaggcagagtaaacttgttaagaagtcaagggtcctagattatggtactaattctactaactaagaggcaagacaggcatttcaaatacaaaactatgaccagcctcctcctcaccttaatcttcttgtgtttcactacagcattaatttcaaaatctcccttccaatgccaggaaatctcctctaacataatgaatttcccaccccaccactatcccttacatttctttaaattcaagatcactttttttcttaaaaagtaatcagagaatttataaactaagggtccttagaccaaaccccaaaattatgaacaagaactcaatcattaagtatttgtacattcacctcagtcctgaagaatagccaacctgccactatacactcaaaccaccgtgctatgtgctgagatttgggcttgccaactagaacacaagaagccaactaatgaaaataaattcgaaaaaaaattacaagttacagagctgggatcctattttcccctttgaagaagcaacctattcagtataaacagaggcagcttatttaaaaagcactttggcaaaataatttagtttgtaacctttgacaaagtaatcataatcttaaggcatataccttaaaaaagattcaatgggtattttgcaccatggggtgtgttttcagaagtcctaacagcataatgcactatctaaatataattggttaagtaacaggacaacaccacatgcctcctaatataatgcagtgaggaggacaccatatcacttccaggagttctcaccaaaaactggcaacctaaatttaatcatgaagaatcaccagacaggccgggcacggtggctcactccttgggaggctaaggcggccaaatcacttgaggtcaggagtttgagatcagcctggccaacatggtgaaaccccacctctactaaaaacacaaaaattagccaggcatggtggcgggtgcctgtaattccagctactggggaggctgaggcaggtgaatcgcttgaacctgggaggcagaggttgcaaagtgagccaggatagctcgccactgaagtccagcctgggggacagagtgagactccatctcaaaacaaacaaacaaacaaaaaggatcaccagacaaatcgaaactgagagacattctacaaaataaccagccagtactcttgaaaaaagttccaaaatcattagaggcaaagactaaaacaagactgatccacattaaaggagagtaaggagacatgtaagcaaaatgcaaagtgtaattctggatggaattctggagcagaaacaggaaattacagtaaaacaatttgctaaatttaattaagattataggttacataatagtttatcatttactttaatcattttcctgattttaataattatactgtagttattaacatgtggacaatctggcaaaatatatgaaaaactcttcatatttttccaacctctttctaaatctgaaattatttcaaaatgaaaagttaatacattttaaagaagtcccttttaattgtctttatttctgaaagataccctttttcataccctttatatgctttttttttttcaaatttccttatgtggctgatactacttttgtatttaacacagaaatggtacaaaaacaatgatacatttgtaaagaaaaatatgtggggtggagagaaagttctcatcttgtcttaaaacagtatttcaccaactggtcctaatattaaatttaattcgcacaaagataattagacatcgagtgtcattagcaaatagcaaatccccccagaatatcaaagcaaaacaatcaacctctattgagacatttatgaattgaaatttgcgaatacagctgggctaactttgacatgacctcaccaaatatgtgagtgggagaaagatcaagcctccataacccattcttctgttttagattgtactgtcatggctctcttccaaaacaacaaatgaagagagagacattaggacacagacatgcctgctttcatacaaagcatacacacaccagaagttaaaaggttgaggtagcaagtaactgaggcataagagccctcaaaagtgattctcagtaagtacagcaccctaattatagtctgaaacaaaaatcggccgggtgcagtgactcatgccggtaatcccagcactttgggaggccgaggcaggaggatgacctgaggtcaggagttcgagaccagcctgaccaacatggagaaatcccatctctactaaaaatacagaattagctgggcgtggtggcgcatgcctgtaatcccagctatccaggaagctgaggcgggagaatcacttgaacccgggaggcagaggttgcggtgagccaagatcatgccattgtactccagcctgggcaacaagagtcaaactccatctcaaacaacaaaaaaaccccactgttttcaataaaattaaagccacttattttgttattctgacaactcctcatccccccctacaaacccagtatcttgatagcagattaaatgtcatgtttcaatctacaataagatgatactacattaagagactacaaatattaatgcttactgtatgacctcatgtaaatagctgaacccctgagctgcagtgtcttgatctgttaaaataaaaaggctagatcagatgtccctttaaccctaaaattcaatgactcaatgaaatttctgtatacttaaacatatttctacaaatctataaattatgtaaaactcccagtttatattattcaatttaaaaactcacaaaaataccccacaaatgtcattttaataacatcctcattaatagatttaattccaactcttcagcatagtgtagttcaaatttctggtcttgtacaattctcttatgcagagataattttcctataatttttattctgtagagacactgggccttgtataaatcctagatctcttaaaattttaaaaagaaatcatgcaagaagcccataatctgtcacacattaggggcccatagatttaatctcttactcccccttgtggccggagtggcttccattctttgatttgcaatttcctcacttgctttcaaccaattagaaaagtgctccaccagaaatgctaatgattaggaggtgtcaagaactaatttattaagtcttttagacattttgactttaaattattacctttctatgcaatgtggcctaacagaataagattttaagctgtgaacatatgttctataaataaggtcatctataagcaggcttgtgcctaatcacttaacgcattttccattaatagatggcaaatctgcacttttaatcaacaagaaatctggcaaagcaagatgttcctgatgttcaagaactgttaaagccagcctaaaactttattaatataattcctgttaaaagagtagctgctccctgatatttaccccaaaacaaaagatacctacactaaacaatgctgatagaaagccccatctgttctgttctaaaactttttttttttaatcaactgggtgaaagggctagcaggaagtgagaataaaaactgccaaattaaatcaggttcagagaattgtctccctccgaatcatgaatgctagcaaaataatcctagaaggaatcagtgttttaagaacatctaacgctgggcacggtggctcacacctgtaatcaatcccactttggaggccgaggcgggtggatcatctgaggtcaggagttcaagaccagccttaccaacatggagaaaccccatctctactaaaatacaaaaatcagctgggcgtggtggtgcatgcctgtaatcccagctactcaggaggccgaggcaggagaatcgcttgaacccaggagacggaggatgtggtgagccaagatcacgccattgcactccagcctgggcaacaagagtgaaactccatctcaaaaaaaataaaaataaaaaaaggaacatctgaaaacaaattttgaaatgttgttcctaaagattaaaagtgaaatactaggccaggtgcagtggctcatgcctgtaatctcagcactttgggaggccgaggcaggcggatcacgaggttaggagatcgagaccaacctggctaacctggtgaaacctcatctctactaaaaaatacaaaagaattagccgggcgtggtggcggccacctgtagtcccagctactagggaggctgagacaggagaatggtgtgaacctggaaggcggagcttgcagtgagccgagatcgcgccactgcactccagcctgggggacagagcgagactccgcgccactgcactccagcctgggggacagagcgagactccgtctcaaaaaaaaaaaaaaaaagtgaaacactaacaagtatcaaaaagaacttatatcaaaaagaacttaatgagtagttaagtataaacttaaaaattattgacactcactgaaggcgttcctcttctcccctcccccaggatctaggcctgcgctgaagtttctcacaaaccaaggcccaatttaccagtatttccctcacgatgctttttgttgttggtggtggtggtagttaaaacgcctcatttttcatagggctttttagcttgtaagtggcacgctatgtattatggataaactacatgggggactatattttatcagcccctttttaaaaaaggctaaagaccagcttttctatgttcaatgaatttgcagtacttttccctctttgacttgtattatttgtgcacgtctatttccctctccagactgaagagcaggggcttttacatttatttttgtaatagcccagggcttataaaatagcaagttgtcaaatattaaataaaaaatttcagctttctaaagttctcttaaatttaatccaaaatttataaatgaaaccacaataaagtgatatcacagaggtacaaaaggtaaagcagtgtatttgctatttaacaccaccacaggggtgtgttaattcaacaatttcctcaaaacatcctagaggtagatagtattattcccattttgaagatgtggaaacagagtcacagacaaatgcagtaaaacttgccccaaatcacacaatgaatcaaaaattcaaaaagactgcatggctcatgctaagttttatcacctctcttaaagtaaggtagtatacactttagtatcctttatttttagaaatgttacacagggatatgcttaaagttttatctctgctccaattaaagaaaaagagcctgatgctagtcctccattagatggcaacaatcaaagggcaactgggaaggaaaagtcgttactcttacaaaaagcagattgcttgagttgtcttatttctaaacatcttcctaacacaatgctaaaggactcatcaaattgttgaattgagaacttgcctgttctaggcaagaactacagcttgcctatataatactaccttcaactgtcaattccacagaatcacattttaagtaggtattttgcataatattttcatcaagtgtctcttggttgaatgtggtccaagtatgtcattctaaactggacaatgtttattacgtttaaggagcaaaaaaattataagctgagtgttcataagtcttggatcaacaaataggtctgtctcagaaaagcgtttgtaattaatcacttagatgagaaacattccgcataccagtgggttccttggtataacgctaatttttaaaaactctagatcccaaaaattgtttgcaagttagaaattaactgccactaaaaaacatttctaggccgggtatggtggctcacgactgtaatcccagcactttgggaggccggggtgggtggatcacctgaggtcaggagttcaagaccagcccggccaacatggcgaaaccccgtctctactaaaaatacaaaaattagccaggcatggtggtgggcgcctgtagtcccagctacctgggaggctgaggagggagaatcgcttgaacccggaaggtggaggctgcagtgaggcgagattgtgccactgcactccagcctggacgacaaggtgagactgctatctcagaaaaaaacaaaacaaaaaacgacaaaaaaaaaaaaaaacatctctaacttcccaactcattaaacgattaaaataaaatactaatacaacaaaaattgggcagtccctgcaaatttaatgcaataatccttcttagattttaaaattcaacacatgcatacaggccaacccattaagcaaatcttatgttggtccgcttaactttatagattaatacttggctgaaactatccttatattcttttacctgttgttaccactgtaagcacatttttatttggggaaggaaggctcacaacaaatcctgtcaaaagaaatccacaagagcttacatgctgaaactttttaataacctatccaatgtaaacaaaagggcaggtgtcacacaaaatgatcttactgatatcaagtcagctatattcatccacatggctttggtgcctgaatggcaatagaaaaaaaaactagtgaaatctgccaatatgtaaaactctatcctacactacactactacttctatcacattataccttaccagaaaacaaaactaaatcaatgacaactgctattgcacagtaactttcacatatacaagcttttcataattaaatggaattactgactagagaacaagtgaatgatcggttacatagaaatacacataataaaaaagagagaactgctgatacgaccgttcttcccacaccaaaatttacatttgtgccatctaaatatcaaagcatatactccttcagtgtactttacaaatacacaaatgttttcaaggagaaaagaacagagccaatcttctgatgctgaaagacagataatcaagattaaaataagtcctaaatcgagtaatgaagcagaaaccctcaggccataaagatggtaattagcaacagtttgtatcagggatagtgagacgaccaaactaaagctaaaagcctcttgcagggaattctggcaaggatcaagcaaatagatggaatgaaatcagcattttagaaagattagaataagaaatacatgcaacatagaactgaaaaaggaaaaataagagtaacaagtccaagtgaatgaccacaagcagcagtaaaaagatgtttataatttagcttttgtccattaaaagcacatcaagtttatccatacagtatcattttcctatttggcaatgtgcacttttctgagtataatcctgggaactatacaattcagcgtgaatgtaaaggatagggaaccaatgatatgggaaacatcaacagcttgtaatctgaaaattaagtcaaagttgagtccaacatgtcgtgtgattaagtctagaaaacatgctaaaattgggtagttataaagaacaggcagtttcaaaaggaaaaggaatgctggctttgagtatattgaaactgacagcagttctaagtcccctaaaaccttgagcggtgtttattctctatgtggaactgtcaagagtaaagcaaaagctatgggaactagaatgaaatcacaatagggaaccaggaattctacaaaaaattctaagaaacttattagaatttcaataaactatatgctaacttttaaaacttacttgatatcagaacacctgtcattctgacttaaaaattctcacacacacattcaatataaatatgccaagagtaacttattttggaatcaaaaatttgagaaattaatccaaaagtccaatgacatttaattcagtattataaagacagagctagtttcccttcccatcaaacagcaaaggcctctacacctttccattccctttcctttattttcatcatttccacttcatatacctcagactttttgtatttgtacaaaatatgtcattgggtgtggcactttacattaaaaaaaactgaactttattaccaaagacactgtccaggccgggcgcggtggctcacgcctgtaatcccagcactttgggaggccgaggcaggtggatcacgaggtcaggagaccaagaccatcttggctaacacggtgaaaccccatctctactaaaaatacaatacaattagctgggtgtggtggcgggcacctgtagtcccagctactcgggaggctgaggcaggagaatggcgtgagcccggaaggcagagcttgcagtgagccgagatcgttccattgcactccagcctaggcgacagagcaagactccgtctcaaaaaaaaaaagaaaaaagaaaaaaagaaaaaaaagacactgtccaattttttccttcctgagaccacagaactgggattatttatactttgaaacataccaaaaccatgaagacatgtaaatatacagtatatcttaataaaatgaaatagtaacaatagatataaccctacagagttctttggagaagcccttattccaatgagctgtctagtgattttcatcttaaaaactgctaactctacatagcagtttttaaagcccaaggcacgtaataatatattcagactaaaacggacccaaagccgcttgctttcttatttctgtttaatggtagttctgtgggctggagataaaaatcagtgacccataaccacaacttaaaattgccctgagcaaataaaaacgtagagcagcaataaaatagaactcagtcaaattaacagaatcactattaagattactcaactgcagttgccaactgttataaatgttagacacacaattttacactgcttcctctcggagacctcctatataaagtcattctctgcctacagcagtggattttaaattttaaaatgaaacctttgaaaatttgatggttggcatggaccttctgccccacaaaaatacacaattttaaaggcttcttcaatcttcgaaattccattcatggactgtaagttaagagacccctgcactattataggcaggctcacacttttaaatagaactgaaaagctaagataaacaggacacagaaggtagtcaaggtgctttacctgactctcattccccacaaccctgtgggatgagtattattcctatttaattgagcttagttttctcagagggactgagtgatttcctcaggccatgcatctattaaatggtaaaactagtttgactcagtatcttgagctccattattcacctcgacatacttctttgagtttgaaagaggcttcctagactgtatttccttggtattcatttcatcatgtgcaagataaaaactacccaatttttggctgccatctttcaggtttaaagaggtactagtgttgagtccctccccaactaccaagagagcttttgtctaagcatctggcaggaaaggcagattgcattagttcacatattgcagtttgaaattaacacgtggaagagaagaaacccaagttcttttacataatgcaaagtccacattgtgaagagcatgccagtgaccacttcccgccataatgctctatttactcttgtaatatgcaacatggtccaagctctttgcttattaaatggttaaacaatagataaatacatataaccagaatgggttactaaagagctcttcagaaaaactcagaactttggagattagctgctttttgtaggaagaaagtttattttcatagctattataaaataggtgctcaatataaaaaatctggttatcactaatgccacaagccaatactattatttctgcaaagggacacctgcttatttttctcaaattaaaaaatatatatatcaaagcccagaaaaggctggagtaataaaaaattataattgattttttatcatgtaagatcttaaaaatataatttaaaatatttttactaatcattaataatgattcaataactttttctagtagaaatatcagttctgctacattttattcttccatctcacagaaagggcagaaggaattttatgcaatatgtttccagagtcgatgtgacctatttgaaaaagatggtaggaaaaagaagcctattatcggtaaatatcaaattttcccaagcagaaaaagaaaaagctagggaaattttgcagtgctgctgacctaattctatgctctttctctaaagaagcctttctgcttgtttaacaaatatttgagcatctattacacgttgagtatgcaaagatcactaagtcttactcctgaaaagaccaaggctggaagcaaaagcttgtttagaattctcttcaaagccatttgtatagtaaagaaattaaactctcatttatccaaactttcaaagtgtaaataccattaaaactttttgggaagccagtgctattctggagggtaacgatgtgggtagggaccagagtgaacttccttaataatcataacaagaagaaactatttatatgaagagattatcttgttatcctcatctactggttctatgcaaacaaagtttcttcataaggaaactaaagggaagcatagtcaaaactgctacaagttgggctggacgtggtggctcactcctgtaatcccagcactttgggaggccaaggcgagtggatcacctgaggtcaagagttagacgtgacctggtcaccagcctggccgacaaggtgaaaccccatctttactaaaagtacaaaaattagctgggcgtgctggtgcacgcccagtaatcccagctactcgggaggtcaaggcagaagaattgcttgaacacgggaggcggaagttgcagtgagctgagatggtgccattgcactccagcctgggtgacaagagcaaaactcagtctcaaaacaaacaaacaaacaaacatacacaaaaaacaaacctgctacaagtcttttccttggaaaagactcacaatgacaggaacttttatactttgtatatggaaaacatgcacatacctacctggtattgcaaataagcgtgttagtaaaaggtaaatgttacattcctttttattcctaaaattgacttttgtcttaagggaaatgttaatgtgtaacacaccctttgaagccaaaataaaaacttttcgatcaggtgtaataattgggaaaaacactccagactgaacaaaactgaattacacatacacagatattagttagtaaggtgagcaaaaaaaaaaaacaaaaaaaacaaaaaaacccaatacattttttattatagaaaaaaaaaatcacattttcaaaatttaaatatttggccgggcgcggtggctcaagcctgtaatcccagcactttgggaggctgaggagggcggatcacgaggtcaggagatcgagaccatcctggctaacatggtgaaaccccgtctctactaaaaatacaaaaaaattagccgggcgcagtggcaggcgcctgtagtctcagctattcgggaggctgaggcaggagaatggcgtgaacccgggaggcggagcttgcagtgagccgagatcgcgccactgcactccagcctgggcaacagagcaagactccgtctcaaaaaaaaaaaaaaacaaaaaacaaaatttaaatattcttattaccttagcaaaatcacaaaacagacatttgtcacttggccccaataaaagcaagatattccttttttcaacttagatacaaatagtagctatcattctaaaggtttcaataagcaaagaacaaaaaaatgccccaagacagatgcctcattgagtttgtggctgtgaacccaaataagcatgtttaaaaaatcactattctttaaaaagacagtgtcaagtaagtatcatttgagaaaattacagtttaggaactgatgctattccattagtaaatacaaatgtaaagaaatgatagtatcatcacaactttaacaaaaaccccaaacccacaaccacatcagacattatcctattgctcattatagcacttcttccataaacaaggttcatatagtaagtaacaaacctggatttccatactgagttccagattcagtaatctgtccagaaaaatcgagatgctgcccctctttgtatatcagagcccttccatactggttaagtgtaaccatttagtaaaaccactttaaatattattccaaaaactgccagcttggttggattctctactggtttatcctcaaatttaaactattcttgatcaaaaagccctactttatatgacagattaaaattaaccaaaatgtagtttaattcttttaagcgcagtgcttcaacacagtaagtactgaatacttaaaatactcgattcaaactggaaaatcaagcttgagttgttcataacctttcatcatggttgtgagtgttcaaaatttaccttcaagaattcaatgcaggaagaggtttcatagttgtgacgccagagttttctgcatggttgactcattacattaacattatagcggctaatcctgagaagagtactatttctacaatgagtatcctattacatctctcttacctaaagtatgtaaaattcctttatccacagatgtacatttaagataaccagctatagagctactacaaatattctaaccataagtaaaacagtaacacaattagtttatattttcaattaatataaaatacaatactaaagtctgttatttttaacaaaactgaactgtttcataatcattgttgcaattattttacatacacgtatctataattgtcttaacatctttttagtcatgacaccatgaagacttttaaatttggaacacacaatgtttagaaggaaaagaaaaaccaaacaaaaagttaagagtaatgtaactgatactcatagggaccctacagtataatgaagccagactgaattgattctcaccagtacatcattgcagatatctcttagctccgtctcaattttctctctgtattctcgagccatctgctgttttttctcagcaccttccgtcttttgttcaatacttgagacgaccctccaagatgacctacgggctcctacaacatttttataagcaactgagagaagattcctctcctcattggataattcagctccttgctcagttacagacttcatgcaggctgccatgtcatcatatcgctcagcctgctcggccagtttggccttctgaaccagctcatttttatccatgactggatgttctgcaggggggaaaaaaggagtatttaaaatttttcccatcaaaataaacagactcaaaattatacctgtggtaaatgagttttttaaacctgaaacctaactgcctgtgaaagactgttcacatgaggaattaaaatgcagcctcacaaaaggatagtcaaaaaagggaaaaaaatttagcatactcagcatcagaggtaaacttacagccattaacacatcagtgtagcaaaacttaaaatttgttcagaagacccaaatttcacatgtcaaaattacttccaaaagctgcctcaaaaactacccctaatcttacctgatcaaaatctcaactcatttccaataccactaagtgatccaaaattaagcagcttttcttcctttagtaaaagcattgtttacagagaacatctggatttctatcatatttccagaatcataattcatatcagtttaatgtaactcacgtctttttactttcataatactcttgtcaagagtgattacattttagctttagtgttacccctaccccaaacctactagatctctgcaacaactgccagccaataatagcataacaatttgggggggaatgaccaactgtttgttttcagatattttgagtataaatccaccacaaaggatcaatatctgaccctaatgtctcaactctttatcttgttatatgtccacatgctttaaaaatatccgcaagtcatgacacttcaactcttactgtgagtactagaatatatcacattggaagtacttaatttataagtgtttccaatgtcatcgctccagttgaaatgcagaagtgctgcattttgcttctagccatcataatgtaattggatgttaccactcaagctgtcctttaccatgactacccatctaattctctttccctcgcattttagtttcctggaccttttcgatttacctcagctacatttttctggaaagatacccttttgcaagttgccgaacagcacaaagatactaatccacacagtgacaccacagaataaatgacttcagaggaaaatacacaccctgaatgaagtgcacttttaagttagaaggtgaacagaagagtccaccttggcagctggctcccgaatattaatcatcttttaccttcccagggaaatcccacaatatttttttaaccaaatgagagaacaggtcgccacattttaaacaaataattaaccactttggatgcaaggtactggctcaatacgtaaactatttaacctttatgacggcattattttcgtcaggtctctaaattactgatttttcccttaggatctcagaaacgctctctggttatttctgcttctaacaaaaaatgatttaagccagtacaaaggattctctccccaatcacttcggtacaagaggaagtggataaggtttctcacacagtaacgagtgctccaaggcctcgcctctacactgcgggcaggactcaccgcacccatttaacccttacctgacttgagacgtcggttactgtgaaacgaaaacgggcagacccggactttaaagtgcaaattctccggtccgcgtatcgcaaccacccccctccaggctccgcccaagtcggagccacggctcaagtccccgactctcctcctttgtcatggcggatctgtgtcagggagcccaacctactgcagagtgttaattcctccccccgaccggagccagagggaggagcagcccgcgcccccgcccaagccgtgggggggggggagagatggggagcgaagccgcccgaccccggggcagagacgccacagcagcccgcagaagcggaaccactaccagccccgccgcggacacaccccgctctcccacccagcgccttccccgccaccgatcagcgccggtgaccgtgtacagcgtctctaagggaccgacagctgcaggtgggggaggggacgagagccacacccagccgagcgggccaccagcggctatgctcaggctcacccgcccccaaagcaggatatgcgtccccaaaccgagcgcagggaccctccagttctagtccatcaagcacgggagccgactgcgggctcaccaccctgttctctaccccgacctggacttgcagcccccgtccacacctcccccgcccgttcacaaggagcaaaaaaagtcagacccatcccccacccccaccaggaaaattcaagtccttcctcccaccgcggagcccaggaaattcagctctaggtcccaggcgagccccaccccaaaacctcaccccgcagtggactcccctcccgccggcgcgcagcctcgccccggtctacctggcgggcgccgccgcgccaggcctgggctccggcccgctctcggccaggcctttccctcgcgcttgggtccccgaggcccccggcccctccccgccgcgccaccgcctcccggggtgggggagggccgggtcccgccgccgcagcgcccagcgcggaggctgcgcgagggggagggaaaggagggggcggccgagggagaggggagggggcggcctcacctgcgccactgcgatgcccgccgccgccgccgccgagtcattatctcgggcggaagcgagaagggcggcgagggagggggtggaagcccgcagagacaagggtggggatggatcgcggccggcggcgccccggccatgcctcgtccaccttcgggagccggcgacagggagatccccagggatctcgcgtgtgggcgccctacccacccccgggggcaggacgggggagcgagcaccgatcggcgccggggcgtcgatgcggaagcaaggagccggaggcggccgctagccgccctcccgagcccagcggaagaggagccgccgcccgtgtccgctgaggagactccgcctcagcccggcgccgccaccgcggggcgagtggggatgaggggacggagcgaggacggctcccacgcgttcggaaggctggcctgggacaggaagcgaggcgcggcggcggccgggttcctcacctgtgtccggagtgggtggtggcggcggacggacgggctcagcagtctctgggcggcggcggcggcagcagcggcgaggctgagactctgtccctggatctcgctgctcacaggctacagccgctccgcagacacggggtttcctccaatcaccagccccggcagcaggggcaccacacgcacgatgacgtcaaacgctgctatggcaaccgttgattggtgcccacagcgatcggggccccgcgtaaccgccgctccccggcgctcgtcctgcccgcccgcgctggagggcgagcggaggcgcgcgcgtcctcgcccgcagccgccactcctcccaccccgctcggcttccagctcctctacgcttgtcccgagtgcacctagggcaggaggctgcttttttccttttcctccccaacgcaaatcccccactcctcgccttccctttgggtccccaacgccctctctctccctctcccctgcagcctctgccggcccactcttcctctcagccggcgggaaggcgttctctccctacccccaccttagctttcgctcagcccgtctgcgcttgccccagtcactccctctggaaggggctcccgttcagcaacatccgggacctttcacatccccccacccctccccgaggcccggcccgccccaccctccgtgcttcgcggtagtaactgccccagggccgtccccgggcaggatgacaagggtggctcggcggctccggcattgtgatcaggacttgcggggcgggggccccggggcgggggcagggcgcggtcgcacggcaagggagggttgtgtgtggtgcgctgccccccgccccgcccgccgctccccttccccggctgggccgaccggggcgcgcggcccctcccggcctccctcccgccgccgcggctttacctgctggctcgggggaagcggtcctagaccttttatggctcggaaacgggagtgaggcgtccagcccctgagtgtggctgagtgatggggaggcgttccaatcgagagcgcgggatctgcgctcggtgactgcgcgaggggacaatgggtgggcgccgaggtgggggcgaggtgggccgggccgggcggagccggcaggaggtgaggcctggaaggaggcgcggccgctttagggaagccagagttccgaggggaaaggacagccttctcgggcggagggctggagctggtcctggcagccttgacccggagacaggcagtcaggcgtgaccgcacggacccgtttctcgtaggctaggttttcctacccaaataaagctttcacgtgaagacctcatactgcacatgacgatcattacctttttatctcctagaagcaaggtttgagggacgtcgtagtccccagggttccagctggcggtgggagtgggccacaggccgggtgatgagccgggacgggagcccggaagaaggggaaggagaaag

SEQ ID NO: 2173 - DNA, 33554 bp, Homo sapiens
  source 1..33554: mol_type = genomic DNA
tctccattgcacttttatttgaatgtaatatttgggacaattattcaaaagggccaatatttcccaatttaatctgaggtcataataaaacaagcaacaaaacagtgtttgggatttcagtttctcacccttatcatcaagactcactgcctcccatcatcaatatttattgagcatttacagtgtactaggcacaatagaacatacagaaaacattgtccctgctcttgaggagcttacattctaaaagaaaaaatacaccttttttaaaatggcatttttgtttggtgttttctgcaaagtactgaggaaatattttgtaaagtgagctttgggtataacttagccccatcattatttagagaatagaggaggaagaaagaggaaggattttaaaggcagacaatgacagaccattcaggataggtagggttttaaagggagataaacacagtctcatcaactaaggagagatttgctgcagtaaataggatgagggaaatagtctgtgggatgcaagcaaaggaagcagggtgccttagacactgagtggagccagaaagatcatgcggcctttttccaagtacatggccaccaagtaagaatggttggtgacaagacagaaggctaaaacaggaaggtaatcttgtgcacctgacaaatagaaagaataaaggatcaaaattgaaggcaggctataagagtatcaagaaattcttaaaaaccaaaaagtgatttggaagcacaaaacttacagttaatgctacccaatgtcatgatgggccaagaacattgtggcttcctaagttagaaaatgccatatgccaaaattttaaatggaacacactacatttttttctaatcaatccccccctctcccagaaaaaataggaactcatttttttcagggtggggaggaagagaggggatcatgggacatggaaacagtagttatattagtagtatttttgttatgataaattttgtgtttaaacttggtaagagcccattagctgccaagagggaataaggaataaatttcaaaaaatgtacaatttcctttagagaagtttcagaaccaagactaatttacatgaaaagctgtagagaaagtagttgaaaagtccattcataaaacttttattccacttacatgaatttaatacacgtgttcttaacaattatgcttggattgttcatgaaaatttcataagacattaaacaaagctagccatcatctcaagttatttccctgttaactatttttacagcacatgcatgttaggcaagtatcaaaaaaaaaaaaatcacaaaagcaaaaatcctaaaaaaaagttaaatacatgggtttttgttttactgctgtgcttgatatacatgaagtaatgaataccaagcaattcatttttcctgcatctttacttttacatttgttcttaggttgcctaaaacatttaaatacaaataaaatgagtgtagcaaaaataatgaaagctaacagcaggtaactttacaaataatggaatgtgaaccgtttctgcccttatccagagtaaaatgggtcacaactttgtctaaaggaacacttctgcagctgtagtcaaaggtgtacacattgagtattccacagatatacatggtttaatatgtggtatccatggggtatgattctaccacagccttgtaagtgctccaaaccttaaagtacccacaattactacacctgtgactggaaccaatgatcccttttattccccgccaggacaaaccagtatgtaggcagttttctttgcttagacatggaagcagttttacactggcccttttgaagccacaatgtaccaaaagtactatgccaaacacttataacttgtataaaaattccacatccccatattggccacctcaagatgaaaacagataactccctaaatgttaactggctctactcccctaatattaaacataaaaaccacatgggaaatatagaaattcaaatagaagtaacataaacctgtcataaatcgtaaacaaaaaactatttgtgggacagcatggatgacaaatggtctactgtgtaaattttagaatgaggcagacaaaagttggaaggccggttaattttcccctccttctcctgcttcagcttcgtctccttgggtatccgatgtccacaactggtaaaagaaggaaagatttttcagcaagtttcagtgggatgggggggggggggcgttttcatataagtgccaagatacctgaatgttttagttggaaagcattcttaaaaagatagcagcatcacttagcttcaagatacaaaaacatctcaatatacaaatttactttttttgtaaccactatataagcaggttaagtacaccacagagttgccttcaaataaccttcagatacaggaaagttttggttatccacagaaggtgaagagaaattacaagaaataatactttttttttgagatggagtctcgctctgtcaccaggctggagtgcagtggcgtgatcttggctcaatgaaccctccgcctcccaggttcaagcgattctcctgcctcagcctcctgagtagctgggactacaggcatgtgccaccacacccatctaatttttgtatttttaggagagacggggtttcactatgttggccaagatggtcttgatctgatctcgtgatccacccacctcggcctcccaaagtggtgagattacaggtgtgagccactgtgcccaggccctaaattattttttaaaaactaagcatcaataggtgtcagaacctaaagagccccaatatgaaagatggacgtccaaggtgagtgcaactataccagaagcatctaatttggcccatgctgaaggagctagggttgactactctccactggtagatcttaaagtgactcacactccaaacagaatcctatactccatgaaattcaagaaccagcctcaactctgagctaaactacaaatctagcttttctaacactttaagcttagaaaaacaaacctttatttatcaggttggtgcaaaagtaatcgcagctcttgccattactttaaatggcaaaaccctcaattacttttgcactaccctatcatatgattcaaaataaatgctggacaaaaaccagaaccaaatcttttaacaggtaaaaatgaaagttgtcccataggtggcagggttatgaactctattccacctgctccaatgttaaaaatgttgaagtcttaaccactctctagtgattttcagaggtaattacaaaaggattcaagacaatcttaaattttatatatgacttacacatgaaaacggaggggaaggggaaaatacactaattattatttttatattccccaaatcatccattagcttcatttatctactaagcaaatatatctctggcctggaaaggagactacttccaaggtcatacagatagccaaatgacctcttggaaactgtgtgctcctcctgtcaaacaaggggttttgtaattgcaagatgaaattgtttctaatgtctctttcctgttctaactttcaaggattcttgaattttctgtataaacatgcaaatttgatacaaaatatttctttttctagagtaatgtgttgacagtcttggtcaaccaaattcagaatgaaatattaagttttgggataatttcttttcttgacagataaatgttccaatcaacctataatggtgacagctgacactaataaggctcagagaagacatacaagtagtgacagaattagaatcaaaaccctggttttttcttttctttttttttttttttgagacagagtctcgctcttttgcccaggctggagtgtagcggtgtgatctcagctcactgcaacctctgcctcccgggttcaagcaattctcttcctcagcctcccgagtagctgggattacaggtgcccaccactatgcccagctaatttttgtatttttagtagagatggggtttcaccatcttggccaagctgttcctgaactcctgacctggtgatccgcccgcctcggcctcccaaagtgctgggattacaggcgtgagccaccacgcccggccaaccctggttttcttattgcaatatgcgctcttcatgctatactgatagcaaaattcagttggaagcagacagtagatcagggcctctcaaaaagtgatgtgaacaaaacacagtatctaggtctcaggtcatcactttaaaaatgtcatcacttcaaactagaaaagaaaaatccttaatactaaagttagttaacaaagtgcttcttatgtttgatatataagattctttcattctttactgtggcttgttatcttgactcaagtatcagaaaagtttatagatagctccaaattgtgctaataaagtaattttaggtttaataaacaagtatacaatactattcaaaaaactcttcaagattttcagcactagcatatagaactggtttatagaaaatggcagtggactagaataaagttggaagagaaatgtataaaatgagattacatagtccccaagagaaatggccctagaagtctaacaaaaaaacagtaatacctagattatgatctgcaattcctacctctttacctgacacacagcaaatgcttgataattttttcacctaagcctcaaaatttcaaatctagtatttatctgaaggagaagaatgagaagacctaagaaacaaacgagacatacaaatcaactgcattgtggactgaatttgaatcccaattcaaataacttaaaaaaagagagataattggaattcaagtattatttagatattcaaacattattagggaattatgttgatgttcctggtgtgatagtgacactgtttctttttatacatctgcagtatcccaaggacaatcacgacctttcatattaagtcatttaaaataagaagctaggcaaaatagacttccacttggattctgtagatacctgagattttgtaactcaagttattaattccctaccattatctttaccaatatggaggcaacttgatgggcaagaaaatcattcttaaaggaactaaaacatgtagagtctcagcacacttttgatactaacaaattttaacaagacaggtaactcatcaatgtgtgtattttttagttctcagtctaatatttcagtttctgtaattttccttcataggactttaatagtagctgagatatatttatgagagcctatgaaatgtgttgagaaaaaattttaaaagatgtatttaataaaaaaaaaaattccctagagtaaaacataacctcttcaaccacattcatcactaatgatgctgttatgtacttactgtcaagttgtctctcagtaattgcattattagcgtgctgtctttgtatgactcttcacttaatgtatcaagttcagcaatggcttcatcaaaagcctacgatttaaaaatagtacattacatttcagtgctcaaataataaagactgctaaatttctacgtaacaggtaaaatacatactgtctttgcaagagagcaggctttctctggggagttcagaatctcataatagaacacagagaagttaagggccagacccagtctgataggatgtgttggttgcatttcctttttgctgatttcaaaagcttcttggtatgcttgttgtgactgatcgacaatccctggataagacacaccaaaacgtactgagataaagtgtgcattatatcttcacccctcaaaccaaacctttaatatctcacatatcctttgaaatactaacctgtaacagcttaatatttgttaattgaacaaggtccttttttttttttaaagggagctttctcctggtacacactagccattgatcaatgtcaagataaaacaactttataatctcattattgttatgtttttaaaaaattgacgagttttgacatcccagacccaagcaatcctcccacctcagcctccagattagctgggaccaaaggcttgcaccaccatgcccagctaattttcaaaatattttttgtagagagagatgttgctcaggctggtcacttttcttaaaatcttgaaaaaacatccctgtacacaatattggcttttcagaaagcatttattttagaatagcagtatgaggcagtagatgtgtattctcagaacacaaagagcactgctactccttattcggcactctaagcaattcaaaacaagacattatgtacgcttcagagactcttcctcactatgttatcttatacaagttcaaccaacaggtttaaaaacagcatacctttcttgtcatcaccagcggcaacctcagccaagtaacggtagtaatctcctttcattttcaaatagaagactttgctctctgcttgtgaagcattggggatcaagaacttttccaaaagagacttaagaagaaaagaaacagacatagtgagaataaaacatttacaaaactgaaagaacttgcatttcttaaagaacaaactatagcctaagttataaaacttaaacacccagtcactgtcaatacaattgtgaatgcagctggcacatgaatttgtggtttaaagcagaatgctttgggcagcaatattttaagtttgaagttagtgttcagtttattatttgaggacaataaaattgaacattggtccctgacaatgttatctatttacatgctgacttcatgaatgtggggcatgaccgttcacatttaggaacattttctaatgagctggcaagctttccatctgaagtttcatgtggtcatgacatgaaaatagaaagaacatacgggatgaaccttttgggactctggagaaatgactaaagcagaaaccaataatgtaagacacttaaggagtccatgccagagaaggaggaacaaaataaacttcatttataacaacacaattcaagcaaacctcacaacagataaaaaaaccgttcaaaagttttatttttcctaaagacagtggtaggagacttacagattttaaagagcagacctttaatctcattgaagtcattttcggctagtaagatacacgattacagatcatcccagacaacagataaaattaaaacatcatcctataaaattctgtctaaaactactattacaatctgagtcatttgattaggattttaaaaattacactctttaactgattttaaagcaaaaagattagatcattgtgttggggatgggaagaagtctcaataaatgtgtaatttttttctttccagttaagggggagaaaaataattctagtagtagaattaggtaaacattaaagcaaaaaaaccccaaccacccattctcactaccccacttcctttaaagttcaagtacactctgagaatcaaggtgaagtcaattttcagctgagctaaattccaaatccattcttacaaaaaaaaagtattagtttatatagcacctacttatatataaaatataaatttgaaaaatgcttttaaatggtaactccaactttttgtttacccattatgttccaatgctgggtaggtgaacagttttaacccaacttcttcccccaattttttttttttttttttttacaactcaagctacagataacccagatgaagtggcagtagggccagattgcactgtgctatataaagaggttaaaggtgagaaaagtcaacctgaaatgatgtttcctgcaattattaaccgatatttaaaaatactggcctgaggccgggcacagtggctcatgccagtaatcccagcactctgggaggctagggtggcaggatcacttgaggtgagcctcgtcaacatggtgaaaccctgtctctactaaaaatacaaaaattagccaggcgtggtgacgggcgcctgtaatcccagctgaggcaggagaactgcttgagcccgagagatagaggctgcagtgagccgaggttgcaccactgcactgcagcctggatgacagagcaagactccatctcaaaataaataaaaataaaataaaattactggccggaaatcagaagaacgttttggttaggatagcaacctctgtcttacaccacattcatactttcatattcaaagttctcttagctgcaaaagtgttttgtcctttgaatacaatgctttttaccacctatggttgctctgtggagatctgcctcaaacagtggaagacacttgcatttaaaatagtcaagtgagtctttccacttaaaaacaatggttttaagaaacaaatgaccaggattttcaaaagtttcattgttacacaaattgtattattcattcaactatgggagatggtataaacataagtggctttggggtgagtctggttttgaattacagcactatacaccgtgtgaactacttaatctcaatgattcagttatctcacctgtaaggcagagacctctaagattattgagaaaaaatacaggtaagcacttaggagtaagcacttaaaattttatttctattatcacaataacaccagacaccatgctagaagctggaagcacaatattctggtaattcataatctagctgtagagacaaggctatcattccttccattacaatacactttacaagaattgcagggcacggtggctcactcctgtaatcccaacactttgggaggctgaggtgggaggatcacttcttgagtccaggagtttgagaccaccccggtgaacatgagatcctgcctctacaaaaaaatttaaaagttaaccaggtgtggtggcacacccctatagtcccagctacttggaaggctgagacaggaggatcatctgagtccaggagtttgaggctgcagtgatctgtaattgaattataccactgtactctaggacagggtgacagtgaggctgtctcaaaaagagtaacactgcctaatcacgtctttcacttttcggtaactttaaccccctctatgtatgcagagatgaaggccataaacacatgcagttacttaagagtgaaccagtcacttaagatgtaaaattttaaagctgtactaaaaacttaaatttttttaggaaaggtgttgataaatgctactaaaagtagtaatctatcttttgtaggtagtaactttctacctgggtaatatgctgaactaagcagttccctgggaattaaaatggcagttaagcacttctttccccaaagctgaacactgaattaaccataaaacaactttaaagctatttgttagaacccacaagtaacaggagggctgggtaaacagcagtcaggctgcttactggcctaatgatagaccaaaagaaccaaacaagtggcaagtgtttctggtgagatgctgaccataagagttgagaaaggtggctgggcatggtggctcacgcctgtaatcccaacactttgggaggctgaggtgggcggatcacgaggtcaggagatcgaggccatcctggctaacaaggtgaaaccccggtctctactacaaaaagaaaaaattagccaggtgtggtggcgggcgcctgtagtcccagctactcgggagactgaggcaggagaacagtgtgaacccgggaggcggagcttgcagtgagctgagatagtgccactgcactccagcctgggcaacagagtgagactccgtctcaaaaaaaaagagttgagaaaggcataaatggcctacttctaataaatcgtccaatgacataagctaattaagatttaaaaacccaaaaccaagcaagactggattaaagattaaatttaaaggggctaacactgtagctcaaaaaaagctaactataaaagaacattttctgccaggtgtggtggttcatgcctataatcccagcactttgggaggctgaggcgggtggatcacctgaggtcaggagttcgagaccagcctggccaacacggtaaaacctcgtctctaccaaaaatacaaaaaattagccaggcgtggtggcacacgcctggaatcccaggtactcaggaggctgaggcaggagaatcacttgaacccgggaggcagaggttgcagtgagctgagattgcgccattgcactccagcctgggcaacaagagtgaaactccgtcttaaaaagaaaaaaaaaaaaaggaacatattctcagcctcaatggggtgatatacctactagaaaggacgttattccacaatcaggaatcaaagttatggcgagtatactagaaactgtcaggataatggaaagaacaggacatgaatggctccaagagacaagaccaattaaatttagcaagagggaagatttctgttcagtatgagaaaacttatgagtggtccagtactggaacctgctcagtgaattccctcttttcacataaaggtaaaacaggaaactaaagagggtaacttaggtattttgtagaggagattcataaagaagatgtcatctgtttcttttaaaaaaattttaattgacaaaatagttgtaaatattttgggggtgcatgtgatattgatacatgcatacaatatataatgatcaaatcagagtaactgggatatccatcacctcaaacattgattttttttttttttttttgagacagtcttgctctggcacccaggctggggtgcagtggcgcaatgtcggctcactgcaacctcctcctcctgagttcaagcgtttctcctgccttggcctcctgagtagctgggattacaggcatgtgccaccatacccagctaacttttgtatctttagtaccaatggggtttcgccatgttggccaggctggtcttgaacttctgacttcaggtgatccacctgcctcagcctcccaaagtgctgggaatacaggcgtaaagccactgcacctggcctcaaacattgatcttctatttgtgttaggagcactgcaattcttctagctactttggtagaataaataaatgttaactataatttccctactgtactattgaatactagaacttatttctactatctaaccggatttttgtacacgtggtctttttcaattctaagggaagtcagagttcacagaattaatttaatggtaacataaaagaggcaattaagtatgttgctttgtcaaactgaccgaagaataacaaatccaagttttccagatttggaagccagaagataaaacccaatgtaggaagaatagaaaaaaatgaataaaagaacaaaagaaaaaggaagcagcagttacaacaaagcagaaaaaaacatggaggtgcaccaagtagagaatggaagggaggaaagggctgatagctactttcaaaatatgcaataacttcagagaatatcctgctcaacacagaaataaacctcctaaatttcgttcacctacaatagtacaatgaaagcaatcatgactgaaataaagtctgaagtaaaaaggggagggagtgggcacaccataatataaggaagtatacactaagtgtcacaatttcaaccgtatttagaacgaagtctcgctctgtcgcccaggctggagttcagtggtgtgatcttggctcactgcaacctcagcctccccggttcaagtgattcttctgcctcagtctcccgagtagccgggactgcaggcacatgccatcacacccagctaatttttgtatttttagtagagacagggtttcactgcattggccaggctagtcttgaactcctgacctcatgatccacctgcctcagcctcccaaagtgctgggattacaggtgtgagccaccgcgcccagccaactccaactgtaaaacaagggctaggttgactgaaggttcaacttgtaaaatttttcaattatcacagtaccttaagtttttaaaccaaatctaaatggttttgaggtcaaacaaaattcaagcacatcctacactcaagctaaatcaaggctaaatgttaatctgttgaatcttcctgaaatataatctcatttagaaatccacagtatttcctcagtttacttcaaaatgtggatgtaagttttacttttttccctcccattaatttttttaatttttatttagagatgaggtcttgctctgtcacacaggctggaatgcagtggccccatcatagcttgccctgctcccattaacttttaaatatgttttttcatgacagccactgtcttttaaagatatcatggccaacattttagaaaatacccaagattaatttgctgaattagagttaatgcatttatacagcattcaccctaataatattaagtgggataagaaatcatttactcagcagcaaaatgccacaagaagccggtatctaatactctttggtaaacagctcctaatccagagttaaatatgtgatatgggctctgaagagaggacactaatccttaacctaaccaacaggtaaattacatgaaatttgagattttagagataaaagagatttttctctctactgcaccgtagtataattaacctcttagattgtgaaaacacttccaagagatggggttcaaataacatttttcctcccaagccagtttccaaaagatgccttaatccaaagatagtctatatttacaatgatgttttgtctttaaaattaagtctattaaaattaaggaaccacataaattgacaggtcatctgtttctgatcccttcttggcatagactcaacctgatcccactaatatgaattttataaacactcactcctgcctgtagtcaaatattcctaatgaaaagttaatgaactgagaatctatctctagtgatatgcctttctcactggtctttcagtatgattacccctaaaccaccaaaactgctgcctgagctggtggcaagactttaacctttcgggcattcaacacttgttagaagaaaagcttgatgtaatgcaaatcgtataaactctaaaaccaggcagacttgaaattccaccctaacccattaattttgagaatttacacaatagctaatctttattttctcatctatatgaaaatccacatcaaaaggctgttatgaggtctaaatgaacatataaacaggagggcaccattcacagctcccaaccgagagtaggcattctactcactggttgctcagttatgtgaaaataaagtatggagattctgacattcaaaaatctgctttagtgctcttgtactcttaagtacatcattttggctttggtaatctaaaatttgtataactaggaaaaatggtgaagtaggatgcaaaaaagttttcattcaaaaacacaggattaagacatatcaaagaacaaaagaaaaaagaacaaaagaaaaaaagaacatttcctttagtatttattttctctttttaaacaacagacttgttaggaacacaaactatggagacagactgcttactgcctaaattcaaactctgtcaccttgacaaaactctgaaatcttcctgggtctcagattctcatctgtaaaaggcaaatattagtagtagacataatgcacaaggttgttgtaaggattaaatgaattaacatataataagcatttagcagagtctggcaaatagtaagcaacaaagaagtgctgccatccttttggaaggtgaaagtctagtgtcaaccacattagacttcaagtactgtttgtactgcagtaactgatcttaacccacccactcacccacccaaaaaccaccttagctctgaactccctcttatgtgaaataatttcctaatatttaagtaatattaccttatttctcccaaccatggtacatatatactacctctataaataggtacattttctaggaaaaaaccctaaacggtaacaatacttcaaatttatggcttaaaagtttgtctcaagacacttttacagtcataaaaaagtagaaaactaagatcatggtggtagtaattattttccaaagttctcatttttgctccaaagcttcaattttatctgtcaaaaatatcattttcccttaaagtgagaggctcaattcatttaagatatttgtcgaatacctaggtctgaatacccacagcttatctgcctgcagttctttgaagaaaaaagtgttccataaaaaaagaaaagcagctagtttatctcacaattcaaataactgcaagtgtttttcttagagacaaccactggacttcccattttgcctcactgaaagatgtctatttaagggctattaataaaataatgtttcagattcaaggacattaaaaaaaaagtcttttttctttttaaaagaaacagtgagtgcataatggtaaagaaatacaataatcactagtacagtatagtatcactgccttgattagcgataaggaaccagtaagtttgagcaacccttgggtttgcaccagtgctaaatgtcaacaaagtgataagaatcagtattaacagtatttgccatgaaaatagttgtgacctggctcggcgcagtggctcacacctgtaactccagcactttgggaggccgaggtgggtggatcatgaggtcaggagctcaagaccagcctggccaagatggtgaaagcctgtctctactaaaaatacaaaaattagctgggcatggtggtgtgtgcctataatcccagctactcgggaggctgagacagaagaatcacttgaacctgggaggtggatgttgcagtgagccgagattgtgccactgcactccagcctgggtaacagagtgagcctccgtctcaaaaaaaaaaaaggaagaaaatagttgtgactttttgtgatgtaatagacacctccccaaaggactcccagtggtcggcatatcacttttaacaactgatttaaagtaacctctgctatgttgtacaccttaaatatatattttttttgccaatcgtacctcaataaagctggaaaaataaaatgaaaagaatctgtgctaaatacctctccatacctagctctaatgctatgttctccctaaagctaattattcaaagctattcagcttcatctacattgtctgtacagatagtgtgtagtgtagagctttttaactgaagagaaaaaagggaaatatcctaatttctgtcaataaaggactaacggccaggtgtggtggcttatacctttaatcacaatcactttggaaggctgagctgggaggattgctggaggccaggagttagtgaccagcctaagcaatatagcaagaccccatctctactaaaaataatttaaaaacttagcctagcgtggccaggcgcggtggctaacgcctgtaatcccagcactttgggaggccgaggtgggtggatcacttgaggtcaggagttcaaaaccagcttggccatcatgttgaaaccccatctctactaaaaatacaaaaaatgaggtgggcatggtggtgcacacctgtaatcccagctacttggcaggcttgaggcaggagactcacttgaaccctggaggcggaggttgcagtgagctgagatcgtgccaaagcactccagcctgggcaacaaagctagactcgtctcaaaaaaaaaaaaaaaaaaaaaaaaaaaaattagcctagtgtagtgtgcacttgcactcccagctactccaaaggctgagatgggaggatcacttgagcacaggatgtcatggctgcagtgagtgcaccactgcactccagcatgggggacagagggagaccctatcttttttttttttttttaaaaggagggtctggctaagtaagttgctacatacccaaataatagaatactatacagacattaagagtgaggaggtacgggctggttgtggtggctcacgcctgtaatcccacactttaggaggccaaggtgggtggatcacctgaggtcaggagttcgagaccagcctggctaacatggcgaaactccgtctctactaaaaatacaaaaattagctgggtgtggtggcaggcgcctgtaatcccagctactcaggagactgagacagaagaatcacttgaacccaggaggcagaggttgtgccatctgcactccaacctgggcgatagggcgagactgtctccaaaaaacaaaagagtaaggaggtacctgtcaaaatgaaacataagatatacatcaaagtgtgtagttttgtacaatttaccaaactaagtatatgatccttattcttcaaggacagaattgtttactttgcacataaattcccaggatacacaaaggactaacagagattacctccaagaaggcaggatgaggttacagcagctttattttttccttctacatgctatgctcttaacacctaaattcttaggagcaagtacaatttaaaataaagattaccagcctgggtgacaccccgtctctactgggaaaaaaaaaaaaattggatgtggtggcacacgactgtaatcccagctactcgggaggctgagccaggagaattgcttgaatgaacccgggaggcagaggttgcagtgagccgacattgtgccactgcactccaatgagttagactccatctcaaataaaacaaacaattatggttttgcacctttaacttttcacacacatatatactcttaacctactcataggctctaataaaggcacgttctacacattttaagcactcaaaaatattaaactccctgactgaataatatacgcataactgtaatagcttcatttaaataaaacattttaaaactatcttggaggatattttaatagctcaacatcctaaaaactatttttcagaaagtcttcatcatcaagagtgtattaccttaccaaattcctaaatagttaagacaaaacctgatagaaattcaggttgacactacattcaataatgaatattctgctgtaagagacacaacaatgttctacttctctgaaaacctaagagattgctcatttaaaatatgtgagtgctgaactaaacacatatattcagaaacagcagcaaaggggcaggctaagcacctcctaatatggataagctccaggtttctatgtaatgaacaaagaagaacctaagaaaaatcctgcagagagaactggaagagagtgtgaggttgcaaggcagagtaaacttgttaagaagtcaagggtcctagattatggtactaattctactaactaagaggcaagacaggcatttcaaatacaaaactatgaccagcctcctcctcaccttaatcttcttgtgtttcactacagcattaatttcaaaatctcccttccaatgccaggaaatctcctctaacataatgaatttcccaccccaccactatcccttacatttctttaaattcaagatcactttttttcttaaaaagtaatcagagaatttataaactaagggtccttagaccaaaccccaaaattatgaacaagaactcaatcattaagtatttgtacattcacctcagtcctgaagaatagccaacctgccactatacactcaaaccaccgtgctatgtgctgagatttgggcttgccaactagaacacaagaagccaactaatgaaaataaattcgaaaaaaaattacaagttacagagctgggatcctattttcccctttgaagaagcaacctattcagtataaacagaggcagcttatttaaaaagcactttggcaaaataatttagtttgtaacctttgacaaagtaatcataatcttaaggcatataccttaaaaaagattcaatgggtattttgcaccatggggtgtgttttcagaagtcctaacagcataatgcactatctaaatataattggttaagtaacaggacaacaccacatgcctcctaatataatgcagtgaggaggacaccatatcacttccaggagttctcaccaaaaactggcaacctaaatttaatcatgaagaatcaccagacaggccgggcacggtggctcactccttgggaggctaaggcggccaaatcacttgaggtcaggagtttgagatcagcctggccaacatggtgaaaccccacctctactaaaaacacaaaaattagccaggcatggtggcgggtgcctgtaattccagctactggggaggctgaggcaggtgaatcgcttgaacctgggaggcagaggttgcaaagtgagccaggatagctcgccactgaagtccagcctgggggacagagtgagactccatctcaaaacaaacaaacaaacaaaaaggatcaccagacaaatcgaaactgagagacattctacaaaataaccagccagtactcttgaaaaaagttccaaaatcattagaggcaaagactaaaacaagactgatccacattaaaggagagtaaggagacatgtaagcaaaatgcaaagtgtaattctggatggaattctggagcagaaacaggaaattacagtaaaacaatttgctaaatttaattaagattataggttacataatagtttatcatttactttaatcattttcctgattttaataattatactgtagttattaacatgtggacaatctggcaaaatatatgaaaaactcttcatatttttccaacctctttctaaatctgaaattatttcaaaatgaaaagttaatacattttaaagaagtcccttttaattgtctttatttctgaaagataccctttttcataccctttatatgctttttttttttcaaatttccttatgtggctgatactacttttgtatttaacacagaaatggtacaaaaacaatgatacatttgtaaagaaaaatatgtggggtggagagaaagttctcatcttgtcttaaaacagtatttcaccaactggtcctaatattaaatttaattcgcacaaagataattagacatcgagtgtcattagcaaatagcaaatccccccagaatatcaaagcaaaacaatcaacctctattgagacatttatgaattgaaatttgcgaatacagctgggctaactttgacatgacctcaccaaatatgtgagtgggagaaagatcaagcctccataacccattcttctgttttagattgtactgtcatggctctcttccaaaacaacaaatgaagagagagacattaggacacagacatgcctgctttcatacaaagcatacacacaccagaagttaaaaggttgaggtagcaagtaactgaggcataagagccctcaaaagtgattctcagtaagtacagcaccctaattatagtctgaaacaaaaatcggccgggtgcagtgactcatgccggtaatcccagcactttgggaggccgaggcaggaggatgacctgaggtcaggagttcgagaccagcctgaccaacatggagaaatcccatctctactaaaaatacagaattagctgggcgtggtggcgcatgcctgtaatcccagctatccaggaagctgaggcgggagaatcacttgaacccgggaggcagaggttgcggtgagccaagatcatgccattgtactccagcctgggcaacaagagtcaaactccatctcaaacaacaaaaaaaccccactgttttcaataaaattaaagccacttattttgttattctgacaactcctcatccccccctacaaacccagtatcttgatagcagattaaatgtcatgtttcaatctacaataagatgatactacattaagagactacaaatattaatgcttactgtatgacctcatgtaaatagctgaacccctgagctgcagtgtcttgatctgttaaaataaaaaggctagatcagatgtccctttaaccctaaaattcaatgactcaatgaaatttctgtatacttaaacatatttctacaaatctataaattatgtaaaactcccagtttatattattcaatttaaaaactcacaaaaataccccacaaatgtcattttaataacatcctcattaatagatttaattccaactcttcagcatagtgtagttcaaatttctggtcttgtacaattctcttatgcagagataattttcctataatttttattctgtagagacactgggccttgtataaatcctagatctcttaaaattttaaaaagaaatcatgcaagaagcccataatctgtcacacattaggggcccatagatttaatctcttactcccccttgtggccggagtggcttccattctttgatttgcaatttcctcacttgctttcaaccaattagaaaagtgctccaccagaaatgctaatgattaggaggtgtcaagaactaatttattaagtcttttagacattttgactttaaattattacctttctatgcaatgtggcctaacagaataagattttaagctgtgaacatatgttctataaataaggtcatctataagcaggcttgtgcctaatcacttaacgcattttccattaatagatggcaaatctgcacttttaatcaacaagaaatctggcaaagcaagatgttcctgatgttcaagaactgttaaagccagcctaaaactttattaatataattcctgttaaaagagtagctgctccctgatatttaccccaaaacaaaagatacctacactaaacaatgctgatagaaagccccatctgttctgttctaaaactttttttttttaatcaactgggtgaaagggctagcaggaagtgagaataaaaactgccaaattaaatcaggttcagagaattgtctccctccgaatcatgaatgctagcaaaataatcctagaaggaatcagtgttttaagaacatctaacgctgggcacggtggctcacacctgtaatcaatcccactttggaggccgaggcgggtggatcatctgaggtcaggagttcaagaccagccttaccaacatggagaaaccccatctctactaaaatacaaaaatcagctgggcgtggtggtgcatgcctgtaatcccagctactcaggaggccgaggcaggagaatcgcttgaacccaggagacggaggatgtggtgagccaagatcacgccattgcactccagcctgggcaacaagagtgaaactccatctcaaaaaaaataaaaataaaaaaaggaacatctgaaaacaaattttgaaatgttgttcctaaagattaaaagtgaaatactaggccaggtgcagtggctcatgcctgtaatctcagcactttgggaggccgaggcaggcggatcacgaggttaggagatcgagaccaacctggctaacctggtgaaacctcatctctactaaaaaatacaaaagaattagccgggcgtggtggcggccacctgtagtcccagctactagggaggctgagacaggagaatggtgtgaacctggaaggcggagcttgcagtgagccgagatcgcgccactgcactccagcctgggggacagagcgagactccgcgccactgcactccagcctgggggacagagcgagactccgtctcaaaaaaaaaaaaaaaaagtgaaacactaacaagtatcaaaaagaacttatatcaaaaagaacttaatgagtagttaagtataaacttaaaaattattgacactcactgaaggcgttcctcttctcccctcccccaggatctaggcctgcgctgaagtttctcacaaaccaaggcccaatttaccagtatttccctcacgatgctttttgttgttggtggtggtggtagttaaaacgcctcatttttcatagggctttttagcttgtaagtggcacgctatgtattatggataaactacatgggggactatattttatcagcccctttttaaaaaaggctaaagaccagcttttctatgttcaatgaatttgcagtacttttccctctttgacttgtattatttgtgcacgtctatttccctctccagactgaagagcaggggcttttacatttatttttgtaatagcccagggcttataaaatagcaagttgtcaaatattaaataaaaaatttcagctttctaaagttctcttaaatttaatccaaaatttataaatgaaaccacaataaagtgatatcacagaggtacaaaaggtaaagcagtgtatttgctatttaacaccaccacaggggtgtgttaattcaacaatttcctcaaaacatcctagaggtagatagtattattcccattttgaagatgtggaaacagagtcacagacaaatgcagtaaaacttgccccaaatcacacaatgaatcaaaaattcaaaaagactgcatggctcatgctaagttttatcacctctcttaaagtaaggtagtatacactttagtatcctttatttttagaaatgttacacagggatatgcttaaagttttatctctgctccaattaaagaaaaagagcctgatgctagtcctccattagatggcaacaatcaaagggcaactgggaaggaaaagtcgttactcttacaaaaagcagattgcttgagttgtcttatttctaaacatcttcctaacacaatgctaaaggactcatcaaattgttgaattgagaacttgcctgttctaggcaagaactacagcttgcctatataatactaccttcaactgtcaattccacagaatcacattttaagtaggtattttgcataatattttcatcaagtgtctcttggttgaatgtggtccaagtatgtcattctaaactggacaatgtttattacgtttaaggagcaaaaaaattataagctgagtgttcataagtcttggatcaacaaataggtctgtctcagaaaagcgtttgtaattaatcacttagatgagaaacattccgcataccagtgggttccttggtataacgctaatttttaaaaactctagatcccaaaaattgtttgcaagttagaaattaactgccactaaaaaacatttctaggccgggtatggtggctcacgactgtaatcccagcactttgggaggccggggtgggtggatcacctgaggtcaggagttcaagaccagcccggccaacatggcgaaaccccgtctctactaaaaatacaaaaattagccaggcatggtggtgggcgcctgtagtcccagctacctgggaggctgaggagggagaatcgcttgaacccggaaggtggaggctgcagtgaggcgagattgtgccactgcactccagcctggacgacaaggtgagactgctatctcagaaaaaaacaaaacaaaaaacgacaaaaaaaaaaaaaaacatctctaacttcccaactcattaaacgattaaaataaaatactaatacaacaaaaattgggcagtccctgcaaatttaatgcaataatccttcttagattttaaaattcaacacatgcatacaggccaacccattaagcaaatcttatgttggtccgcttaactttatagattaatacttggctgaaactatccttatattcttttacctgttgttaccactgtaagcacatttttatttggggaaggaaggctcacaacaaatcctgtcaaaagaaatccacaagagcttacatgctgaaactttttaataacctatccaatgtaaacaaaagggcaggtgtcacacaaaatgatcttactgatatcaagtcagctatattcatccacatggctttggtgcctgaatggcaatagaaaaaaaaactagtgaaatctgccaatatgtaaaactctatcctacactacactactacttctatcacattataccttaccagaaaacaaaactaaatcaatgacaactgctattgcacagtaactttcacatatacaagcttttcataattaaatggaattactgactagagaacaagtgaatgatcggttacatagaaatacacataataaaaaagagagaactgctgatacgaccgttcttcccacaccaaaatttacatttgtgccatctaaatatcaaagcatatactccttcagtgtactttacaaatacacaaatgttttcaaggagaaaagaacagagccaatcttctgatgctgaaagacagataatcaagattaaaataagtcctaaatcgagtaatgaagcagaaaccctcaggccataaagatggtaattagcaacagtttgtatcagggatagtgagacgaccaaactaaagctaaaagcctcttgcagggaattctggcaaggatcaagcaaatagatggaatgaaatcagcattttagaaagattagaataagaaatacatgcaacatagaactgaaaaaggaaaaataagagtaacaagtccaagtgaatgaccacaagcagcagtaaaaagatgtttataatttagcttttgtccattaaaagcacatcaagtttatccatacagtatcattttcctatttggcaatgtgcacttttctgagtataatcctgggaactatacaattcagcgtgaatgtaaaggatagggaaccaatgatatgggaaacatcaacagcttgtaatctgaaaattaagtcaaagttgagtccaacatgtcgtgtgattaagtctagaaaacatgctaaaattgggtagttataaagaacaggcagtttcaaaaggaaaaggaatgctggctttgagtatattgaaactgacagcagttctaagtcccctaaaaccttgagcggtgtttattctctatgtggaactgtcaagagtaaagcaaaagctatgggaactagaatgaaatcacaatagggaaccaggaattctacaaaaaattctaagaaacttattagaatttcaataaactatatgctaacttttaaaacttacttgatatcagaacacctgtcattctgacttaaaaattctcacacacacattcaatataaatatgccaagagtaacttattttggaatcaaaaatttgagaaattaatccaaaagtccaatgacatttaattcagtattataaagacagagctagtttcccttcccatcaaacagcaaaggcctctacacctttccattccctttcctttattttcatcatttccacttcatatacctcagactttttgtatttgtacaaaatatgtcattgggtgtggcactttacattaaaaaaaactgaactttattaccaaagacactgtccaggccgggcgcggtggctcacgcctgtaatcccagcactttgggaggccgaggcaggtggatcacgaggtcaggagaccaagaccatcttggctaacacggtgaaaccccatctctactaaaaatacaatacaattagctgggtgtggtggcgggcacctgtagtcccagctactcgggaggctgaggcaggagaatggcgtgagcccggaaggcagagcttgcagtgagccgagatcgttccattgcactccagcctaggcgacagagcaagactccgtctcaaaaaaaaaaagaaaaaagaaaaaaagaaaaaaaagacactgtccaattttttccttcctgagaccacagaactgggattatttatactttgaaacataccaaaaccatgaagacatgtaaatatacagtatatcttaataaaatgaaatagtaacaatagatataaccctacagagttctttggagaagcccttattccaatgagctgtctagtgattttcatcttaaaaactgctaactctacatagcagtttttaaagcccaaggcacgtaataatatattcagactaaaacggacccaaagccgcttgctttcttatttctgtttaatggtagttctgtgggctggagataaaaatcagtgacccataaccacaacttaaaattgccctgagcaaataaaaacgtagagcagcaataaaatagaactcagtcaaattaacagaatcactattaagattactcaactgcagttgccaactgttataaatgttagacacacaattttacactgcttcctctcggagacctcctatataaagtcattctctgcctacagcagtggattttaaattttaaaatgaaacctttgaaaatttgatggttggcatggaccttctgccccacaaaaatacacaattttaaaggcttcttcaatcttcgaaattccattcatggactgtaagttaagagacccctgcactattataggcaggctcacacttttaaatagaactgaaaagctaagataaacaggacacagaaggtagtcaaggtgctttacctgactctcattccccacaaccctgtgggatgagtattattcctatttaattgagcttagttttctcagagggactgagtgatttcctcaggccatgcatctattaaatggtaaaactagtttgactcagtatcttgagctccattattcacctcgacatacttctttgagtttgaaagaggcttcctagactgtatttccttggtattcatttcatcatgtgcaagataaaaactacccaatttttggctgccatctttcaggtttaaagaggtactagtgttgagtccctccccaactaccaagagagcttttgtctaagcatctggcaggaaaggcagattgcattagttcacatattgcagtttgaaattaacacgtggaagagaagaaacccaagttcttttacataatgcaaagtccacattgtgaagagcatgccagtgaccacttcccgccataatgctctatttactcttgtaatatgcaacatggtccaagctctttgcttattaaatggttaaacaatagataaatacatataaccagaatgggttactaaagagctcttcagaaaaactcagaactttggagattagctgctttttgtaggaagaaagtttattttcatagctattataaaataggtgctcaatataaaaaatctggttatcactaatgccacaagccaatactattatttctgcaaagggacacctgcttatttttctcaaattaaaaaatatatatatcaaagcccagaaaaggctggagtaataaaaaattataattgattttttatcatgtaagatcttaaaaatataatttaaaatatttttactaatcattaataatgattcaataactttttctagtagaaatatcagttctgctacattttattcttccatctcacagaaagggcagaaggaattttatgcaatatgtttccagagtcgatgtgacctatttgaaaaagatggtaggaaaaagaagcctattatcggtaaatatcaaattttcccaagcagaaaaagaaaaagctagggaaattttgcagtgctgctgacctaattctatgctctttctctaaagaagcctttctgcttgtttaacaaatatttgagcatctattacacgttgagtatgcaaagatcactaagtcttactcctgaaaagaccaaggctggaagcaaaagcttgtttagaattctcttcaaagccatttgtatagtaaagaaattaaactctcatttatccaaactttcaaagtgtaaataccattaaaactttttgggaagccagtgctattctggagggtaacgatgtgggtagggaccagagtgaacttccttaataatcataacaagaagaaactatttatatgaagagattatcttgttatcctcatctactggttctatgcaaacaaagtttcttcataaggaaactaaagggaagcatagtcaaaactgctacaagttgggctggacgtggtggctcactcctgtaatcccagcactttgggaggccaaggcgagtggatcacctgaggtcaagagttagacgtgacctggtcaccagcctggccgacaaggtgaaaccccatctttactaaaagtacaaaaattagctgggcgtgctggtgcacgcccagtaatcccagctactcgggaggtcaaggcagaagaattgcttgaacacgggaggcggaagttgcagtgagctgagatggtgccattgcactccagcctgggtgacaagagcaaaactcagtctcaaaacaaacaaacaaacaaacatacacaaaaaacaaacctgctacaagtcttttccttggaaaagactcacaatgacaggaacttttatactttgtatatggaaaacatgcacatacctacctggtattgcaaataagcgtgttagtaaaaggtaaatgttacattcctttttattcctaaaattgacttttgtcttaagggaaatgttaatgtgtaacacaccctttgaagccaaaataaaaacttttcgatcaggtgtaataattgggaaaaacactccagactgaacaaaactgaattacacatacacagatattagttagtaaggtgagcaaaaaaaaaaaacaaaaaaaacaaaaaaacccaatacattttttattatagaaaaaaaaaatcacattttcaaaatttaaatatttggccgggcgcggtggctcaagcctgtaatcccagcactttgggaggctgaggagggcggatcacgaggtcaggagatcgagaccatcctggctaacatggtgaaaccccgtctctactaaaaatacaaaaaaattagccgggcgcagtggcaggcgcctgtagtctcagctattcgggaggctgaggcaggagaatggcgtgaacccgggaggcggagcttgcagtgagccgagatcgcgccactgcactccagcctgggcaacagagcaagactccgtctcaaaaaaaaaaaaaaacaaaaaacaaaatttaaatattcttattaccttagcaaaatcacaaaacagacatttgtcacttggccccaataaaagcaagatattccttttttcaacttagatacaaatagtagctatcattctaaaggtttcaataagcaaagaacaaaaaaatgccccaagacagatgcctcattgagtttgtggctgtgaacccaaataagcatgtttaaaaaatcactattctttaaaaagacagtgtcaagtaagtatcatttgagaaaattacagtttaggaactgatgctattccattagtaaatacaaatgtaaagaaatgatagtatcatcacaactttaacaaaaaccccaaacccacaaccacatcagacattatcctattgctcattatagcacttcttccataaacaaggttcatatagtaagtaacaaacctggatttccatactgagttccagattcagtaatctgtccagaaaaatcgagatgctgcccctctttgtatatcagagcccttccatactggttaagtgtaaccatttagtaaaaccactttaaatattattccaaaaactgccagcttggttggattctctactggtttatcctcaaatttaaactattcttgatcaaaaagccctactttatatgacagattaaaattaaccaaaatgtagtttaattcttttaagcgcagtgcttcaacacagtaagtactgaatacttaaaatactcgattcaaactggaaaatcaagcttgagttgttcataacctttcatcatggttgtgagtgttcaaaatttaccttcaagaattcaatgcaggaagaggtttcatagttgtgacgccagagttttctgcatggttgactcattacattaacattatagcggctaatcctgagaagagtactatttctacaatgagtatcctattacatctctcttacctaaagtatgtaaaattcctttatccacagatgtacatttaagataaccagctatagagctactacaaatattctaaccataagtaaaacagtaacacaattagtttatattttcaattaatataaaatacaatactaaagtctgttatttttaacaaaactgaactgtttcataatcattgttgcaattattttacatacacgtatctataattgtcttaacatctttttagtcatgacaccatgaagacttttaaatttggaacacacaatgtttagaaggaaaagaaaaaccaaacaaaaagttaagagtaatgtaactgatactcatagggaccctacagtataatgaagccagactgaattgattctcaccagtacatcattgcagatatctcttagctccgtctcaattttctctctgtattctcgagccatctgctgttttttctcagcaccttccgtcttttgttcaatacttgagacgaccctccaagatgacctacgggctcctacaacatttttataagcaactgagagaagattcctctcctcattggataattcagctccttgctcagttacagacttcatgcaggctgccatgtcatcatatcgctcagcctgctcggccagtttggccttctgaaccagctcatttttatccatgactggatgttctgcaggggggaaaaaaggagtatttaaaatttttcccatcaaaataaacagactcaaaattatacctgtggtaaatgagttttttaaacctgaaacctaactgcctgtgaaagactgttcacatgaggaattaaaatgcagcctcacaaaaggatagtcaaaaaagggaaaaaaatttagcatactcagcatcagaggtaaacttacagccattaacacatcagtgtagcaaaacttaaaatttgttcagaagacccaaatttcacatgtcaaaattacttccaaaagctgcctcaaaaactacccctaatcttacctgatcaaaatctcaactcatttccaataccactaagtgatccaaaattaagcagcttttcttcctttagtaaaagcattgtttacagagaacatctggatttctatcatatttccagaatcataattcatatcagtttaatgtaactcacgtctttttactttcataatactcttgtcaagagtgattacattttagctttagtgttacccctaccccaaacctactagatctctgcaacaactgccagccaataatagcataacaatttgggggggaatgaccaactgtttgttttcagatattttgagtataaatccaccacaaaggatcaatatctgaccctaatgtctcaactctttatcttgttatatgtccacatgctttaaaaatatccgcaagtcatgacacttcaactcttactgtgagtactagaatatatcacattggaagtacttaatttataagtgtttccaatgtcatcgctccagttgaaatgcagaagtgctgcattttgcttctagccatcataatgtaattggatgttaccactcaagctgtcctttaccatgactacccatctaattctctttccctcgcattttagtttcctggaccttttcgatttacctcagctacatttttctggaaagatacccttttgcaagttgccgaacagcacaaagatactaatccacacagtgacaccacagaataaatgacttcagaggaaaatacacaccctgaatgaagtgcacttttaagttagaaggtgaacagaagagtccaccttggcagctggctcccgaatattaatcatcttttaccttcccagggaaatcccacaatatttttttaaccaaatgagagaacaggtcgccacattttaaacaaataattaaccactttggatgcaaggtactggctcaatacgtaaactatttaacctttatgacggcattattttcgtcaggtctctaaattactgatttttcccttaggatctcagaaacgctctctggttatttctgcttctaacaaaaaatgatttaagccagtacaaaggattctctccccaatcacttcggtacaagaggaagtggataaggtttctcacacagtaacgagtgctccaaggcctcgcctctacactgcgggcaggactcaccgcacccatttaacccttacctgacttgagacgtcggttactgtgaaacgaaaacgggcagacccggactttaaagtgcaaattctccggtccgcgtatcgcaaccacccccctccaggctccgcccaagtcggagccacggctcaagtccccgactctcctcctttgtcatggcggatctgtgtcagggagcccaacctactgcagagtgttaattcctccccccgaccggagccagagggaggagcagcccgcgcccccgcccaagccgtgggggggggggagagatggggagcgaagccgcccgaccccggggcagagacgccacagcagcccgcagaagcggaaccactaccagccccgccgcggacacaccccgctctcccacccagcgccttccccgccaccgatcagcgccggtgaccgtgtacagcgtctctaagggaccgacagctgcaggtgggggaggggacgagagccacacccagccgagcgggccaccagcggctatgctcaggctcacccgcccccaaagcaggatatgcgtccccaaaccgagcgcagggaccctccagttctagtccatcaagcacgggagccgactgcgggctcaccaccctgttctctaccccgacctggacttgcagcccccgtccacacctcccccgcccgttcacaaggagcaaaaaaagtcagacccatcccccacccccaccaggaaaattcaagtccttcctcccaccgcggagcccaggaaattcagctctaggtcccaggcgagccccaccccaaaacctcaccccgcagtggactcccctcccgccggcgcgcagcctcgccccggtctacctggcgggcgccgccgcgccaggcctgggctccggcccgctctcggccaggcctttccctcgcgcttgggtccccgaggcccccggcccctccccgccgcgccaccgcctcccggggtgggggagggccgggtcccgccgccgcagcgcccagcgcggaggctgcgcgagggggagggaaaggagggggcggccgagggagaggggagggggcggcctcacctgcgccactgcgatgcccgccgccgccgccgccgagtcattatctcgggcggaagcgagaagggcggcgagggagggggtggaagcccgcagagacaagggtggggatggatcgcggccggcggcgccccggccatgcctcgtccaccttcgggagccggcgacagggagatccccagggatctcgcgtgtgggcgccctacccacccccgggggcaggacgggggagcgagcaccgatcggcgccggggcgtcgatgcggaagcaaggagccggaggcggccgctagccgccctcccgagcccagcggaagaggagccgccgcccgtgtccgctgaggagactccgcctcagcccggcgccgccaccgcggggcgagtggggatgaggggacggagcgaggacggctcccacgcgttcggaaggctggcctgggacaggaagcgaggcgcggcggcggccgggttcctcacctgtgtccggagtgggtggtggcggcggacggacgggctcagcagtctctgggcggcggcggcggcagcagcggcgaggctgagactctgtccctggatctcgctgctcacaggctacagccgctccgcagacacggggtttcctccaatcaccagccccggcagcaggggcaccacacgcacgatgacgtcaaacgctgc

SEQ ID NO: 2174 - DNA, 26293 bp, Homo sapiens
  source 1..26293: mol_type = genomic DNA
aataggttagtttcagacaagcctgcttgccggagctcagcagacaccaggccttccgggcaggcctggcccaccgtgggcctcagagctgctgctggggcattcaggtaagcggctgtcctcgggccttctgcctgtgtcctgccaccagggccaccccagggggctctgggagacctggcagaggatgaaccccccccatccatgagtgagaaaccctggcggggtgtgacatcctcccccggggtgtgtgcggagagtgtgagcggcagggcctccctctcaggctgggggcttgggctgcagggaaatccaaaccggctttgtaagccccgattcctcacccagaaccggctctccattggcattgggaccagagaccccgcaagtggcctgtttgcctggacatccacctgtacgtccccaggtaagtggtgcctgggtggagtggcacctggccaccgtctccatggtgggctgtgtctggaggaggaagacagaatattaactgggagtcaggaggttgctgggaggaccaggagagctggaggactgggctgggtggtgactggctggagatggaggcagacggggcttgtggccacgctgagggaagcagctccccctccagaggcttggccgagcggggctgttcaggggacacggtgaggcctgctcagtccctgggctcctgctgggccctgtttggctgcatccttggctctcggaggcagagaaacctccagagaaagcgcatgtgcactctgtgaagatgagggggctgctcaccagggccgtgagctccatcagcagaatgctgtgattcctgtgaggagtccagggcaggcttgagccacttgtaggcgagctcaggttagaggaagacctggagagagaaagagcaaaacaccgagttctcctcaactgctgtgtgttctcggcaagttgcttggcctctctgacctcagtttgtgcatctgttaaatgcacatgcagatatgggcacctggcaggcgcctggttcctgactgttggcgagaggctgggaaatgtgtcccaggtaggaagcatccccgacaggaaggaacaggagttcatgaggtgagcagctcgagatgattcattactctcgtcttggttggaacagtaggcagacaggaggtgtttaataatgccttgctgagagatcagggtcagggactcctaaggtgccacctgtgaagctgcctcctgctgaatccagagcttccttttcctcttcacacctgccctccatcctcagccccactgccctggcagtgttgcgggggtggtgttgatgtgcacactctggagcctgggggcctggcttcacattctggctctgccactcaccagctgtgtgactggaccagtcaccgcatctctctgtgcttccctcccagggctctcgggaggataaagagagtgactgtatccacactgcccggcacatacaggtgctgcagaaaggtctcactaaaaccctcattatcctcactagctctgggtggcctcgggctctggactccacagttcctgtatgctctccggggctgcagcacccagaccaccccgtgctgaccactccctgccccaccccaaggtacagggttaaggcagccattctcatcagagccaattttacctcctcccgtctccctgggacagttgatagtgcctggagacagtttgggttgtgacccagcgggtgttactggcatccagcatgtccaggacaggaatcctgtgaacagcctacaaggcccaggacagtcccaccctgttccattgtctctatcagcccctatcctcctgactcacaccgccttttcccatctcccttttacagtcacagagcctgaggcccagagagggaccgctgcttgctgaggtcacacaggcagtggaggccggagttgggggcctcactggaggggcggtggaagggcattgttcaatcaacagacacttggagagtgtgctgggttggggaatctgaccctgaccccgcaccagcccagctctccagggtctcctaatagacatttgctggagtggttagtgctggctgctgcattggacagacctgagttcaaatcctggtggccccttgcaggctgcatgttctgagagtgacattgacctctccgagcctcagtttctttagctgaggagtgggataacagttcccaccaaatgtagttgtggtgagaattagaataaatggctaatgctcgcaaagggtagtgcagtccccagcacagaggctgttgtgattgtccttacacacttgacaaatatttgtggggaggaagcaggagcttccatagaaaacaagacagagccgtgggccctgcctcggggagctcagcctggtgagggactgaggagcagagacagaggccatcagggctgtgatgtgggaggatggggaccctggaagcctaggggaggtgcctgacccaggctggggagggggcagggctcatggaatgcttctgggaggatgggacaacggaggaggcctgaagccggaggcccagtagaaggatgcagcgcagttctgggctgagggaatagcctgtggccaggatcctcaggatgggcccctcctctcccgccatcctccacccaaggaagcccctgtggcccctcaccccttcccaggtgtcaggttccaccggtgctcagaggcatccccacccatcccagtggactgcagacctttgtaggtacctggtatattgagcacctcctctgtgccatgctggtataggtaggagaacaagacaaaggctccactcccgtggtgcttacattctggcagggacaaaggtactatgtcaccaatagatacaatatcatcttttaggtggtgaagaacaacaaagctgggtcagggctagagagagaaggagaggctattttggagagggaggtcagggaaggcctcctggaggaggtgacttaggcagagacctgaataaagtggaaggtgttggaggaagagtctccaggcagagggaacagacagtacaaaggccctgaggctgcaccatgcctggtttgtccgagggacctgaacgaataacatgaggaggcccgtgtggctggaggggagtgagtggcggggggtggtgatgggcatcatgaagggccttgggggccaccctgaggacttgcattttcaccccgagtgaggtgggagcctagagggcttcaagcagagaagaggatgtgatggcatgacgggggccagcaagtctcaccccagggagtccctgcagccccagtgctggacaccttcactggccctgctttccggaggaggtctggcgagcttcactcgctgctgaggctgcactgtgaccatgtggtgggtccacgattccatgatttgaatccaatccctgcagtcaggaaagacatatgaaggaggagcctgcagccatggctaactgcggctgtgtggctcatggcgtcaccaagctggcgtgtgctgacgaccagtgcctatgctgcctctgttggtgggcacaggcggcccgagcacagctgggggattaaggagcagggaacatggcttcagagggacttagggtctcaggtgaggactaggggttcagagagagagagccaggagctggagtgggaacagggtggtgggggggcagtaggaggaggtggggcggtgaggggctggggccctgctcctgcagagccttggatggggacatgtcaagcctctggctggggggacatgcggagcctctggctggggagacatgcggagcctctggctggggggacatgcggagcctctgagcctctggctggggtgacatgtggagcctctggctggggggacacgaggagcctctgagcctctggctggggggacacgtggagcctctggctggggggacatgtggagcttgtgctgctcctgcccgctcccaccaggtccagtggctttggtgtgatacctctgctctgacgatgggcatgtaatgggggcttctgatgcccagggaatgttctgtgaaacagtagaccttcaaggctttgctgaataggtgtgggaattaagtgacgctgaaagaggtccttccatgtggtcttctcggagcctttaatgtgcttttcacagcatttgaaactgtatttgaccccttgactcttttttcctttgaagcatgtttggggaatctgatctctctggaacagctgtaatctagcactgcctttacccagggaggctgggtgaatggtgggattccaggcaggtccttctgaccaggctccaaggcttcctcccatcatcctcccagggcctgggctgtgagtgtggggcaggtgccccgtggctgctctgctgtgatctctgtgctgtgatccaggggctgtaagttctgggaaggccaaactaggatctctgaactgtgagctcaagaggaagctgactggggtcagcctagggagaaccataggccaggcttggggaatgaacaggctcactggggactgagggacgcggctcctaacccaagtcctgtccgtcgggatggcccaggcaggtcgagggctggggtgggtctcatggtgggtgtgtcttctgggagggccacgagtctgcagggacacagctgagaacagaaacatttgatcccctgcctggggtctggggtcaccccggggagctctagatcggtgcagctcactgacagcagacactccggctagccgctgcgtggcaaatgctcccacctcttgcccccggacttttcatctctgccacctctgcccaccttctctggcctccccagcatctctggccatggggtccctgggaacttgggccccatgttttactagtgaggacagtccagaaaggccccaggggtggaagaggaggcgcccaccacccgacctgtgtgtgtggggtggtgcttgtgattaccgttgtccttgtgggcagtgggacagggaagctgggacgcagccgagatgcacaggaagagagcctgcctctgggactccttagcctcgggtcatggatggcagccctgggctgggcactgagcctccctcatctcctcttctgccctaacccacttctagctacccaggctgcacctgcggccacgtggggaggagcttctcaaactgtgttggcgacagtttcctgccacagcttcctgccccagagaccagctttgctactctgcacccatggtccttggacaagccctcagttttctgcctcatcctgcatcctcatgctttatgggagtggctccatgagtcttcaaggatgggctggctgggttggagaagatggaggggagagggaagggtgcactaggtggagggtgctgtgtggatgaaagtatgaacatccatttgaaggaaggcaagtagcacagctcagctggggcagagggctggggagatccaatgcagtagccattagggtcttgagcaagggaggccttggggaagaattgccaaggagcaacttgcagactctggggctcagctctgtggaaatagactgtgaggttcagccagccacaggcagcatgagcatgccatctggatcttaggttggttgtattaatggaaacagttggtggagatcaaaggagatgatgccagcaccaaccgacctcagtcgggcgagagatctgggctctgggagaggtgggtgtggcagcatgtacagctactgacaggatgacccaagtaaggggacgggggtgggggaaggagagtgagcaggatggtcagagggcagaggcaagccagggagtttgtgaaggaccagagaggtctgtggggctcaagcaggagggaggagtcataggtgtcggccattcagggggcccaggattgaggaggtcacagagtgcttgtctggtgcctacagactgccaggggtgctatcagtgctggagaacagcctggggggggggcgcagaccaggtctggctgagaggctgggagtcaaggacatagggacaggagtgtagacagcccttaatcacttttcctattttcattagcatttttagtgtccattgtgtctgtatcttccagttcctttcccccttaattaaaaatttggggtataatttacatgcaataaaatttttatatcattttagtgaaaaattctgagatttgacaaatgcatacagcccagagactaccaccacatcaatcaagatacagactattcccccaaattccgtcctgccctctgtcgtcactccttctccggcccccagcacccagcaacctctggtgcgttttccgtccctatagttgtgtgtggaatcacacaattcgtagcccttggaacctggtttctttcatccagcctgaggcctttgcgatgcgtttgcggaactgcgtgtctccgtatgctgttccacttaccgcggagtagaattccactgtaggcatgtcccacagtgtatcttattcatctgttgggaaacatgtaagttattcctaatttttggcaactgtggctagtacggctataaatgttcctgtgtaggtttttgtgtgaatgtaaatttccatttctttagagtgaatacctaggagccttcatgggtttttttgttttgttttgttttgttttgttttgagatggagttttgctctgttgcccaggctggagtgaagtggtgcgatctcggctcactgcaacttccacctcctgggttcaagcgattctcctgcctcagcctcctgaggagctgggactacaggcgcccaccaccacgcccgactaatttttttgtatttttaatagagacggggtttcaccatgttcgccaggctagtctcaaactcctgactttaggtgatccgcctgcctcggcctcccaaagtgtgggccaccgggcccagccattaatttttgtatcttaatggagacggggtttcaccatgttggccaggctggtctcagactgctggccccatgtgatccacccgccttgatctcccaaagtgctgggattacaagcgtgagccacttcgcccagccgcttcatgactttttaaaaacactcttgtggaatggtgacctttttctccaggtggagccacaaatgcagtcccttatgaatctctggaacacccacctgtctgtaactgttgggacatccaggacccccctcaagcttggccctcccaacctcactgtcacaatcaatcgggttacagtgcagatcctggcccctcctctagctactctgacccagacttcacctgattcccattccagtaccttcctttcagctccagagcccatctctggacacccagggcagagggagctttcacaaaagcattcattttaccccttggttgcatttgcataactaagaagggcactcaaagtcaattctccaatgcaaacttatgcctgagtagccttgctgggcctatgttagtagagaaacaactcagaaccgctatggagaggtattttttcccaacattctatgaaaacttacaaatatgcagaaaatagaaagaattaactgtacaccaataactcacctgctagattctccagtttatgatttgctataattgctttatcacatacagttgatcaacactgcggagttcttatttgtgagtttgcctacttgttaaatttatctgaaaccctaaaaccaacatggcacttttgtggtcattctcagacatacagagtggcaaaaatatgaatcactcgatacacattttcccaccgaggctgcacaaggcaaacactctcatgctgcagataagtgtctttttcatgttctttttttttgagacagagtctcactctgtcgcccaggctggagtgcaatggcgtgacctcagctcactgcaagctctgcctcctgggttcatgtcattcttctgccttggcctcccgagtagctgggactacaggcgcccgccaccatggctggctgatttttttttttttttttttttttttgtatttttagtagagacagggtttcactgtgttagccaggatggtcttggtctcctgaccttgtgatccacccgcctcggcctcccataatgctggattagaggcgtgagccaccgcagccggccaatctttttcatgttctatttggtggtgccacatattttgtttttttattttatcttttttttttttgagattgctgtctcgcactgtcgccccagctggagtgcagtggcagtggcgcgatctcagctcactgcaacctccgcctcccaggttcaagcaattctgcttcagcctcccgagtagctggaattacaggcacctgccaccatgcccggctaattttttgtatttttagtagagacggggtttcactgtgttggccaagatggtctcgaatgcctgaccttgtgatccacctgccttggcctcccaaagtgctgggattacaggcgtgagccaccacgctcggcctattttatctttttaaagacagagtttcgcgcttgttgcccaggctggagtgcagtggcctgatctcggctcaatggaatctccgcctcttgggttcacgaggttctcctgcctcagcctcccaagtagctgggattacaggtgcccgccaccacctctggctaattttttgtatttatggtggagacggggtttcaccatgttagccaggctggtctcgaactgctggtctcaagtgatccacccgccttggcctcccaaagtgctggatgacaggcatgagccgttgcactcggcctcacatattttgaatgtttgtgctttttgttggtgatttcagtggttgacatggcccccaaccatagtgctgaaatgctatctagcattcctaagggcaagaatgctgtatgtgccttatggagaaaacatgtcagataagcttatagttatagtgctgttggctaagagttcaatgttagtgaatcaaccatgtctattaaataaggtgcctttaaacagaaactcacaaaaaaacaaggttatgtcttgatcagttgatgaaaatgtaaacagtttcctaggaacctaactctgtatttcccctaggagggatagttctatattgctaattcagtgttttcgttgactttatagaactgcagagaatgacagaaatcaactgtgtctatctggctgtctatccttttatccatccctctcgctctgttcgtccatcggtcagtgttatttttgggatgctctcaaattagattacagtcctcagttcccatcactcctaaacatttctgcaagcagatcgttacctagggttcaatattttatgtttcttttttaattgagggagggcaaatacaatggaatgaacacatcttaagtgtacattctcttagttttcggaaaatcagacacttgcataacccaagccctgtgaatatacaggacgtcaccatcaccccagaaagttgagggcaggcaattttaagttatctgccttaccagatatccatctgtctaaatagccttaattcctcctcccctcaatcacacgttttgtttaatagctgtatcagagttcactttgagattaaaccctaatgcatttaaccagtcccctagggatggatattccaattagcgtatgctctgtagaaacttgccaaggaaggcagagggcagggcgaggggtgcctgctaaggccgaggggaaagggtcagcggaagggacaagggaggctgaggggtagggcccttgggtgagcaaagctgggtgcggcctcagggcctctgcgcatgcagtcctctctgcctgatgcgctgtcccgcgcgctttttgaaaagttggctcctcctccttcagctctcccttcaaatgctagctccttggagaaggtgaccatcctagctagagccacctcttctctctcttaatgtcactccacttatttcctttgtaatgctgacctcaatctgtaattattatttttgtttctttctcagtttatctcacggctctccctccttagagtgttgccttcgggaggacggggtgggaccgcgcctgcctcaagcgtgcatatccccagcaccgggcctgaaacacaataattcagcacgtggttgggacatgaagagatgggtacaggtgtgggtgcttggggaccagttggcgtgcttgggcgtccacataatgtctctggaaagtcagatgggggtttgggacttctcgatctgtgcccagcaggctgcggcttctctccaggttgactctggcacagagcaggctctgcccccttggcgagctcagtctgcggcactgatgccctccacttggcgtctctcgcgccgtctttgggcccaacgcaccaggttcaggaaggccctgacgtgcctccgaccctctgtgaacccgcaggtttcgggaggcccaggggcgatgccagaccccgcggcgcacctgcccttcttctacggcagcatctcgcgtgccgaggccgaggagcacctgaagctggcgggcatggcggacgggctcttcctgctgcgccagtgcctgcgctcgctgggcggctatgtgctgtcgctcgtgcacgatgtgcgcttccaccactttcccatcgagcgccagctcaacggcacctacgccattgccggcggcaaagcgcactgtggaccggcagagctctgcgagttctactcgcgcgaccccgacgggctgccctgcaacctgcgcaagccgtgcaaccggccgtcgggcctcgagccgcagccgggggtcttcgactgcctgcgagacgccatggtgcgtgactacgtgcgccagacgtggaagctggaggtgagagcgcagcctggggcgcggggtctggaggggcgtggccgaagaggggcagtcgagggttttggggggataggagggaggaaaaggtcgtcttccccattcagtcccctttggaagctggagaggtggggcactggttggggaagaacctgaaaggaggcctcagaggcaggggctccgtggtggcggtcgccttccgcaggctgagcgatgctatggtgctctactatgccagatgggaaggtagagggacgcactgggccgggcgaaggcgaggcttggaatgggggcggggctgagaggagggtgcgcggggctagggtgagcccttagggtagggtggctgttggggaagatgggcagtagtcgtccacagcctgagtgacaccaccatgcacaactacctgaattaggtcttcaagctggagatgcgcttggggccgcgctggaaggtgggggtggttcctccctagctggattggggaggggaccacggagatggcgcggaggtagtcctcgaaaacctgcctaacacgcgctagggacgcctgggtggggtggggagtcctctgggacagggctcccggaagggggttcctgtggcgagcacttggccacacctacagacctcctcgcctctccttttctagggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacggcaagttcctgtatgtggggcccgggatttgggtgcggtgaggattggggctcgttggcagggatcctggggactggggcagacgtgagtgtgcagttgggccgtaagggtgtccctgtgctcacatgtgcaagtgggttgtgtgtttctgatgtgcaaagggacttgcacatggggaagtagaggtagtgactaggaaagcctccagactcggtcccttggcctggcttggaatcccgcttccgccacctgctggctgtggcccttgggcaagtagcggactgtggttgcctgcctcagtttcccctccttcaatcaacaaatatttactgaatacctactgtgtaccaggcactgagcacacggcagtgagccaaaaagacacagtgcctgtcctcatggggcaggtagacaagaaaaggaatcaataaaatagagaccctgtcagatggtggtaagcgccgtgtgtgcaggtggggaggcggttgcaattttagattaggtggtcagaagaggccttcctgagaaggtgacttctgaggaagggaaagaagctgaggagtgagctgtgcagctttcagggggaagggtgttcctggaaaatgcaatggcaagtgcaaagatcaggaggcaggagtctatttggcgtgttccagaaacattgtggaggccatgtgcctggagctgagtaagtgagggggagaatgggaggaggtgagggcagggcggggactttagcttttcccccaagtgaggtgggatccccgggagagtgttgaagcagccccctctaactgtcctgtggttgacagcagtacctcccctcaggatcctctatgaggattacatgaattaatacgtgtgaatcgagagtatggtaactgacataggaaaaatgcggtaaatgttagcttttatatgtgggtgaacgtgcgtgtctgagccacagctgaggccatgtagctatttgtgagtttgttaatgtgaaaaaaatctctgaaaatctctttttaaaactctgctgagtgtttgacagccctgctggggctgttgctctctggtttggacacgggatcttttctgtaacagatggtatccaggtgcagctgaggtcactcaggcctcaagacacagataaattggtgctgcctctttcccatgacctcaggaagcccagtgttttcccccaagaaatctgtggggacaattcttgggccttccttctcgtgagtgcttcttggcctgagcccctgcccagcagatcccttgggtcatctgcctcccccagggctgtttcctctcctgaggtcaacccacttggaggaaatgaccacatcccttgattttcctcacccatgtgaagtttctgtagattgcctgcaggcctcttgcaagatgcagctccctctccaagattctgttgtgggctgataaaataactcttttcaccctaccatacagattcagatttaggctgtaaattggagtggagtttccaaggcttctgagggagctcttagatacatgttgcacgtaatactcagttgccggcacaacttctgaacaggacagggctgttttctctaagaggaaacctttgcatttgtatcagttagcttttgctacataacaagcagccctaagatttattggctcaaaatgacagtttattgctcttcatgattctgtgagctaactaagcagttctggtttgggtcatctaggctgggcctgaataggctgggatggccacactcacatgactggccattggctcagtgtcacctgggtgatggggatgagctggcccagtgcagccatcatccagcaagctagctgaagcttgtttgtgtggtggtggtgcagggttcccaagatcagtcagagaggacagggcaagttcaagcctttgtttgtgtaatgtcactgatgtcctaatggacaaagcaagtcatacgaccaaaaccaaagtcactgtagggaagggattccttaagggagaggaatgcagggagccatttttgcaaacggttggtcgtaggattggatgaagcaagttgtcgtgaaggtatgggcattgtgaacatgggtgttgggggctgtctctctttccttttggactgtcagcctgagggcagggcctgccctgctgcatctggagggctccatcttgcagtacatggtgatggctggtccaggtattacccaccttcctccagatgttgcatcaccccaccccaggtgtgaccctcgccaagatgttagtaatgtttgctcccacgttctcacatgctcatatccccctcgtccattacatgctaccccaggtgcctgagagtccaggggctctccccaggctggacacgcgaagaaggctctaaacccttcctattgatgtagctgattctttccttccgtctctgctttctctttcataaaatgtaaattcatctgtcttctttgattttataatctgagtttcttctctgttttccccctacatccccaatgtagcttttcatccccaccatctctgcctctcttctgtctcagttttcctttcttcttctctctttccctccccacccccatctctcttcctcatcttgcactcacacacacacatacaggtcatgattctgccactccaatggcttaaaaatttcccccagattccctaaagcctcctgagagtggcagaggattctagggggtgggagagtgagagaagggttgagcaggtgggatttgggcccctgttccagcttgaatgacgacagccgctcagctttgatctgtttgctatcttaggcttccacacacaatgttgtgtggcagaggtttcactgcccaaaggaaaagttcaaacagtttttgtgtaacacagcagagctcatgacaggcttagagtcaaccagtctgctgagattagaggagtctcaggagagccagggccaacagctttaagcagctgtctgtgcattgcatatcaaactggcgtgcagtctcccaggcaaataggacaagcgttggcggtgggagggtgtggctaggaaggagagatgcccagcatctgggcacagcatagagcgtgtggctggcagtgaggtccacagctggcacagtggtatgaggacaatgactcattctgggtaaacgtcaagagacgaagcagctacaaagagccaggctcctggaaaattaggcaaggtacgctttggacagaaactgtgagagcttcttcttgtggttcctgtagtctataactgctttctcagggcttggggtgtgagagaaagacacgtgctactcaggcctagagtgaagaccaggaccacgcctaccattgatcacagttcatggttgccgaagaacagatttaattgtacccagggctgtgcactgccaatgctggcttgtttctgtgttattggcagcaattttatggaaccggctgattcgactttaaaagaaacttgtcctggaaagggcctttaagagagtacattgtcaagtgtttctttttttgagacagagtcttgctctgtcacccaggctggagcacagtggtgcaatcttcgctcactgcaacctctgcctcccgggtttagtgattcttctgcctcagcctccctgagtagctgggactataggcgtgcaccaccacgcttggctaatttttgtattttcagtagagacagggttttgccatgttggccaggctggtctcgaactcctgacctcaggtgatccacccgccttggcctcccaaattgctgggatcacaggcgtgagccaccgcgcctggcctgtcaagtgtttcttatcctctcctggactgcagacctctttggaatcctactgactgctcctttcacaatcccccaaagcatattcacctcaaagactttgcagacagttatatgagatcatggttggtcctgaacctcgtccttagaacccttttcaggtcaagaagttatgatttagaccagttacctcattttatacataaggaaaccgaggcacagcgaggataagcagtttattcagggtttcacagataatctgtgacagagctgggtgttagtcctaggtagcaattaactgtagagtcagaaatgcatttgaatcctggctccccctcctatctcttaccaactctgcaatttaggcaagatacataatcttgtgcctcagtttcctcatctgcaaaatggagataacaatagtgcctactttgtggggagtgctgtgattataggacaaatatgtgaggaatttagaaccaatatcttaataaataaattgtagcccttttgttttgttttgtttacaatcgtgaaccagagacagatgtagctcttataggttctatgtattattttaagagcagagatacaagttgattttttagcctgtacttctggcttaagtgcaagttccaactgcaagaacaaagaactgccactacctagcatttttttttttttttgtaaatcaagtagaacttatggtactgaaatatatgtggtgataacaccaatgtcttagcttttgtggttattatctgggaatttgcagctgctctttatgaactcacacatctctttccaaagagtgtattggttagcttttgctgtgtaacaatgtgctgtattcataccctgaaatgtagtggcttaaaacaatggtcatttacagccaagtgtgatggctcacacctgtaatcccagcactttgggaagctgaggcaggcggatcgtctaatgtcgggagtttgagaccagcctggccaacatggtgaaaccctgtctctactaaaaatacaaaaattagctgggcatgatggtgggtgcctgtaatcccagctacttgggaggctgaggcaagagaatcacttgaacccaggaggtggaggttgcagtgagccaaggttgcaccattgtactccagcctgggcaacaagagcaaaactctgtcccaaacaaacaaacaaacaccgatcatttattcactcttgttttgcttggcaatttggctggttgcttggtaatttgggctgagttcagctgggtgcctcttctgctgggtttttgagcttactcatgtggccacagccagctggaagattggctggagctggatggtctctgggatggcctcactcacatgaatggctattggccactcatgtagggtgccttggttctcctccatgggccttctctagcaggctagcttggactcattcccatggtatttggagagctgccaggaaaagcaagagagggcaggccaacctcaatgttcaaccatttttcaagcctctgcttgtgtcatgtttgctaatgtcctgttagcaaggcacatggtcaagccctgattcagaagacagaggaggaggccccacctattgatgggaagagctccctaatattgtggctgttttcccccagtattccacatggaagtttaaataaacaaataaggaggaaattattagttctagaagaaagaatgaaagagacagacagacttggtggctcacgcctgtaatcccagcactttgggaggccgaggcaggtggatcacgaggtcagaagattgagaccatcctatctaacacagtgaaaccccatctctactaaaaatacaaaaaattagctgggcgtggtggtgtgcacctgcagtcccagctacttgggaggctgaggcaggagaatggcatggacccaggaggcagagcttgcagtgagccgagatcacgccactgcactccagcccgggctgtggagcgagactcggtctcaaaaaaaaaaaaaaaaaaaaagagacagaggaggggagatgggaggtttgctgtttgctggtgagtggcttggcatggagtctctgttgtcagtttaaaacttcaggttgtgacccttaggaggtgttttcacttctcacagtccctggagaccatcacctccaggccagcctgccacctgcctctgacttccacagctctgagacccccagggccaatagccctccctcctcactggaaagctgcacttaacaggagcttgtgccagtgactcaaaatagaaatgttttgtgggagatgttgactggtgtcactgcggggtttcacgtgacggcgctgcatctgctgtcccagcctactgtctctgtgggatgtttgtttcctaatttgtggtgggttctcttccttgcccttttgtgtgccctcattgcccccgccctgatttcccatctctccatgttatctccagactgttgtgggctagcctgggaactgccccacccttcactgcactgtacttcggggaacgtgctgtccaggaatggagaggatggtcacagctgcacctctctccctcactcaggggacatttcctaaggaagggccttattgcaaggtgggcccatggctgccttgctcactgccatatccctgcgctgagaacagtgcctggcctgtcagtaaagacttgtccagtgaatgaacatccacaggcagggccaggcctggtctgagaatttgcaccttggagggtgcagctcgcaggccatcacaagggctcttctgtagtgcagtgcaatccctgagatcaggagtcggctgcttccggcctccacagcttccacggggccagctgccctccctcctcactgtaaagctacacttgaccctgcaatagaggcttgtgccagtgaccccagacaaaactgttgtgtgggggatgctgactggtgtcactgtggggcttcatgcgagggtgccggtgtctgacactaagttggtctgtgttgaggggggatgtgtgtactcagggctggagcggatggggggacagtttcttaccccacaaatgcaccacctttgaggggctcaattcccatcatagacatggaagatttatatatttatattgacaaaattccagcagaaggcaatcgagggtctcattctaggaaaggtccatctattatggaactggtcagtctcgtgatgagaaagtgacttgttttgatttgcacaggggtgccctgtaagcttgtcatggagctgcgcctacctgtgtgggtctgtgtggaaaaggctttctctccccaggagaatggtgctaggtctacctgttgaaggctctgggtctgttgtagaaggccaagtgccccccatggttggctgactgtatggccgagtgtacccccaatgagtgcctgtggatgactatctctctgtggatggcaagtgtctggccgtggatggccaactgttcagccatgggggaccaggtgttccccagtggatgggtgtcccctcctccgtggctgggtgtccaccgtggggggtcaggtattccccgtgaatggccatctgttggctcttggagaacagtgcattttcctgggaacacagccatggcccctccaccgccctctgccacttggcccatcatcagcagatctggaggtgatgggggcctggcctggcttccccagtccctgcagcttctctgcaaggctctgaggtgtggagcccatagggtgtgttgcgggggaaccggggcacagcaggaggcccccaggtggctctaggggttacatcccctcccttcccctgccaggctgaggccgcggaaggagcagggcacatacgccctgtccctcatctatgggaagacggtgtaccactacctcatcagccaagacaaggcgggcaagtactgcattcccgagggcaccaagtttgacacgctctggcaggtaggctgcccgtgcaacttgttctgggagatgccgtgctcagatggggtgccgggctctggggaggagaggagcctctctgctagctgcctgctccctgcagctggtggagtatctgaagctgaaggcggacgggctcatctactgcctgaaggaggcctgccccaacagcagtgccagcaacgcctcaggtgacggcagcaggcgggcgggcggtgggcgggggcggcaggagacctggcccccagccctcactgtcccttctgctcccccaggggctgctgctcccacactcccagcccacccatccacgttgactcatgtgagttgggggcacctggagtgtggccttggggatggagctggggagtggctgtgggggaggctgggatggaggctggggtgcctgtggagcggaagaagctctctctccactgtctctgggagtcctcagtggatataggtctcatgagaggggctggacgtccccagctcaggccttgctgaccctgtggcctttagcctcagagacgaatcgacaccctcaactcagatggatacacccctgagccaggtgagcgggcagaggtggggacgcgggttggggctcatgctgagccgagatcagggtcgctgtcagggctgtggggtttcacggggggcgctgtgggccgggccaggctgtggcagttggcttggttaacacctgtgcacacatgtgcccacacccatcacacctgcctgtgcacatgtacgtcccagtgtgtactgacgtgcagggagcacacttggccttgcctgaggctccccagacacacgtttgttgagtacctactatgtgtcagtcacgttccgaggtcactgtgtgtatgagccaccgaaccctcctgacatgccttatgaagtggctatggtgattaacctcactttacagatgagagagggaggggtctgtctatggggatgtgaggcagtggtagaggcgggatgtgaacccacgatgggccccagagctcacattcctaaaatggtctgctgcgggtgctcctgtttctcatgggtgggcccagacctgaacatgtgtatgcacagagaagacacatagttacatgtgcacctagaggctcgcttttggaggcctcgtaaatgtggctgtgtgctgcatacgcagacagggacgggcccggccataggcgtacacgtacgaatgcacacacatgcacaccccagctggcacagtaacggtgccacgtggataccaatgcacacgcccctagagtccaccctcatgtggcttcatggggcacccacagctgtggccaggagtgtatgccagtgtgtgcgtgtggatgtgcaggaacacgcatgggcacccacctgcttgtgcatgctccagggacggcacccttgtctggggcaggtgcttgtgggggctgaggctgccttgctccccacacccctgcccctgacctgggagtgtaccgctgtgtgtgcccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagtatggccgcccctgccgtggtgggagcaccgccgcctggggcagaggggagtggcttcaccgggctgtgggacgggagccgggatgtctgtctcacagcagtttgcctgggaaacagactctggggcaggacgttgcacgctggaggattccctgagagagctcgggacacctgacgggggtgggatggggcctgggcagggggaggctgtggagctgaagttcccaacccaggggagctgcagtggggtccccgatccctgagtccactggcccctgacaggctgcccctggggagggtgtcactttggattctttttggcgatgggctgttcccggtgagcgatccggctgtgagccgtcctcagcagacgctccaggctgcagggacattgagcgccttggtcccagcctgggtggcgactacagttgtctaccacacaactcaagggagaagagagatgggtgggtgggggtgtggggccgagcagggccggtgcccctcgcccacgtgcctcccgtggccgggtcgggcaggaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagaggtgagcaccgggtgggcccggccatcgggtgggtggggccggggcccatcctgggcatggtggacatgcacccgcgtgcatgcgtgtgtgggaagccggggcacttccacaccatcgtggacacactctcagcctgcacacccacacccatacccatgcctgcaaagcagagctaaccctcagtccaccattgcaccagtgcggtaataacagtgtctacctccagggcctttgcgaggatcgaatgagtcggcacctataaagggcactgctagggccgggtgcggtggctcatgcctgtaattccagcactttgggaggccaaggcgggtggatcatgaggtcaagagatccagaccatcctggccaacatggtgaaaccccgtccttactaaaaatacaaaagattagctgggcgtggtggtgggcgcctcccagctactcaggaggctgaggcaggagaatcgcttgaacccacgaggcggagcttgcagtgagccgagattgtgccactgcactccagcctggggacagagcgaaactccatctcaaaaaaataaataaataaaaataaataaagggcactgctagtaagagctttgtacacatcagctgctccccagactccctgggccaaattcatggcccctgggaaagtgcccattgccagttatctggaacctgccctttgtttacgtgctgcgtggttttctatttttaatttttttttttttaaagaaacaaaaacgaagatgtgacagagatcacttgtggcctgtaaaggctaaaatccttactatccggccctttactgaaaagttttgcagtttcatttgtggttcctcatccccaaactcttaccctcacagacacaagttctgcactccccaaggcacgtttttgctgatctgtgccctctggctggtgcacacaccttcccagtgtgcccctggctcccacattcagtcatttgacaggtgtttattggacagtttctcagtgacaggaactgttagtagcacttgggattcattagcgaataaacaaggcagagatccatgctctgtattctggttggagaagagagacagtaagtaacaatcctgatgaaatctagagcatgtgggaagatagtgtggtgggcacaagcctgccgcagctccagggggttgggagtgttggggtgcgaggtgcagtgagcagggaggtttgaacaaactgagggaggccgccatgcccagacgtggggaagggcattccaggcaaagggcaccgcctgtgcagaggccctgaggtggtcccgtgcctcgtgtggtgcgggcagggaggggatgagcagaccgtgccaggccttgcgggctgccaggaggacttggagttttaccctgagttgggtgggagctagggggtgctgtgagcagaggagggggaggacctgactcaggggcagagaggacaagacagtgggagacaggagggagcgagggcctgggcggagctgactattcctgcctgggggtccaggtgagtgatgctgcggctgcttcccggtggcagaggcagagatgaggagtgcggtggattctggagagattctgacaccagaactgccagggtttgctgatggattgggtgtgagagaaagaggagctgctggagaggacagtggaggagccatatgtgtgtgcacatggggatggggacaatcaggccacattatctttgagatgcctgtgagacctcagcacgtcgagggtgcaggcataggtctagacttgggagtcgtagcgtgtgggtgatccctaaagccttgagactggatgaaggcaggagttttgcctgttttgttcactgctgtgtccccagccccacgcctggcacacagcaggtgctcaataagcgtttttgaacacatggtcacctggctcatgcccagctgggtcagagaagcatgctttgcccctgggaacttggctagtcttctcccagctgaccccgccttccccgccaccccagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgtaagcctctgcccctgtgatgcccgactggatgggctgggtgggtagagggtccctgacccctgatccagcagcatctccccctccccaggcccgctcagcagggaagtggccgctcaagtggtacgcacccgaatgcatcaacttccgcaagttctccagccgcagcgatgtctggagctatggggtcaccatgtgggaggccttgtcctacggccagaagccctacaaggcaggcgcgggcagaggcaggtgggcggtgtggtggggagggggatgaggaggaggacactggtcactcacaggtgtctctgccccggcttgagcagaagatgaaagggccggaggtcatggccttcatcgagcagggcaagcggatggagtgcccaccagagtgtccacccgaactgtacgcactcatgagtgactgctggatctacaagtgagtgccagtggggaggggacccggctgggctgacccctggaaagtcctggtgcccgatgagttgatgtcaatataactctacccaatgtcatctcacccaaagcccttcacccagttcatagcctttgcagctgccccctacccccacacccagctctccaacacaccagggtttgctgtcctgctccagtgtgccacaccctgccatcccacctgtgggcctgtgcctcagcatctaaaacctcagccatcactcaacacatggaccctgcaacacgcaaacaggtccatactctgctactcaacctatgacactgacactcagggcatgagatgattctccagtacccaacactccagtccccaccagccagcacacagcacccaactaccagacaggtgagcactgaggtaccaaatactcatctattccagcccccacctctgcctggttgaagcccaaccttcagacatctcaactcctaacaccatcagtatcccaacttcccatcagacaacaggcaacacacccccagacaagcggacgccctagactgcccatgcaatgtgtggacactgtaacgcatgaccccccaccggccagcacttagcatgctgacaccccaacacccaagcagcccaacagatagacaccctctctggctggcccaccctcctgcgacatgtgttaattccacctccatcaggaaacacccagggcaccacaccccagtacccaaagaggctagcacctagcaccccaacacagtccatggataccccatgcacagtaccgttaatactgccgctccccgctggccagacccactgccatgctccaggcttctgctgatcaccagccttgcactccctctcatctaagccccagcacactgataccctggccccaggtgcatgcacagagcatcagctttctatatcccaggtccccgtggtcaatagttgccactctgacaccaagtccactcagtcccctgagtcctcactggtcaacgctcggtagaggggtcatcccagcaccctgtgtgtgggcagctctgcctccttaggctgtgtggcattgcccaacgctctcacaccccagagtcctctccaccacccaatgtcccgccaccccaacagccctgctgactttctgagccccaaaagtctacctcagccaagcacagtgcatgcccacccactggtgaagctgggtcctgggggcgtggtcagcagcctggatgtaccccacgccccacaggtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacgccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttg

SEQ ID NO: 2175 - DNA, 5455 bp, Homo sapiens
  source 1..5455: mol_type = genomic DNA
tgcatgctccagggacggcacccttgtctggggcaggtgcttgtgggggctgaggctgccttgctccccacacccctgcccctgacctgggagtgtaccgctgtgtgtgcccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagtatggccgcccctgccgtggtgggagcaccgccgcctggggcagaggggagtggcttcaccgggctgtgggacgggagccgggatgtctgtctcacagcagtttgcctgggaaacagactctggggcaggacgttgcacgctggaggattccctgagagagctcgggacacctgacgggggtgggatggggcctgggcagggggaggctgtggagctgaagttcccaacccaggggagctgcagtggggtccccgatccctgagtccactggcccctgacaggctgcccctggggagggtgtcactttggattctttttggcgatgggctgttcccggtgagcgatccggctgtgagccgtcctcagcagacgctccaggctgcagggacattgagcgccttggtcccagcctgggtggcgactacagttgtctaccacacaactcaagggagaagagagatgggtgggtgggggtgtggggccgagcagggccggtgcccctcgcccacgtgcctcccgtggccgggtcgggcaggaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagaggtgagcaccgggtgggcccggccatcgggtgggtggggccggggcccatcctgggcatggtggacatgcacccgcgtgcatgcgtgtgtgggaagccggggcacttccacaccatcgtggacacactctcagcctgcacacccacacccatacccatgcctgcaaagcagagctaaccctcagtccaccattgcaccagtgcggtaataacagtgtctacctccagggcctttgcgaggatcgaatgagtcggcacctataaagggcactgctagggccgggtgcggtggctcatgcctgtaattccagcactttgggaggccaaggcgggtggatcatgaggtcaagagatccagaccatcctggccaacatggtgaaaccccgtccttactaaaaatacaaaagattagctgggcgtggtggtgggcgcctcccagctactcaggaggctgaggcaggagaatcgcttgaacccacgaggcggagcttgcagtgagccgagattgtgccactgcactccagcctggggacagagcgaaactccatctcaaaaaaataaataaataaaaataaataaagggcactgctagtaagagctttgtacacatcagctgctccccagactccctgggccaaattcatggcccctgggaaagtgcccattgccagttatctggaacctgccctttgtttacgtgctgcgtggttttctatttttaatttttttttttttaaagaaacaaaaacgaagatgtgacagagatcacttgtggcctgtaaaggctaaaatccttactatccggccctttactgaaaagttttgcagtttcatttgtggttcctcatccccaaactcttaccctcacagacacaagttctgcactccccaaggcacgtttttgctgatctgtgccctctggctggtgcacacaccttcccagtgtgcccctggctcccacattcagtcatttgacaggtgtttattggacagtttctcagtgacaggaactgttagtagcacttgggattcattagcgaataaacaaggcagagatccatgctctgtattctggttggagaagagagacagtaagtaacaatcctgatgaaatctagagcatgtgggaagatagtgtggtgggcacaagcctgccgcagctccagggggttgggagtgttggggtgcgaggtgcagtgagcagggaggtttgaacaaactgagggaggccgccatgcccagacgtggggaagggcattccaggcaaagggcaccgcctgtgcagaggccctgaggtggtcccgtgcctcgtgtggtgcgggcagggaggggatgagcagaccgtgccaggccttgcgggctgccaggaggacttggagttttaccctgagttgggtgggagctagggggtgctgtgagcagaggagggggaggacctgactcaggggcagagaggacaagacagtgggagacaggagggagcgagggcctgggcggagctgactattcctgcctgggggtccaggtgagtgatgctgcggctgcttcccggtggcagaggcagagatgaggagtgcggtggattctggagagattctgacaccagaactgccagggtttgctgatggattgggtgtgagagaaagaggagctgctggagaggacagtggaggagccatatgtgtgtgcacatggggatggggacaatcaggccacattatctttgagatgcctgtgagacctcagcacgtcgagggtgcaggcataggtctagacttgggagtcgtagcgtgtgggtgatccctaaagccttgagactggatgaaggcaggagttttgcctgttttgttcactgctgtgtccccagccccacgcctggcacacagcaggtgctcaataagcgtttttgaacacatggtcacctggctcatgcccagctgggtcagagaagcatgctttgcccctgggaacttggctagtcttctcccagctgaccccgccttccccgccaccccagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgtaagcctctgcccctgtgatgcccgactggatgggctgggtgggtagagggtccctgacccctgatccagcagcatctccccctccccaggcccgctcagcagggaagtggccgctcaagtggtacgcacccgaatgcatcaacttccgcaagttctccagccgcagcgatgtctggagctatggggtcaccatgtgggaggccttgtcctacggccagaagccctacaaggcaggcgcgggcagaggcaggtgggcggtgtggtggggagggggatgaggaggaggacactggtcactcacaggtgtctctgccccggcttgagcagaagatgaaagggccggaggtcatggccttcatcgagcagggcaagcggatggagtgcccaccagagtgtccacccgaactgtacgcactcatgagtgactgctggatctacaagtgagtgccagtggggaggggacccggctgggctgacccctggaaagtcctggtgcccgatgagttgatgtcaatataactctacccaatgtcatctcacccaaagcccttcacccagttcatagcctttgcagctgccccctacccccacacccagctctccaacacaccagggtttgctgtcctgctccagtgtgccacaccctgccatcccacctgtgggcctgtgcctcagcatctaaaacctcagccatcactcaacacatggaccctgcaacacgcaaacaggtccatactctgctactcaacctatgacactgacactcagggcatgagatgattctccagtacccaacactccagtccccaccagccagcacacagcacccaactaccagacaggtgagcactgaggtaccaaatactcatctattccagcccccacctctgcctggttgaagcccaaccttcagacatctcaactcctaacaccatcagtatcccaacttcccatcagacaacaggcaacacacccccagacaagcggacgccctagactgcccatgcaatgtgtggacactgtaacgcatgaccccccaccggccagcacttagcatgctgacaccccaacacccaagcagcccaacagatagacaccctctctggctggcccaccctcctgcgacatgtgttaattccacctccatcaggaaacacccagggcaccacaccccagtacccaaagaggctagcacctagcaccccaacacagtccatggataccccatgcacagtaccgttaatactgccgctccccgctggccagacccactgccatgctccaggcttctgctgatcaccagccttgcactccctctcatctaagccccagcacactgataccctggccccaggtgcatgcacagagcatcagctttctatatcccaggtccccgtggtcaatagttgccactctgacaccaagtccactcagtcccctgagtcctcactggtcaacgctcggtagaggggtcatcccagcaccctgtgtgtgggcagctctgcctccttaggctgtgtggcattgcccaacgctctcacaccccagagtcctctccaccacccaatgtcccgccaccccaacagccctgctgactttctgagccccaaaagtctacctcagccaagcacagtgcatgcccacccactggtgaagctgggtcctgggggcgtggtcagcagcctggatgtaccccacgccccacaggtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacgccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttg

SEQ ID NO: 2176 - DNA, 20722 bp, Homo sapiens
  source 1..20722: mol_type = genomic DNA
attgttacattcccatttatgaaaacctagataagcatctataatgagaatcctaggtaagcatttataatgagaatcttttttcattcctcagcatcatttaatctgttgctcacaacatttataacacaagaaccaactgtagaaaatacagagtagaggtgagtttcaagaagcactgggcaagcacttgaataactgattttgatggtaagagctccaatcatcccaaggcagaccctcttctgggagaaaaccaaagattcaccttcaaaacgaggtgtttcaggagccccaaagcataacattctatttcctaagaaacacactctatatttctgttaaaacaatttaaaaaatggtacacatttagtagaaaatgaattgtgaaacactgcactagcaacatcatttctcaaggacacatgagaagtactttcatgttcacgacatttcttttgggtactcaagtcatttaacttttttttttgagacggagtctcgctctgtcgccaggcttgagtgcaatggcgtgatctcagctcactgcagcctccgcctcctgggttcaagtgattctcctgtctcagcctcccgagtagctgggattacaggggtacaccaccacgcccagctaatttttgtatttttagtagagatggggtttcactatgttggtcaggctgccctcgaactcctgacctcgtgatccgcccaccttggcctcccaaagtgctgggattacaggcatgagcctccacgcccggcgtcattgaacttttttattcaaaggggtagaatgtatatgtgggacaaagaaagaggctagattaacaaagctatcatttccttgtttctctttgacagctggtcaaataattcaggcatagctaggactgatgctcaagttagaaacaggtggcccatgctgtccaatatagcagccactagccacatgtgcttatcaagcatttgcactgtgtcccatgcaacaaggaactggattttaattttaataaatttaatataaatttttaaactgatacttatttcaattcttgaaaaaaacttttgtcttagctacttgatatgagaatctgttttcaactgtaagttgtatgaaatctaaatacagatcaagtatgtccaatgaacattagcatccaaatggagatgtgcagaaagtgtaaaatacacaccagatttcgaaagcttagtatgaaaaagagaatgtaaaatgtctcactaatatatttttatatgttgaaatatttggcaaatgttggattaaataaacttttattaacattttcacctgcttctttttatgtttttaaaagttgctactagaacatttaaagtgacctatgttgttcatgttatagttctcttagtgtagaggtagactgttatagagccagtgaaacttgacttataaatagctatgtaaccgtattttctgaataatcacctagctatccagagtgagtaaacactcacttacttaaatatttaatttcctggagaaaatgtggattggtgggctttgaaaagttggtaaaaactttgtgttttaagaataaaattaaacagtttaaacgagaacctgaaataatacttagggcttaacagtgtttgtaaaaaattgttatctttgctctagtcaggcctgatttaacattagtttggttgatacatataagatatatatcattttggaagttttgtgaattacatataataaaatatagcttagcaaatatgcaaccaaaatgtttttatcttctctcaaacctgaagaattctctattactctaacctccaaataacttatttgatttagggagaaatcaaggatgtctaaaacaaaacaattgatggaaaggctctattaattttagagtagattaccccctactccccatcagcattgttaatttagatatactagtgcccaccttcttttctcaaaaatcccctaccagcttacatgaaagtggtaaaagaattcaataagcttagcttgaaaacctaacccaaacataatttaatcttttgatgatgatttaaaaatcatacaattacagacacatgctggctacaaagtctctgaggctcaaagttttaagattagatgaagattagctgggtgtggtggtacatccctgtagtcccagctactagggaggctaaggtgggagggttgcttgagcccaggaattcgaggttacagtgagcaatgattgtgccactacactctggcctgggtgatacagtgagaccctgtctctaaaaaaggaaagattaggagaagatattcactttgtgggatttaactagtctgcaataaaaatgaattataagcttccatctccagaaagttatcagacacaacacgtagatcaacattttcaggagatcagttagaattcagtagagtatatataagacttaaattacactgaataaagttttatgttccagaatagtgaagaaagctttaccttcatgaaaatcaaatctcttttctgacaaaaattcagaatttagggtgaatgtcttgatccaattttgtattttaaacttaattaaaattttgatagccttctgttgaaaaatatgtaaatttatgtttctcagaaaagacgaattcagaattttaagaaatcctatgcttttggctatcttgttacatgaattttgagttaaaatactgagtttatgagtttgaatctttctgaagtgttaacacaataagcccactgtactgcataaagataaaacgttgagggttactttgtcttaggggactggaaattattaaaagggcaaattccccatacattgtgatctgtcatatttagccctgacttgtcttgtggtaacaactgtgttgcctaagaaaaataagaaaatagaacaaaccattctgcccagttcaaccaaaatgactccctttgtcctagaaaacaaaaaaacataactggggaggttggcaagaccataacctatggctgtgaacatttaaaccttacagaaaaactgagatcaatgcccccaaagaaaaactacccgagtctttatgagacattgcagattaaaatgaaaaccattcaataatattgaaatgctcaatacaaatcagtaccttagacaagacatacacacatcttgctacctggatggagggcattataaacatcagttagccatcacagctctcacagaagcatctgcaagtcaatggtgtggagagcctgatttcaagcgttcaaaatccagtcagagctggcttataagaagagcccaatcaagcagtcaaacgtgtttacaggtcagctctgctcctggccaagtggcgttggctggggcacgtggtgagtgggtggtggcggaccaggctcctgtgtcagctgcaggtgctgagctggatctgaagtacttgtagctaaatggagctcctctgtttgctcttgatgggcatgaagatgttccagtgtttccttggacagagtgatcacgtgcactggctctgtttgtgagggccccatctggctttcaatcatattgaggctctgaatgtgttctgtttgctcctgttgagctgaaagaattaaattctgcagttgctctggctgctgcgtgagcagggtaagattagcagcctggtctgcagtcatgttttgggaactctctgcagtcacaatgctgattccctggctaggaccgggcatgaaattgatgttatgtacagaatcggttacgagaagctgaatttcctgctctcccgaggtagagagttgatatggctgtagctgaagaatattcctgacctcttctgtattactactgccagaaatgctgctggcatctgaagcatgcttctccttgctatgaattttcaagtgagccttcaagttgtctaagcgagcaaactgtaagttacactcagggcaggagaaaggcttcttgccagtgtgtagaatgcagtgtctccttttggcactggagtcagagaaggatttgccacaaatgccacaggagtatggcttttctcctctgtaagaaaataaacattttatttttaaaatggaaatacctacttactacttcctgattatttagggggaagcaatcaagagtagtggaaaattaactagactgcaagtcataagtcatgggttcacctactaattcaaggacttgaagcaagtctcgcttccatgggcagtttttaatctgaaaatagggtgtgggtggtgcctgaggaagggtggcagatggggcacggctatatatgataaaattttatgattccacagtatgtatttcagataagaaaagagagtaaatatttatacaataaacatatagttctcttttgttttgtcttagttttcagagccaatttttagactctaatggcccaataagtatctatgattaatgtcaatttaaaaaatttaagcatcctctaattatttgtgatgctgtcagaagaactcctaagtccaacctggggataactgtgtaaacaaaaacatttattcagaaaacatcaaatttaatacttatttttgattgaagatttaagctttggaccaatccgtagccccaatcaaaatttaataaatgaaatcagtaatgtaaacttttactggccagaatcagcattcctttttacctaggtgaggaatttcattattgaaaagataaaacaaaataggccaggtgtggtggctcacacctgtaatcccaacactttgggaggcccaggcaggcggatcacttgaggtcaggagtctgagaccagcctggtcaacatggtgaaatcccgtctctaccaaaaaaatacaaaaactagctgggtgtggtatcccagttactcaggaggccacggtgggagaatcgcctgaactcccacctgcactccactcacaccactgcactccagcctgggcgacagtgagaccctgtctcaaaacaaacaaacaaaacaaagccaaagtaataaactgcacacaaaattctgcaaagtaacaactgggagaaaactatataggtaacacatgtcacctcactgaacagcagaactgaatgaggcctccatgcgagaaaaatatctgcaaaactttaccgatggattctgatgtgggtctgaagagaactctttgctgtgaaagatttgccacagatttcacaagtaaatggcttctcacctaaaaaaaacaaaaacaaaaacaaaaaacccaaaacaaaaaaacatttaacaatatacattcagaataagacaaaattaaaaaaacacttcggtttcacaatataaacagaacaaaggcaatcccctccgtaagcgtaaacgaatgatgcactcaccaaatatctactctgtaactaacctaagcactgtgtgccgagtgccaagagcatacacagaaatcgtaaggcatggttctcttaaaaacctgaaaactgcaacaaggaagtgagttacactgtatttactcctgttttctccccttagatattacagcacctatgctctcctgccttattgcttggctaggtagcccacttgaccctgaaaggactcctgtgtgctagggtgagttatgtattattcatgtttatatcaaccttccaaatatatccagaatctgaccactgctcagtacctccactgccactctcttgtccacaccaccaccatctcttgcctcttatggggtctccatttctgctcttgcttccctgccataaactatcaatatggccaccagagtgagccttgatgcagtcaggtcattttatgcttgggctgcaaatgttctgatgatttcccaccccaggataaaacccaaagttcttgccctacaagcgatcatagatctgtaccccataaaccctactcctcaccccaaacttcccggatctcatctcagggtgtctcccagcatggttcactctcctcatctccttcaagtctctgttcacatgttattttatcagtgaggctccatcaccaccaagagcactacaaaccttgccacgcactccttagtccaattctccaatttagtttttccacaatgctattgctgcctcatataatgtataagttatttattatccatttcttcctttttaagataacttgtgggtatgtctgctcctagtaccccagtgccgagaatctggcctggcatgccatttcagaaatccctgctgaatgaacttcatgggagtggcacacctgagatgctataactgctccagaacccaccaggcttcactaacatcagcaagtgcttattcagtgtgtttgcatgctgaacatacaatgacagactgttcatgttccccagaaacaaaattaagtaatccaatgcaggcaagaaaactaaattggaaaaaaagaaaaaaaaaaaaaaagcaagcagcaaaatccacttaactggagaacaggagaacagcaaaggataagtacaatttgaaatggaagatggtcagtgagcttccctttcacagcatctactggaaaattcaggcaagacatttctccaagctccatcgaggcagaggacagctgtaacaactcggatgaatctgcatctttgcatcatgaactcttaccactacaaagattaaaaccaggcaactgccataatctgtctatagctttctacatcagagctggggccttctctgatcttggttggttttctccctctccagattcaaagactgagtacctgctgtttgcttgtgattgtaaaattcttgttgcagttttcaggtttttaagagaaagaacagcaacaatcatccataacaacattaactataccattcagctccagctgagtttctatttcagaaagtctgtctgatggcaaatgttttttgagggtaagtgtttgcaggagcaacatcctgcagtggaagctctttgagggagtgagcaggacagtgggaaggcaaatttccctagccaaggtcaatctgcagggggtcttcccgcttagtggtttctgatctgttcccctgtgcacagctctaccaccttcaatggagacacccattccttaaatttatttagttctcaaacactgatagaccatcaataaagtacacagctaagaaacaaaaaagaaacttttctaatctacttgaggagatgcacaaactaattaagtaacatagggctgtgtttcactgaacattaaaacgagtggcgtcaacaattctgagtgcagacagggtgctggatggggtgggcaggatctggctagactggaaagaagcctgggccagggtactagtctaaatagtatgagcagaagctggtgtcagaaatgactacacggtgtgcaccagtgaccaaggatcactgtcaggagtcaggaggccaaggcaacaggagctatgaaatccaggcaggggacctgtggagcctctggaagtttttagcagaatgacatgctgaaagtactaagaaaatacacctgggaatgatgaggagggtgggctagaggcaggaggacctctaacaggctatgcacaaggcctggaccaggaggtggcaggaggcagacggagaaggataaggtaataggacagggcctgagaggcatggggaccggaaagaagtgtgttacaagaggattagacaatagcgattaaaggaaaaggcagagacaggagtgtgatgaaaggttccacccagggtgatgtcaacagaagtactgaaacagctccagggtgtacttccagaccctcttctcagcagttactacaccaatcccacccacccagggtgatgtcaacggaagtactgaaacagctccagggtgtacttccagatcctcttctcagcagttactccaccgatcccacccctacccttccccagtgacttaaatcccggaccccactccagataggatcgatgagtcactgcttattggcatcacagctggatttcccatgcccacctgctgaaacccagaataacatggggcatgacatgttaatgacaacatcacccagcccctgtccagccaggcacaacaatcacagtgacacctcccattccctcagctgtcacattcacctggcagtccagttccgtccgtgtggacccctcagcatcctgcctcccactgtggaccacggctttgtttttcttaaaaaattactgtgttcattgtaaaagaatcaaatattgaaaatacaaagaatattaaaactgctccactattctcatctcttgagacaaccagttaacaatggcgaatatctttacagacaaatctgtttatttgcggtcttactgtgtgaggtcatccaatgcatgccgtttgtcacatcagtaaagccacaccaccattttaaaaccctgtgctgtgtaccattgtgtgtactgccccaaatttacctatctaatcccctcctgggacattcaggtggctgttaagcttgttaagttataaacaatgctgcctatgatgaatatccttaggcaaacatcttttcacaattgtgcagtttatgttttggtaagtattgcaaaagttccttccagggggttcccaaattatattcccaccaacaataaataaagatgtgcatttcctcatgtacttgccaatcttggcaaaaaagggacacatgtccatgataactgtggatagcatggtttgacacctgtgtacttggcattcctatatggtcttctcagctgtttcctgtcctgtgttcacacctctgctgtggctctgaccacgccatactgtttcatagtagatggcacgtagactctgtaagggcatgttatggtgaggggcccccaggtctcaggaagatgggaagacccccaggtctcaacgttaatggatggtctcaacacacagttgaagagatttgggaagcttcaacttcaagccacaatgaggctgtgaacagaactgtgacttactgaactttatcatttgttccctgacagggccatctacctgtgagtaggaaccctcagggcagaatcagtgtttatggaacaccatccaggaacagggacactggcggggtgggactgtgctgtggggtcagaggtcactcaccaggcttctctgtgacctgggctaattcccttgacttgttcccagctcaccatgcaatcttctgatcactaacttggctttcgggtcactaatgtgaggaaggaggtgctgtgggcaacagaaaggtgtaatccctctattgagttgatatatcctctggtttatctgtcctgtgaactcatttggcttgattgggtccctgtaaacctgaccagtgccaggtatggggacaagatgtgagcagaagggcctgagatgtggtgacctggcaggtactgcttgtctgcctgacactttgcctccatgtcaaaatgtgttcacctccctcactggggatgcactcctaggaaagggaacatctctaatttgcctttgacttctccagtgcttggtgcaggacatctaacccagagagtttgtgcctaaagatctaagagatgaatgacagctcatctctaagagatgaagtcttggtttccagctgagcatggccctgagagtaggactggcacttctcactctgaatgcccagggagcagggaaatggcacgccaatgcccttcaccaacattcaagcagattctccatgctgatgctagggacagatgggtcatagttgctgctcttgaagaaccccaattttttgataggttcaatttcttttcatatttctaagtcatgcaaaccacagaggcccgtctgtctcctttttaactcatcacacatcttccactttctgttctgcttctcaaagttgacaggctgagaagagtttgctggaattatagtgggggaggtcttctgttccttttcatccccacttcaagtcctactgctactcacaaagcccagaaacctcactcccccttatgctcaggcaacagaaccaaggggaagtgcctcttctggcactgctcagcatgaccaagccagctccacgctcctccaccaccgctgtctccctagggaactcagcacagcgccacccactatttgcaggcacatgtgcacctgtggaaatccagagctctggctgcatctctcccccgaattctccagacctggaaatctaatgatctaccccacacctgcacatggatgtcaaatagacaccaaccagtccacaatctaactcctgatctgttcttcttagtcttccctagcttttcctcctcacagtggcttttgcctcctctttcaactcccacatccaatcatgagcgaatcacatgaattcttccctggactatctccagaactggaccacctgacaccacctctgctgctactgtgctgttccgagccccactactgcacagcctcctgatgggtctctctgcctccaccctggcctcgcccccacctcacagggtggctagagtgaccctattacaaccctaagtcatgccatgtcactcatctcagtaaagccatctccctcagaataaaatccaatctttactgtggccttcaaagtacttcagcccgagtgcaccctacaactgttgaggggtactttaaaaaacaccaattcccaggctctgcccaggtgaagtcaatcagaatcttggcagctgggacaaggcttttttttaaagcttcccaggtggtaaaaagcatgcagctaaattgagaacatccacctacactatgacttcctactcccagctctctggctgccttgatgctcctcccagcacgtctccagcttgtcaaaaacatttattcctgcctgagggccctgtgcccagggctccccctgcctagaatgctctctcctggacatcttcaatggccggctggctcactcccccactgcattctcatctccatccaagatgccacctcatctgtgagaccttcccaaaccagtccatgcataaaagagcaactctctttccggcatcccgcccccttaccttgcattttattcttcaacgcactcacaacaccaaatgtgttatatacttgtctgtactctgtcttccctattgaatgttggccccttaaggcaggggcctgtccatctcattcactgctgtatcctcaaagcctaaaacaatgtctggttcccagtaagtgctcagtacatgtgttaaaatccatatcctatgagatgtttactgaatttaagaagaaaaacttgtatttaaaaaacaacatccaggccaggcacagtggctcacgcctgtaatcccagcgctttgggaggctgggagggtggatcacttgagccaggagtttgagcgagaccagcctggctaacatgccaaaaccctgtctctacaaaaaaaaaacacaaaaattagccaggcgtggtggtgcgcacctgtagttccagctactcgggaggatgaagcaggagaattgcttgaacccagcaggcagaggttacagtgagccaagatagcaccactgcacaacagcctgggcgacagagacagtgactccaaaaaaaaaaaaaaaaaaagtccaaagcaccataaatcaatttgctatttagataattccagtagacaacagaattattaaataacctgtaatggcaagtttttcttagaaaactgaataggcttatttttaacatacattctttgacaaaaggtataaaagatccaattttccgatcttacataaaaaaactgacctgccctaatcaatgctgcctcctcgtcatctctgaaactgatttttctggaggtggtgctgcttaagtttaagtgttggttctaggggagaaagtggaaacattctcagtgtctatgctacatttgtgtctgttacatttggctgtcttttctaaaaaaataatcttgggccaggcacagtggctcacgcctgtaatcccagcactttgggaggccaaggtgggcagatcacaaggtcaagagatcgagaccatcctggccaacatggtaaaaccccatctctactaaaaatacaaaaaaaattagctgggcatggtagcgcacacctatagtcccagctactagggaggctgaggcaggagaatcacttgaacccgggaggcagaggttgcagtgagccaagatcgtgccactgcactgcagcctggcaacagagcgagactccgtctcaaaaaaaaaaaaaaaaatttatcttgctgggtatggtggctcatgcctgtcatctcagcattttgggaggctcagacaggaagactgcttgagcccaggagttcaagaccagcctgggcaacatagtgggacccatctctacaaaaattaaaaaataaaaaattaggtagtgtggtggtttgcacctgtggtcccagctacccaggaggctgaggtgggacgatcacctcagcccaggaggtcaaggctgtggtgagctgtgatcgtgccactacactctagcctggatgacagcacaagcccttatctttaaaaaaaaaaaaaaaaaaaagtcttgatatcaccttcaatgctgaagtaaattaagagtgaaacatagaaccagactcagactcactattctgtggtattaaatgaattgtgacatacgaatagtcctcagtaagtgatctccattttgctcatctacaagagatgtgatttccccaaagacagtgctgacaacattctgccttccaacttttaacttatcttcttacacaactcccatccaatttataataaacatttccaaacacaggcttagcagggcactcagagaacttcattcttcactctcctgaaaacatcccgtgtactggggggacagacgagatggagttttacctgtgtgtgttcgcagatgtttctttagctgagacacatccatgaatttgcgatggcagtctttgcattccggtaatgagtggccttgtcgcaacaataaaaaaagtgtcagtgcatacatgctctccctgccttttcttcagtgatttgtgttaaagcacttccctgaaaaataatcactttaaatatagtactttaaccacaaaaattttttcattaatttggtaactgttaatattttcctaagcacctcaactcactgcctcctccaagagagctaggatccttccaattctaaatgtagtctctccttttttcctcaaagtattggtgtgactgaggccacaaatgacctcaaatgacactcgtaacccacattcatttcttatcagttggcaggaaagaaaaaggacaacaggtagaaccaggggagagaaagcctgggctgacagccatgggatgatgatgtctctgcccaggcaccactaacaaccattcactgaagctcccctgtgcaagtggcacttttgaaagatgccaattctgtagggtttctgtgtgtggcaccaaaactgtagtatacaaataaaacataattcacatggtggcggacaataacataaaaacatgtaatttagactcttaaggcacttttccctaaataccctatgtgaacgatatgtgctaagagcagaacaatataaacctaatgtttcagaaacaattcttatttgcatttcttcccccccaatctaaatgttctcactttatcgtacctgtatgaactcggtaatggctctttagctgtctgttctggctgaaatattttccgcattgatcacaggtaaaagacttctgtcctgccaaaaaaaccaaaacactaaaacatgtaaaaaattataaagaactggaatgctcactaataaggtaaatactacagtgggtccaggtccccattttctacaaatgatacaagcgacttgtttacatacccagaagccttcaatctaccacagaaacataaatgtgcaaaggtatgtaaggcaatcgggagtactggagactggggtagaactggagaatttaagtttccccgaaaggcgttcaaagtaaaacaattctaaactttggtggtttaataaaacatgcttgcacactaaactcccagcagccagtttataagctctagtttaatgatccgtgcagaactctaaactgcactcagacagatgcaaaatcctgtctttcaatgacaccacgttggaaatgatactaggctgagaaaacaccatttaggtgttggtaatgcccaccctggggaatgggaatctggtgaagctggccctctgggcaagccccactacctgagtgcaggctcatgtgctccagcagtgagtgcttggtggtcagagccttgctgcacacggtgcaggtgtacggccgctcgcctgtgtgcatcctggtgtggacctgtagcgagtgcttctgggcaaagccttttccacactcattacatttgaaaggtcgctcccctggaagaagagccccagaagcatggtataagtaagaatccacacatttttctgtctctcccaaattaaaaaaacaataaaggatttttcttaaaaggcacacatccaaaaggccaacaatgaacacaagagacatcagcaataaaattttggaagctgaacagatgaatctgaagccagcagtgagtagcactaacataacctaattttttgtttttcctttgtaacagggtctcactctatcacccaggctggagtgcagtggcgctaccatagctgactatagcctcaacctcctgggaacaaatgatcttcccacttcagcctcctgagtagctgggatcacaggcatgtgccaccactacacccagctaattttttaattgtaattttaattttttttagagatgggatctcactatgttgcccaggcaggtctccaactcctgggctcaagcaatcttcctgcctcggcctcccaaattgctgggagtacaggcatgagccaccacacccagcccaatacaacctaatttttaagacacaatctcctaaggctcaggaattggtggcacctgctatctctggaaacaggggtgagggagggtaaatgaaagtctgtttcaaaggtgcttagacccctgatcaaatcttccactctacacagccaggagactgtccctcccccaaaagagaatggagagtgttcactgaggagggttaagaaaaaggggtctttggattaggagtttctaggcacagttgagttgggatcaccacagggagagtaagtcaacatttccatctgggatgatgagactcccccactccttcttccccatcctgtcctagacacaggccagcagccaggcctagtgcctccaagtgggagagcagaagcgtcttccagtggaacatgagaggtccaaggtgagagagcaaagatgtggaagccaggcaccagtaaggacatggggcacagccacaccacctccagtgaggttatgacaggcctccatacaactgtttcagtactgactgagtggttaagttaaacattaaaagccagtgcccttaaacaaaggctggaatgtaacaaaagcccaccaagagtttcccctaggcttctcctgggccttaaagcatgacaaaataacgaaggaattcttaacagggcccacttaggattaaacaagttttactggggatctgaaggaactccccaaatctccgtgatttagcagaagataagggtaatcaccccagcacctagacccatttagattaagtaaacttactgaggctccagaagaaggtctttgggacgcagaccttggatatagattaaaagaagttaatcacctacgtctttagaggaatgcacacttacagacagacatacagcttaggcggtatataagctctgaaaaattctgtaattttgagttggtctggcgataatttccaggccttctccctataactggttacagaaataaaaactctcttcctctccaattcatctgcatctcattattgggccacgagaaatagcagcctgactctcagtgtgatctgggaacaaggtcacagttttacagactctctcatacaaaaaaaattagccaggcatggtggtgcgtgcctgtaatcccagctacttgggtggctgaggcaggagaatcacttgaatccaggaggcggaggttgtggtgatcggagatcacgccattgcactccagcctgggcaacagcctaagaaataaataaaatacaggctctctccacacatgcagcattgccagtagcttttagcaacccacccttacatatgatttaaaaaaaaaacaccaggcactcaaggagagccttttgtaatagtgacagacaaacaagcaagaagaaaaaaaaaagcaacttgcctccagtgaggaaaatgttgttatcattaacatgctcatagaggtaagataatacattgtgaaataaaaagatcattcaaattaaaacatttagaaaaaaaagagctcctaaagggggaaaaaaataagagttgaaacagaaaacctcaaagggctgaaaaacaaagtggaaatcccccagagggtggggccaaaaatgatggaaaatataagagaaaataaagttagagagaacagagaaaacagagaggagaaatcatctatgaaataactcaagattttccagaactgaaagacagtttccaaaccttatgaatctacctgttatctacccagatggaagaaaacagacccatactaaagtgatgggctgcaaaattcagaatacagatgcttcctgacttatgatgggactacatctaacaaacccatcatactgaaaatatcataaggaaaaatgcacttatacagagtactgtatgaatgcaccaaatgcagagtactggtcatttacccacgtgactgtgtggcccggcatggcatgagaggatcatactgaatattactagaccgggaaaagatcaaaactcagaattcaaagtacagtttctgttgaacatgtactgctttcacactattgtaaagatgaattgaaccattgtgagtcggggactgtctgtactgaggacataagggaagaacgatcctacatgctttttcttaagtcttgtataatgatttaactctaaactatgcacataaaatttttgataaaaatagccagctgggcgcagtggcgcacgcctgtaatcccagcactttgggaggctgaggcaggcagatcacgaggtcaggagtttgagaccagcctgaccaacatggtgaaaccccgtctctactaaaaatacaaaaaattagctgggcgtggtggcgtgtgcctgtaatcccagctactcaggaggctgaggcaggagaatcacttgaactcgggaggcggaggttgcggtgagccgagatcgcgccactgcactctagcctgggtgacagagcgagaatccatctcaaaaaaaaaaaaaaaaaaaaaaaaaaagctaaaatataacctattacagttcaacaaatatttctcaagtatccactttgttcgaagtacctgaattcaagctcttcaacctatctgtagctaaagtctttagggagcttttaaaagcaccaaggctccagacaactaaatcagaagctctggggtggaggtctaggcactggtagttttagaagctccctaagtgattccaatttgcaggctgagaaccacagcaccagatactgctggatcacaggagaagacttaagccccagtccctatacttaagattacaattaagttgagggatatacaagtggtaacaacaatctgatccaaagcagagtgggttttaagcacctgaaagggctcaaaggaggaagggatttctcactaggactgcagtgtccaatacggtagccactagccacatgtggttattcaaatttaaatgaattaaaataaaatttaaaattcagtttctcagtcacgctagccacagttcaagtgctcaaaaaccacatgtggttactggccaccatattggacatcagagatgtaggaacatttccatcatcacagaagggtcccattggtcagcgctgggctagagggaccaaaaatgagaaggtatttaaagctagatagctgagttacaaagtgatctacacagacttgggcaaaagcatggttatggtcaagatgaagaatgttcaagaatcagaaagcagggtacattgggctagatcttgataagtggacattaaaggattcattcaacaactacaaatgagaggggttcttgaaccaggctacctgggttcaatcccagctctgtcactaacgggtgactctggcaagttatttaagctccctagaacttggttgcttcatctgtaaactatgcactttagcaaccctctcttacatatgagtaaatatgattttaatcatacaatgtataatgaggatattacccaccttgcaggattgtggagaaaattaactgcaataacatgtataaaggctttattacaatgcccatcacacagaagttgcacagtaaatggaagctattattatcatcactactcccaattctgcaacacactgcaatcagctttgaaaacatcattacctgtgtggctcctctggtggattgctaaaaagtgattgtacttaaagaccttgccacagtctttacagcgggcctcagggcctccagggcgctttctccttccacagatcctcttggctgaaccatggtcctcttgatccccaacaagtttgtaatctttaagtttgacggatctccaaatcctccgcttgctgtatcgactctggcttgcctggccatcctcggtcttgggatcatagttctcatctttttcaactggcatttcctcctctctacttggctcacaagtaggctccgattcttccttttcttttgctgcaatttgctcattcagtacaccactgtctcctttaaccacaaagttttgtctattctgaactgaattgttcactcttaactgtatttcttcctctgcagccagttctgatttctcctcctgcaatgtattgactttttttggtcttccccgtttccgctttggaggatcgtttttcttattagagataacaaccactggggcaccagcagtgttcaaagttgttggctttggggagctatgattattttggaagtctgtgtaagcctttaccaggtcatagacttttaagaactgagcagtagccaggatttgttctgtacttttctcactggcatggagataacctgtgtagataaattccagcaggataccaaaggtgtctgcaaccatgccttccagcatataaatggattggccgatttccccctcttctgcaaacatcattgagaagtattcactactggcagcaagtaaggctttgtgggcccggaaatgtacattctccacgattaaagtaatgtcacagaggaagcctttcttcctctgatcctcaaaactggccagcacagtgtcactgtgagcgtctgagtgtacaacaagctgcccagaaggctctggcgatgtttctgccattttcttcagaagccactaagggttaaatctgaaataagaaaacaaggtttaaaaaggagaaagcactgtctaaaaggttaatgccagcccacatgaacttcctattcacttcacatcattaactgaattttaccattaccatttttgtctgtctacaaacttagctctgggcccgggcgcagtggcctcacgcctgtaatcccagcactttgggaggccgaggccgacggatcacttgagaccagcctgggcaacatggagagaattcatctatacaaaaaatacaaaaattagcctggcgtggtggcgcccgcctgtggtcccagctactcaggaggctgcggcaggagcatcacctgagcctgggagttcgaggttgccgtgagccgtgatcgtgccactgcactccagcctgggcgacagaacgagaccaccacctcaaaaaacaaaaacaaaacaacttagctcgcggttttttttttttgagacggagtctcgctctatcgcccaggctggagtgcagtggcgcaatctcggctcactgcaacctccgcctcccaggttcaagcaattctctccctcagcctcctgccgcacattaactagctgagtgactctccagtattcatggaacggttcagggtctaccttctataaaatgaaggaatgggattaaccatctccaaaatcctccgcaagcacgaactttctatggttgcacaactatttcagggagaacgaagctgcctccatctcccagattattagccatttcgtatgtgggaaccaatgtgaagagtgaagaaatgtgcacgtgcaaagtgaatgtgaggtagctgcaataaaatactaataacttaagctgcgtggggccgccagacacactaggggcggcgcggagccccccgcagccccgggtggtcccagcagggagaggtggcgcggaaagacccccacctccccgcccaggccccgcgggcccgactggggagcacacggcgggggaggggtcggcgcggcagacctaccgctcaggggcgcccggtggggtccgggtcgctgccaactcacccggcggcctggcgggagacccacgccggggcccgctggccctccgctccgccccgcccgcctctggggcttctgcgccgcaccggtttctgctcctgcgccgccgccgcagccacagccacagccaacccggaagcgcg

SEQ ID NO: 2177 - DNA, 2289 bp, Homo sapiens
  source 1..2289: mol_type = genomic DNA
taacatgtataaaggctttattacaatgcccatcacacagaagttgcacagtaaatggaagctattattatcatcactactcccaattctgcaacacactgcaatcagctttgaaaacatcattacctgtgtggctcctctggtggattgctaaaaagtgattgtacttaaagaccttgccacagtctttacagcgggcctcagggcctccagggcgctttctccttccacagatcctcttggctgaaccatggtcctcttgatccccaacaagtttgtaatctttaagtttgacggatctccaaatcctccgcttgctgtatcgactctggcttgcctggccatcctcggtcttgggatcatagttctcatctttttcaactggcatttcctcctctctacttggctcacaagtaggctccgattcttccttttcttttgctgcaatttgctcattcagtacaccactgtctcctttaaccacaaagttttgtctattctgaactgaattgttcactcttaactgtatttcttcctctgcagccagttctgatttctcctcctgcaatgtattgactttttttggtcttccccgtttccgctttggaggatcgtttttcttattagagataacaaccactggggcaccagcagtgttcaaagttgttggctttggggagctatgattattttggaagtctgtgtaagcctttaccaggtcatagacttttaagaactgagcagtagccaggatttgttctgtacttttctcactggcatggagataacctgtgtagataaattccagcaggataccaaaggtgtctgcaaccatgccttccagcatataaatggattggccgatttccccctcttctgcaaacatcattgagaagtattcactactggcagcaagtaaggctttgtgggcccggaaatgtacattctccacgattaaagtaatgtcacagaggaagcctttcttcctctgatcctcaaaactggccagcacagtgtcactgtgagcgtctgagtgtacaacaagctgcccagaaggctctggcgatgtttctgccattttcttcagaagccactaagggttaaatctgaaataagaaaacaaggtttaaaaaggagaaagcactgtctaaaaggttaatgccagcccacatgaacttcctattcacttcacatcattaactgaattttaccattaccatttttgtctgtctacaaacttagctctgggcccgggcgcagtggcctcacgcctgtaatcccagcactttgggaggccgaggccgacggatcacttgagaccagcctgggcaacatggagagaattcatctatacaaaaaatacaaaaattagcctggcgtggtggcgcccgcctgtggtcccagctactcaggaggctgcggcaggagcatcacctgagcctgggagttcgaggttgccgtgagccgtgatcgtgccactgcactccagcctgggcgacagaacgagaccaccacctcaaaaaacaaaaacaaaacaacttagctcgcggttttttttttttgagacggagtctcgctctatcgcccaggctggagtgcagtggcgcaatctcggctcactgcaacctccgcctcccaggttcaagcaattctctccctcagcctcctgccgcacattaactagctgagtgactctccagtattcatggaacggttcagggtctaccttctataaaatgaaggaatgggattaaccatctccaaaatcctccgcaagcacgaactttctatggttgcacaactatttcagggagaacgaagctgcctccatctcccagattattagccatttcgtatgtgggaaccaatgtgaagagtgaagaaatgtgcacgtgcaaagtgaatgtgaggtagctgcaataaaatactaataacttaagctgcgtggggccgccagacacactaggggcggcgcggagccccccgcagccccgggtggtcccagcagggagaggtggcgcggaaagacccccacctccccgcccaggccccgcgggcccgactggggagcacacggcgggggaggggtcggcgcggcagacctaccgctcaggggcgcccggtggggtccgggtcgctgccaactcacccggcggcctggcgggagacccacgccggggcccgctggccctccgctccgccccgcccgcctctggggcttctgcgccgcaccggtttctgctcctgcgccgccgccgcagccacagccacagccaacccggaagcgcg

SEQ ID NO: 2178-2199 - skipped (22 entries)

SEQ ID NO: 2200 - DNA, 56510 bp, Homo sapiens
  source 1..56510: mol_type = genomic DNA
cagaagaagtcaatgagagaacatgtgtggacttgagttatattcttccaacaaaacagaaaattttatatatatatatatatatatacatatatatatatatatatatatatgaatgtattgtactaaaaataaaagataccccaaaacacaactttaaaaacatttaaatatcaagaatatgctgaaacttttgtactcagtatgatctattgtgagttctgaaaatcagtatgctactctaaacacataaaaatacagagagtggaatgggatccagacacaccggtttgttttcatacaaccttatgtaattaagttgggtactggaaagcaaaggacaacagaaaattttagagacatggaccctgagagttactcattaatgattcatctgtatgtggaagaaactcacctattttccagtgtttaattttaaaattagtgttctcattttaagaagagtatgtgggataagagtattttgaccatttgtggggggggggaaaaaaaccttgccatgccaaacagcaggattttcacgagatgagtgtgccagatgtttattttcaacttgaaatcaacccagttcctatcttcattttcttctgcattgcagaagatcagcctgaaactacagtttctgaagttcctttctccatagcttgcttctcccttagattcccccatgagatgtacttaaagaagacttggaagaagagaaagacaagggattatctggtagcagctgctggtagcagctgagatcaccaacagtagctttctttgattctggacgttttgctgagaaacatccactgcagcaccatagataattagtgagggcatcactaagactcttgaacatcagaattttctggaaatagcatttttgacctttgttccctcagttcttccaatagttgcagaagcctttcgttccctttatggaaactctctttactcaaaaaatgagaaataaagtaaattaatgttttatgttacttttgcattcagtccattactgtgcctaaataaaattgtaccagtacatatcaggcaatcaaatccacagatgattgtgaaaccactaactggaattattgaagcattttgtaaaactctctgaactttgatatttactaaatgaccttaaagcccctagcttcatggtagtgcacttaaattcagaaccacacttggtaactaataatgaaagatttcaaaccccaaacagtgcaactgaaacttttgtattagcatactactgagaatatctaacatgttgttactaatcaatgtcattctgaccttgtgggtttcctgtgctaatggacaaggtaagttaaaagagatctaaacactcagcttccctcttaaatgtaacttcatgtaatatctagctttgtatgtctataattattttatgaatcaaagaggatttattcactatgctagtagaagtgacatattttgtgagagtataacagaaattaattttataaaaaattatctcattttaacttaaagaaaaaatgaataatgttttatttgttttctaagttctacagtgtaaaaggcatttaatattgattatggagatatgtgaatatactcatgaaactttaagtaggaaacatgtcattagacagattctaagcttaaaatgttcagaattttcctatacgtaatacaaggggaacattgggagtgactgatgttttcataatcttacatatggtgatttttatagatttatatatcaaaaaatcaaataatacattttaaattatgcagtttcttatatttctattatagcttaagaaagctgctaaaactaattaacattaatatcaacttactacgtcaacaaaattagcaacatacatatataatgaaaaaatagaatataaacttacattggaaagatagtaagttttgattggcatttctgagttcactagcaaatgttcaataagtaaatatacagaaaatacttttcatagcgttatgtcattgttcactgatttctcctagatagtcatatattttctgtattaattatctttttgaatgcaggccttgcatattaaagaactatatggtaacattagcagtggaaccacatgggtcaaaaatcatggacaatcaagggtgtgtgtccattaatgaagaatacaaattttgtaattatccaaaacttcatatttcagccaatgtaatggagggtaatactggaaatcccattatcaatttatgagactatcttttccctcaaccactcttcgcgaagctatgccactttatttgattctagggaaagagctttaagttttatagtattatctatcacatgatttgctagttttatttgttgcgcaaaatcaaacttgatctgtgccaaaatggaaaaaaaaaggaatttcaccagttatttccttttttaactgaactgttacaggtacatttcttcaaataaagactaaatagattaaagtagaatgcaaagaagaaaatactactattttgaaatgactggaattagagaagcatatgcactatattttcttacttactttcttaaaagcactatagaaaagaatgatgacaaattctttcttatctgatattccagtggaaaacttgcctcctccaatgaactctttgtaagagtaaacttgagcaaaatgtcttgtaaatttgggttgcacctatatttctcaaaggagaaagtaactcatttagtggaataacatcttgggtagagagaaacatctttgtgaattcagtagcattggctcaactgcatcccgccaaaattcatttgttaaagtccaaattcccaatacctgagaatgtgactgcatttggagaaggagtgcttagcgatgtaattaagttaaaggtcaatgattcaggtgggtcctactccaatataactggtgtccatataagaagagaaaataagaacacaccgtatagggaaagatcacgcaaggcatagagagaaaacaaccatttacaaggcaaaggaggaggtctcagaagcatccaatcctgttgacagctatatctcaaactagtagcctccagaactgtgagaaaataaatttctatgaaatcagtagtactttgttatggtagctctagcagatgaatactatgatatttacacaatgtattaaaagaatattaataattaaaaataactttttactttttactcaaggatatatatatatatatacccaccaacacagattttagagggtattcatcagaattgggtaattatatcttgggtgtattgtccttgctgatttttgtcttgttgaatactttgtgtttacatattatctgtattcatctatattcagaatctagtaaatcgaatcagcaaatatttttcatatgattaatgaaggatatactttgtgagttgcttatgctaagaatttttttttaatggtggttgatgtttcagttctgaacaataaaatcagcacaccaattcttttggaagccacgctatttgaaagataaacttgacagaaaatttgtaattgcaacctattataatgttcattgaatttgtattgaccaatatttcttccatcaactcataagttatttacacttatttaaaaacaggttgtcaggaaaattatttttaatcatgaatatcctttcagaattgtataaactttatattcatctactagagttgccataacaaagtgtcaagggtgacaattagtaatgtagagtagggttgcctctaaattccttttaaactgatcattttcagtacccaatgcattacagttaattgccattgtacttctttgggacgctcaaatttatttcaagtttaactaagaagctggcttctgtgtatatttcacgtgtccccattacactttggcataacaaaaggtcccaggatttccttgacttttcctactacagaccaagttccaataatttccctatgaaattccagtgccttttagtgggagaaacgattttcagaaacaaacctaaactatgaaaaactcactacagtttcgaaattatcactgactaagaaaagtaatttttggtcgagccggggggctcctgccttaatcccagcactttcgggggccaaggcgcgcggatcacttgaggtcaggagttggagaccagcccggccaacatgatggaacgctgtctctactaacaattcaaaaaattagccggagtggcggcacacacctgcaatcccagctactcaggagactgaggcaggagaataacttgaacctgggaggcagaggttgcagtgagccgagatggtgccactgtactctagccttggtgacagaacaagactgttaaaaaaaaaaaaaaaaaaaagaaaagaaagaaaaattaaaatgatttcctttaatatatgtccctttcttcttcagactaaatagcctgcaatcataagaaaatgtaagagtatctcaggaggttacacagtgcagggagatttagattttccaatatggaggagacactcagcagaaaactgtgcatccatgcttgagggactgggtcagagaagctgtcatgcgtcacccaacaagcctctggagccagttctgtaactagcaaacacttcccacaaagtaaagatgtcacttctctgaacttagtcttctcatctgcacactaaagctgttgtgccgctagcctccttcccgttctctctgatttatgatgattcaaacttaaagatttttccttagtgatattcttaagttttcccaataaataggctgtaaatattattttctatcacttgttccagaattatagaagaaacataaattatatgctatttaaattatggtattggtcaacattctatatgtctacatacatatagaatgtaagaatatatatatatttgaacattcgtgtatgcacctatttttttatgtcaataatatatctcatccgatacatgaattctaactatggtaagaatgcatgccatcgaatacaaacaaaatgccacaaaactcaagaaaatgttttatttctggagataattggtacatttctgattttttttaatgtttagagtcatatttcttgtttctcttttccaaaaaacaattattggtaatgtgtgcaccctgaactgacagctttagcataacttggtatagttctagataagctcagttcaaattaatgttgataaaacctccagaattgctaaagagaccatactacattagtagaagtagagaaagtagaatgaggttcttcttgtcctgttagctgatttgggatccattaaggattttaagtgtagaaataaaatgaccagatgaagggttattaatttatacccaggaaaacagattatacagatgagaggtcaggatcaggaaactagttatggttgctgtaattccacaagaaaatgtttgagagaaggtgatatcaaaatttatctctaatatgatttattacagtaaaaattatttatacttttttgtttgttttttattgcaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagtaagtaatcctctgaactgctacacatgtataaaactttaaaagattaaagagaggagagcacataattgattactcttgtcttatgtaacagaaatagggccaagaaatgagttgttcaagcaaaatgaccaaaatagatcttttctattatgaggagttcttgaaaatcatatgaaaaataaatatagagactttatgagaatatctatatagtttatacatattttaattatgaaaactaaagagaagtaatattaaatattgacatttcctcttgtacaacctttgttagtaattttggttcatactaagttgtacattatttttggatgtttatgcgatcttatttaaatatggtaacaataattttaatatactttttgtgcaaatttatgtttctcatttactttatttatttatcattgctatgtccttaggaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagtaagtacaccgctctgagatcccagcatgttcatgtctttctaagtaacacggacgacagtctcagacttgtctatattaactgtggcaaaatgtttttgtcaacttgttttgccaacggacctatttagttttacttttttaattgtgtgaatatacaaatttcttgataagtacatagcaaaataaatgctcctattaatgggcattagtcaagaatacagtaaaagaattagaacacaatacttgttggctaaataaagtcatattgaagcggcattaatgtctcgggtaaatacccgaggttcgtcatcttgcaccaagaagattaagtacaaatgggtattctgggatcttgtacatattctactctagaaggtttcctacagtatttattcaaatatacatttatataaacagttccttcttttttcacatgttgctaatgattggtgatgtcacattttaatatttacaagttgagtggctataaaatggtatagcattgtaatgtaaatttgcatttcttttactaccagctggatttagaatacatgttcacagtttaattggtatttaatgattctaaaatttggaaatgcagtttgatttcttttatttatctttttgggagttttggttgttattagttggaatcatcttaataattctgaaggtaaaatctcttttaattatatgtaatgcaaatgcattctctttgtggctagtattgttctttccttttttctgcattatgaacaagttgctcattttactaaataattgtcaatcttttttcatgatgaatgttttttggttctttttttatattttattattattatattttaagttttagggtacatgtgcacaatgtgcaggttagttacatatgtatacatgtgccatgctggtgtgctgcacccattaactcatcatttagcattaggtatatctcctaatactatccctcccccctccccccaccccacaacagtccccagagtgtgatgttccccttcctgtgtccatgtgttctcgttgttcagttcccacctatgagtgagaacacgtggtgtttggtgttttgtccttgtgatagtttactgagaatggtgatttccagtttcatccatgtccctacaaagaacatgaactcatcattttttatggctgcatagaattccatggtgtatatgtgccacattttcttaatccagtctatcattgttggacatttgggttggttccaagtctttgctattgtgaataatgccgcaataagcatacgtgtgcatgtgtctttatagcagcatgatttatagtcctttgggtatatacccattaatgggatggctgggtcaaatggtatttctagttctagatccctgaggaatcaccacactgtcttccacaatggttgaactagtttacagtcccaccaatggtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcgtaaatgtcttcttttgagaagcatctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcggaagctctttagtttaattagatcccatttgtcaattttggcttttgttgccattgcttttggtgttttagacatgaagtccttgcccatgcctatgtcctgaatggtaatgcctaggttttcttttagggtttttatggtgttaggtctatcatttaagtctttaatccatcttgaattaatttttgtataaggtgtaaggaagggatccagtttcagctttctacatatggctagcctgttttcccagcaacatttattaaatagggaatcctttccccattacttgtttttctcaggtttgtcaaagatcagatagttgtagatatgcagcgttatttctgagggctctgttctgttccattgatctatatctctgttttggtagcagtaccatgctgttttggttactgtagccttgtagtatagtttgaagtcacgtagtgtgatgcctccagctttgttcttttggcttaggattgacttggtgatgcgggctcttttttggttccatatgaactttaaagtacttttttccactttggtgaagaaagtcattggtagcttgatggggatggcattgaatctataaattaccttgggcagtatggccattttcatgatattgattcctcctacccatgagcatggaatgttcttccatttgtttgtatcctcttttatttccttgagcagtggtttgtggttctccttgaagaggtccttcgcgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgctaatcagctttaggagattttgggctgagacaatggggttttctagatatacaatcatgtcacctgcaaacaaggacaatttgacttcctcttttcctaattgaataccctttatttctttctcctgaaggagatccctggccagaacttccaacactatgttgaataggagtggtgagagagggcatccctgtcttgtgctgattttcaaaggaatgcttccagtttttgcccattcagtatgatattggctgtgggtttgtcatagatagttcttgttattttgagatatgtcccatcaatatctaatttattgagagtttttagcatgaagcgttgttgaattttgtcaaaggccttttctgcatctattgagataatcatgtggtttttgtctttggttctgtctatatgctggattacatttattgatttgcgtatattgaactagccttgcatccccgggatgaagaccacttgatcatggtggataagctttttgatgtgctgttggattcggtttgccagtattttattgaggatttttgtatcaatattaatcaaggatattggtctaaaattatcttttttggttgtgtctctgcctggctttggtatcaggatgatgctggcctcataaaatgagttagggaggattccctctttttctattgattggaatagtttcagaaggaatggtaccagttgctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcaaggaatttatccatttcttctagattttctagtttatttgcgcagaggtgtttgtagtattctctgatggtagtttgtatttctgtgggattggtggtgatatcccctttatcattttttattgtgtctatttgattcatctctctttttttctttattactcttgctagcagtctatcgattttgttgatcctttcaaaaaaccagctcctggattcattaattttttgacaggctttttgtgcctctatttccttcagttctcctctgattttagttatttcttgccttctgctagctttgaatgtgtttgctcttgcttttctagttcttttaattgtgatgttagggtgtcaattttggatctttcctgctttctcttgtgggcatttagtgctataaatttccctctacacactgctttgaatgtgtcccatagattctggtatgttgtgtctttgttctcgttggtttcaaagaacatctttatttctgccttcatttctttatgtacccagtagtcattcaggagcagtttgttcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaattggtgtggtgtggtgctgaaaaaaatgtatattctgtcgatttggggtggagagttctgtaaatgtctattaggtccgcttggtgcagagctgagttcaattcctgggtatccttgttgactttccatctcgttgatctgtctaatgttgacagtggtgtgttaaagtctcccattattattgtgtgggagtctaagtctctttgtaggtcactccagacttgctttatgaatctgggtgctcctgtattgggtgcatatatatctaggatagttagctcttcttgttgaattgatccctttaccattatgtaatggccttctttgtctcttttgatctttgttggtttaaagtttgtttcatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttaaatgtgaatttgatcctgtcattatgatgttagctggttattttgcttgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttatctgtaaaggattttatttctccttcacttatgaagcttagtttggctggatatgaaattctgggttgaaaattcttctctttaagaatgttgaatattggcccccactctcttctggcttgtagagtttctgctgagagatctgctattagtctgatgggcttccctttgtgggtaacccgacctttctctctggctgcccttaacattttttccttcatttcaactttggtgaatctgacaattatgtgtcttggagttgctcttctctaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggttttgttcatttctttttggtcttttttctctaaacttcccttctcgcttcatttcattcatttcatcttccatcactgataccctttcttccagatgatcacatcggctcctgaggcttctgtattcttcacgtagttctcgagccttggctttcagctccaccagctcctttaagcacttctctgtattggttattctacttatacatttgtctaaatttttttcaaatttttaacttctttgcctttggtttgaatttcctcctgtagcttggagtagtttgattgtctgaagccttcttttctcaactcgtcaaagtcattctccgtccagctttgttccgttgctggtgaggaactttgttcctttggaggaggagaggtgctctgcttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactctagaccctgtttgcctgggtatctgcagcagtggctgcagaacagcggattttcatgaaccgcgaatgctgctgtatgatggttcctctggaagttttgtctcagaggagtacccggccgtgtgaggtgtcagtctgcccctactgggtggtgcctcccagttaggctgctcgggggttggggtcagcgaccaacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcaggcccccctcccccagcctcgctgccgccttgcagtttgatctcagactgctatgctagcaatcagagagactccgtgggcataggaccctctgagccaggtgagcgatataatctcctggtgtgccgttttttaagcccgtgggaaaagcgcagtattagggtgggagtgacccgattttccaggtgccgtgtgtcacccctttctttgactaggaaagggaactccctgaccccttgtgcctcccaagtgaggcaatgccttcccctgctttggctcacgcacggtgcgctgcacccattgtcctgcacccactgtctggcactccctagtgagatgaacccagaacctcagatggaaatgcagaaatcacccgtcttctgcgtcgctcacgctgggagctgtagaccagagctgttccgatttggccatcttggctgccctctatgatatctattttttagttagtgctctgttgctttaaattaaggctcatcttcagttacagctgacttttactttttaagtaaaggggactctgaaaattgtttgtgtgtattgtttgcaatttacaaaacattccattatagaaaccgcataataattatggaataattgagacgaaagataatgggaatcttcctacaccattataggagcaactgtcctcaacaatagcctaagcccctgaaagaaaagtccctttttctcctgccataagcaccaactctatcattaatccacctaataaatattgttgtgtgtcaagcactttgtaggtattgaaaataaagctgtttacaatagaaactgaacattgtagtttagaggctggaggagattaataggaaagtaggcaagaatagatcagaaaactcatgattatgacaaatgctatattataaatatgcatcatctttaacatgatttctttttctttcagatagtaaaattggtccatttacatttgtttttgaattactaattagaaaagaacatatacattactaatatcttaaaacatatgcgttactaaaataattactaccttgtacatatacccattagtaatgtatagaacacatacattactaatatataaagaacaaatacattgctaatatattagaacttatttttgctatcttgcttgctttcttttttctgcttacatttccacatgcctctcaaacaccacgtctatatgggtttaagcacccacttaagatgacaaccattttaaattcttggagacaaaggatttacaaaattactttcttgcctatggtagcagggtgtaccgtatctttgcctgggaaatggcatttgacttaatgaggtttaagaccccttaatagtaccaaaaatactcaggttgttgcaaagtagccagaaagtcttccaaaatttcattagggactggagagtctcctagatctgcactcctcaaggactgccagagctctgttgacagtctcaaggattctttgctttcattctgcccttccctgtgttcaacatttccttcagaaattcgtggtttcctttaagaacacggatgtctaggaaacttccagttttgctgttttcaattcattaacaaatgtttcattgtttcgccatattgccatgtttttacttgttccctcctataaaagaactattcaactaatatttacttttttcttgactttttctattttaggaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattagtaagtgatttacatattcccattcagtttctgtcaacttcgttcctctctttgagatgatagtgttttacttaaaaatatagaaaacaattttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagagtatcagcaaaatatgttagttgccaataaaaactttgttgtcttccctttctttgtatttcaaaattatcagctgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgtatttttaacccaaatactgttgtataatttacatactcccaaatccacttcattttcaagggtacaattcaactatttttagtcatgagataatatggaaccttgatacataatacaacatggaagactctcaaaaatattaagctaagagagaaaaaagatacacttacaaagtgattatctcaatgttatcatgagttttgggggttatatgaattcctacatttctagaatactgttttcaatttctatacttatcaagggctctgtgtaaagaaaaaggtgtatacttcaattttactcagctttgataaatgatctactttaaaacttgtgaaataaaagacaggatgcttcataaattttatagaacttatatccaattaatataatttttatctaatatatacacccttactgttagtaaatcgttacataactacataaatggttacattaacttttaaattcacaaatttaaaagcggtttaagctccgtgacacattggactacgaatgctacgatggatatgaaatcagttatggaaacaccacaggttccatagtgtgtggtgaagatgggtagtcccatttcccaacatgttatagtaagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagaccatgaggtcaggagttcgagatcagcctgaccaacatggtgaaccccgtatctacaaaaaatacaaaaattagccaggcatgctggcatatgcctgtaatcccagctactcaggagggtgaggcaggagaatcatttgaacccgggaggcagaggttgcagtgagtggagattgcaccattgccctccagcctgggcgacagagggagaccccatctccaaaaataaaaaaataataaataaataaataaataaataaataaataaataaataaataaaacagaagaagaagaaaagaaaaagagaaaaagaaaaaaccaagaatgttcagagtcttcaatttgttaatggatacaatgagtcttcaagaatgacaaccatttattgcgcacatatgaaatatggcatctcagcttaacaccagtaatcattttcacattattaacacttaggtaaagagttttcaaacagttctgaaaacattgtttcaaaaaaccacaaactattaaaccctacttgaacacatgaaatttttcctgatagaacacatagctggttaacactgagaagttctttctctgattattattcttacttatattttatcagtattcctagcaagcaacaaagaaattaacgaaacttcagccatttccataacccattgcttttccatttttaccttattctcctcttcccttataccagaatcaaaatgaatacactaaaaacccctcaagccagtaatataggtatacttccagaattttgtcccccaagtactatgaacttgaagcaacacaactcaaaaaatataagccacaatgattatggcaacaacaagaaaacctaaaagaaaatttgccacaagtttctactagcctatgaggtagagccctgggacacccatcagtccttgaatgtcagataacctattcctatcacagctcttaaactgtaagttcatgagtttttcaagtgctcaagttcctaagtacaggatgatacaagcagttgttttctgtgatgtgactcatttcctttattttgatgctatgctaccttttacctttcatattgactgatgacgctgatattttggctgatcttacaatgggctaaaccttaattattgtcccctacttaagtatccacttctgtagatgatcatgtccaagtttgagctccaaactatgcaagtggtaagactgaagaagaaattagtatcctcaaatcaaaatagtttacaagtatcttcaaacttgatttcatagaaaagtgttaggtttcagagataaattctgagtcttaaatttgattgactgaggagatggacactcctaagatgggtttcacagcaaaagcattacctcttctcacaatcaagaacaggaaaggattataattatctgaagatataagatcagttctatgatacaagcaagactttcagtcttcaaaactaaagaagcaaagagcattcaagcacagaattctagggaaaaaggcaaccttatggaaaagattacatatacatatggcatattaaagcaatgaggaaaattttcccaggcagcaggaaactttagaaagttttggaaaatatgtttggagaagtatttagagttcaaacaatatttatttttgaattgtaaacagcccctgaatgtattgaagagctcttaaaattttttggatttcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaagtgaaaagcttgctatgtaagaactgacatttttatcatgtaagtactaggcttaatacctggggtatgggttgataggtacagcaaaccaccatggcacacatttacctatggaacaaacctgcacatcctgcacatgtaccctggaacttaaaaaaaaaattataaatttttttacaaaagaattttataaaagaaaatccatatgtggaagtaacattatcttactgattttacagatgaaggcatagtgagacagagtaatttgtccataatcatgtagggattcatattaactctgtgtgcttatccttgcctctctttaaaatagaaaatgaagatgacagggatagatgatgttgatagagagagagataactgatagatattgaggtatatttatgtatgtatgtatgtatgtatatatagtttcattttaacagatgactattagaaagattatacctttctacagttctgtttctacattgtgggcataagagaaaaatataaacatagaattaaattagcaaaatgtgagtacatttggagtgcttgtagtcacggcttgtcgaatgggggaaaggaggataagtaaccatgactccaatggaacatgttagcataatcctttttgatatgaagtcactagggtggacacaacatattttaggaaagaagagttcaggctctagagaaagactgccagggttcacgtttatcacctcacctgatgatctctgctgtgatgttggggaagtgcaactgaacttattatatttttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgtgaaaaaagaaaagaggttttgctaaccctttcagagcattgggaacacagccagaagtgcattaaatgtatatattaacttgggcaatgttgacactttaggatgctgaagccaggtgcagtggcacacgcctgtaatcctagcactttgagaggccaagctggcaatcatcagaggtcaaaagttcaagaccagcctgttcaacacggtgaaaccctgtctctactaaaaatagaaaaactagctcggcatgatggcgtgcacctgtagtcccagctactcaggaggctgaggtgggagaatcactttaaccagtggggcagaggttgaactgagccaagatagtgccactgcactccagcctgggcaatagagtgagactctgtcttaaaaataaataaataggatgctgaaaattcctatttaaggaaataattctttttctgatttatttaaggctacatttgtattttcttaatacaaatattttgaaagtttcttcatatatggttttttgcatttcttattaagttttgcttcagatttttttttgtcttttctcctgttaattgccttcactctctttctgttctgtacttttctttgtatataaggattttttgaaaagattgtatatccctgttaacaaattgaaatctctattcactttaatagatttttacccccagttagcatatggttagtgagaagttgcagggtaagaagaaaacaatgttccctttcccaacacttttcctgattatagagaaaaaagcatgaacttgtataatgatctagtcctgtacagaatgagaaatattaattgctagactgagaatgttttggtggctaaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcaaaaataattgctgatatggtttggctgtgtcccacccaattttcaccttgaattatataatcaccatgcatcaaaggtagggccaggtggagataatggaatcatgggagcagtttccccataccccactcatggtagtaaatacatctcatgagatctaatggttttataaatgaaagttcccctggacaagttctcttgcctgccaccatgtaagatgtacctttgctactcattcaccttctgtcatgatggtgaggccttcccagcaatgtggaactgtgagtccattaaacctctttcctttataaattacctagtctcaagtatgtttttattagcagtgtgagaatcaactaatacagtaaattggtattacacagtagagtggggtgctgctgtaaagataaccaaaaatgtagagtgactttggaactgggtaacagacagaggttggaacagtttggaggactcagaagaaggcaggaagatgtggggaagtttggaacttcttagagagacttgttaaatggctttgaccaaaatgctgatagtgatttggaaaatgcaatctaggctgaggtggtctcagctagagatgagaaacttgttgggaacaggagcaaggtgattgtcgctatgttatagctcagagactggtggcattttgccacttccctagagatgtggaactttgaacttgagagatgatttaaggcatctggcggaaaaaatttctgagcagcaaagcattcaagagatgacttgggtgctgttaaaagcattcaattttatatattcacaaatatatggtttggaattggaaattatgttaaaagggaagcagagcataaaagttcagaaaatttgcagcctgatgatttgatagaaaagaaaaacccattttctggggagcaatttaagctggctgcagaaatttgcacaagtaatgagaaaccaaatgttaatcaccaagacaatggggaaaatgtctccagggcatgtcagaggtctccagggcatgtcagaggtcttcaggacaacccctcccatcacaggcccagaggcctaggagaaaaaaatggttttgtgagcagggcccaggaccatgctgctttttgcagtttcaggagttggtgccctgcatcccagcaggggctaaaaggggccaacatagagctcagaccattgctttggatggtgcaagccccaagccttggtagcttccatgtgatgttgagattttggttcacagaagtcaagaattaaggtttgggaacctctgcttagatttcaaaggatgtatggaaatgcctggatgtccagcaaatgtttgctgcaggggtggggccctcatggagaacctctgctatggcagtgcagaaggaaaatgtggggtgggagcccccacacagagtccccactggggcactgcttagtggagctgtgagaagaggcccactgtactccagaccccagaatggtagttccaccgacagttagcatcgtgcacctggaaaagatgcagacaatgccatcccatggaagcagtcaggagggaagctgtaccctgcaaagccacaggggtggagttgcctaagaccatgggaacccatctgctgcatcagcgtgacctggatgtgagacatggagtcaaatgagatcatttttgagctttaagatttgactgccctgctggattttgtacttgcatgagacctgtagcccctttgttttggccaatttctcccatttggaacaggtttacttacacattgtctgcaccattgtctgtaccattgtatctaggaaataactaatttgcttttgattttacaaagggacttgccttgtctcagatgagacttgagactgtggacttttgagttaatgctgaaatgagttaagactttgagaggcttttgggaaggcataattggttctgaaatgcaaggacatgatatttgggaggggccagggtggaatgatatagtttgactctgtgtctctgctcaaatcttaccccatgttaagggcagggccatgtggagataattgaatcatggggactatttccccatattgttctcatggtagtgagtaagtctcacaaggtctgatggttttataaatgggagttcccctgcacaagccctcttgcttgtcaccatgtaagatgtgactttgctcctcatttaccttccaccatgattgtgaggcctccccagccatgtggaactgtgagtcaattaaacctcttgttttaataaattacctagtctcaggtatgtctttattagcagcatgagaacagactaatatgattgccttagtttcctaaaatggtacaaaaataaatggcaggaaaccacaactgtaggagcaacaaacaatatcatcaggaagaggaaaataaaatgtgatataaaagcatcagtggggttattaaagagtagagtatgcacctagcaaagtgaattggtgtgacagataagaaatttggtgtagtgggttttaaaagggaaaccatagaggaatgattacagagattattaatctggagaataaaccataaaaatctaagtctagggaagaaaccagtacaattgcaataagtacaatcatcaaaatgttcttacattcctttctaaacaattattcctagtgtatagcttaatgtggttccaggcaaagtgagagataaaatctcacagaaacattatctagccaattgttttttaattataagactaatgaacaaatcttacaaatctttaggcaggaaaataaaaatgactgaaaatgaaatcttagggaaaatagaatggttgttatattaaaatgtaaatatacttggtgtgatatttatcaagcaaaatagctgtttatgggccagacatagtggatcaacctgtaatcccagcactttgggatgctgaggtgaaagggttgcttgaggtcaggagtttgtgatcagcctgggagtcacagcaagatcctgtgtataaaaacaaagaaaactaattagctgggcttggtggtgcatgcctgtagtcccagctactacaggaggatgaggtgggacaattgtgccactgcactccaacccagcgacagagccagtccctgtctcaaaacgaaaataaaacaaacccccccatttattagttcattaatttgtgcctagaaaccaattgttttaacacatccattaagaatcattatatgccaagccttttatctagataggaagcacattttgaatttgaaaatactattgcttgatatgaagttaattataacttctttgaagatacaatgcaaacacaaaattcagaatacaaaagtatgtagacagtatgttgttaacaataagggaagaaaatatagcggggagattggcaggaaaaacaagacattttgattttatcactttgaggtttcttctactttacagttattttatttatttatttatttttaattttgtgggtacacagtaggtatatatatttatggggtgtatgaggtattttgatacaggcatgcaatgtgagataagcacatcatggagaatagggtatccatcccctcaagcatttatcctttgagttacaaacaacccaattacactaagttatatttaaggtatactattaaattattgttgactatagtagccttattgtgctatcaattagtaggtcttattcattcttctaattatttatttgtacctattgaaaataggtacccacctcctctctgacacccccaaccactgcctcccaccactagccccttgctacagtagcccattcatctactgtctatgtccatgagttcaattgttcttatttgtagatcccacaaataagtgagaatatgtgaagtttgtctttctgtgcctggcttatttcacttaacataatgatctccagttccatccatgttgctataagtaactagatcttattcttttttatggcagaatactactccattgtatatacataccatgtatatacatggattttcttgatccattcatctgttgatggacacttaggctgcttacaaaccttagctattgtaaacagtgcagcaacaaacatagggatgcagatgtctcttccatatactgatttcctttcttttgggtatatgccctgcagtgggattgctggatcatatggtagctcaatgtttagttttctgaggaacctccaaactgttctccatagtggttatgctaacttgcattcccaccaacagtgtacaagtgttcccttttctccatatcctcccaagcatttattactgatttttggatataagccatattaattggagttagatgatatcacactgtagtttcgatttgcatttctctgataatcaatgatattgagtaccttttcatatgcttgtttgccatttatatgtctttgtttgagaaatgtctattcaaatcttttgcacgtttttaattggattattagaatctttcctatagcgttgtttgagctccttatatattgcggttattcatgccctgtcagatgggtacttcacgaatattttctcccgttctgtgggttgtcacttctctttgttgtttcttttactgtgcagaagaagatttttaactttatgtaatcccattggttcatttgtgtttaggtttcctgtgcttatgggatattgcccccaaaatttttgaacagacctatatcctggagattctctgcaatgttttcttgtagtagtttcatagtttgaggtcttagatttaagtctgtaatctacgttgatttttttttatatggtgagacatagggtctagttacattcttctgcatatgaacatcctgttttcccagcaccatttattgaaagacagtcttttccccagtgtacattcttggcactcttgtcagaaatgagttcactgtaggtgtgtggatttacttctgtgctctctattctgttccattggtctatgtgcctgtttttatgccactattatgctgttttgattactatagttgtgtagtataatttgaagtcaggtaatatgattcctctagttttgttcttattgcttaggatagctttggctattctgggtcttttgtggttccatataaattttagaattgttttttcctacgtctgtgaagaatgttattggtattttcacagtgattgcactgaatctgtagattgctttaggtagtatggacattttaacaatgttgattcttccaatccataaacataaaatatctttccatctttttgtatccttttcaatttctttcatcaggcttttatagttttcattatagagctctttaacttctttatttaattcctaggtatttaactttatttgtggctactgtaaatgggactactttcttgatttctttttcacattgttcactgttgacgtatagaaatgctactgatttctgtatgtttatttcatacccagcaaatttaccaaatttatcagttctaatagttttctggttgagtctttaggtttttccaaatataagatcatatcatctgcaaacaaggataacttggtttctttcttcccaacttggatgccctttgtattcttctcttgcctgattgctgtagctaggacttcgtgtattatgttgaataactatgtaacagtgggcatccttgtcatgttccagtcctttgaggaaaggatttcagtttttctccattcagtatgatactaactgtgtatctgttgaatacagcttttgttactttgaggtgtgttccttctatccccagtatttgagggttttcatcatgaaggatattgaattttatcgaatgctttttcagcatcaactgaaatgatcgtatggtttttatccttcattctgttaatatgatgtatcacattgattgacttgtgtatattgcaccatccttgcatcccacaggtaaaccccatttggtcatgatgaatgatctttctaatgtattgctgaattcagtttgctagtattttgttgaggatttttgtatcgatatttattagagattttaacctgtaattttctttctcttttttgggtgtgtctttgtctaattttggcatcagggtaatactggccccatatattccgccagcatctgccatacctcagtaccatatcagaaagaaggagcctagagtattattctgtttctctgggatgttctctcacatacatgcattccctcatcattggtcacactttttgccattttctgtttactatcaatcttaaccaagcttagcatctgtggatggaagtccataggtgagctataatacccacccatagagtgcagcaatagccccttgcatcaatagcctttccagaacttccctctatgaacattcccaataagaaaaagtacagttacaaatataaaatatggcaggagtatctctaccactagtcagggggcagcatctaggcagtcttagtttagtgagagaaataatcattcctcagcccgttgtccctttagtaatgtacacttaaattcagaggacttgaagtaatgttttcagctgcaatgacttcttgtggtaaaatctacagctgtaattctaaattggtaaaaatggatctggcaaaacagaaacagtttacggggttggaaatatgtacgagctgaccattcatgacatttgccataatccatgtgtctgtacatctgtaagcattgcctttgggataaccactcaattctttcaaacttccagatatattgctttcaatgttatttaccacgaatcttgccttgtaatctagattttattatctacaaggtgattgcttcactcaaattgggacgtgctgtcagaaaaacagacagattgctttgcacaaggagaagaagaatcacagagtttagaccatttcaaaaaaggagccagaagttcttttgtggattatatcattggtcaaaaatgctggctgcaaactgcttatgaatgtaacatacaccaagagcaaccaccagtggagagttgctgcatgtgtcatttccatattattagtttttctaaactgttccatgctaattggaatgtttgtctgatattacctatgaaataataggcattttgagttttagatttattaaccacaatggtgagggctatcttcatcaaagctcagtaatgaacaaggaattgtcttttaatccccctttaaaaattcacaaataataaccatacatatttatggggtgcatagtaatgtgtgtgtgtgtttgtgtgtgtgtgtgtgtgtgtgtgagtgtatatatatatatatacacacacatatatatacacacacatatatacacacacacatatatatacatatatatatacacatatatatataatgtatagtaatcagagtaattagcatctccattatctcaaacatttatcatttctttctgttgggaacactgaatattctccttccagctatttggtactatctagtatattcttggtaactgaaaaaaaattacatctaagtgttaacctcaggtatcttgaaatgccaactcctaacagtcatagcctgggagttcatgttagccttcttgcaactatgcatatccacataattaatcaaaatcatttgtgttttggtgagaattagcatctgcaatggtgagttttatgtgtcagcttagctaggctatcaatccaagttatttaatcaaatattaatctaagtgttgctgtgaacaaggtattttatagatggagttaataacatctacaataagttgcctttaagtaaagattacccttgataatatgggcgggtcacattcaatcaattgaagcagtaagagtcaaaacttcggcttcccaaagaagaaattctaccttaagactgtaacatcaactcttctctgagtttctactctattaacctgccctgtgaattttggacttgcttatactcacaaatcaagtaaaccaattgcataaaacaaatctctatctcatctatctatacacacctcacactatacattctgtttctctggaaaacactaatacatcatcttaccacttcacatttttaagcaattaaaatctctcactatcttcccaagatttggtattacttaatattcactagagaggctggtttgaccgattataaaattcccatttaacaagaataactaagaccaggtgaagagagcccttttccaaaatctgactataagtcggtaattgaattcactaccaaattacaaaccatttatttcaaggactctgtggaaagattaatctggcaggcaccgatacttctctgttttgcaaaacagaccacatatttaatgttatttctctagtattgatggtcatttggtctttaaatcctggcgcttggaaggtaggatctgttgatgaagggtcagagtgaaggagtgccatgatttaacctgtatctccccaagtctccatcaaaacctttgtcacacatgaagccaattatatttggttcagatatttatctcaatattgctggggttgaatgttcatttgctttactttccaccatgagatgttttaatatcaccaaacttgctagcagcaaccaagaaaatgtatttctagtaatttctccatcattttgtatcacattctaaatacatatatatatatatatatatatatatatatatatatatatatatatataaaacaaactcttgagtcaaagtcatatactccaaactacactcctacaattcattccagataatcttcctctgaggattttcccttcagacaaagagtggattggtaacaccctggcaataaacatttgtcatacccttcatcctatcctccttaaatttcatggtgcctttgccatatcatgaagaaggaaagaagctcagtgtccacttctgataccactctgccactcctacactgctaagctaacagcagtgatcttgctttcagaactagcaattcacatttttacctatcattatgttaactgctgaaaattatttaacacagcattaatgtcaacagcatagtgagaattgtgactcttatgtgtagtgtctgattatcctaatcttcaccttgaattcatatgtttaagggagatgactcaatgagtgtctgtgacctctgaagttcttccatctcctttcctttattagttgatgagctccctcagctgcatcttatgaaatccagttatttattatacttattttagatgaacaacctaaaaaatgtgatttgagcacttaactcagattcttatttatcttcaatctggtgtacacctaaagattctcttgcaagaattttaacaagggtcaaattatcagtcttctatgaaattacagaaaatatcacagacttgtttttaaaacttttcttaaagaaacaggcagaaaactgtcaaaaacatgggtgagcgctaccgaggtagagaaataaaacattactctttcattagatacaattaaactttgaaaacacatttaaatatgatttctaaaataggtaagacttggttacatttgatgacaccaataaagatgaactaggtaagtaatcataatggagtacattcttaaatgcaattatttttatgacacatacgtacctcagagtggagataaattaaaatattagtatgtaatgtatcatagttactatgttttgcagattaaagatgtccacaaataatttgaaaatcctctgattaagtgacctatttccccatcatcttgaacttgtgctaacccatgacttttctgaccaataggatatggtataagtatctctatgccagttacggatgtaagctttaaaaaaatagcagcttctgccttggtgtcttgtagcttctaatcagcatgagagaattctgggtaccctgtagagaggccctgagagtgacaggagtcacctaaaccccaaatttcacttgttgctggcaaagcaccaaatatgtgactgaagacatattgaaccctccaccgcagaagattaaccagatgaataacaatgaatgtctccattaatacacagaaaataaaagatttatccatttgatccccaccaaaattctatgccccatagaattgtgagatgtcattaaatggtatattagaaaagaagaaatatctcaaaacactaacctaagttccaacttaagaaggtaggaaatcatgaatattagtgtataaatcaatgaagcaagtgcaatatagaaaaaactgttttcttaatcttctcaaagaatgaataaaaccaatcaaagttagttctttgagaagaataaatgatatatttctagcaagaacaatgaagaaaaaaagaagaaacaaattacctgtcatttggcatagtatagggcattgactgacatggttccaatagttgaagggtatacaattattttaacttctgaaatgtccaaagtgtcagggttttgtctgaaaaacacaccaaaaaaaagagaatacccaaaagagttccattattaaatggaaattttatatgaaggaaaattctacaagaaggtacagcaatggccttggtcatattcatgagcaaatacctcctctttttctgggactcactctagagactgctgaagctctgtcttaggctactgaaggaaaagtttaaagggattctccattagaacacctgctgccagaggctagatgattatcctgtctttctgatggcagttcataaatgaatggttactactctacctggaaagttgtggcagatcctcatgggtaaatataagactaaaggaattcaatagggtaaactttaatgtgttttctcgctattatggaagacattgaggacataaaaggccagatcacatgggttgataccaattcatgaccagtgattaattaatgcaaaaatagttgattcaagtacttgttgcccgagatactacctttatgggaattaaaaagacaaatcaaactgggacaagctgatgcccaccaaaataaaaactctaccaggattggaaagcgactggagtcaacaaataggtatttcggttcattacctagaagtaactacttatatacatgaaaggaatggtcacagaaggacctaaaccaacagaagcaccagaaaaggtataaattgtttaccataatggtccagtttcttagcaagataggtaagatttaaaaattcattaggacatatccactggggtgatggcccagcatacagctagtaaatagattatatttgatgttcgttcttaacaccaggaagatttaagcaagctttgaaggccactaaaacgtatttgagacttggtttttttcatggaagttaaatctaacgtatgaaaattaaataatctgaattgtttttgcccaccaagttatattcttctgatcaaggaagctattttacagcacgtgatatacaacaatgggcaaataaacaccacatcgaatatatatatcatatcctttatcttctgcagagtagtggaaatatttgaaatcattaattgaaatacctgccaaaaataaagactggggcagataggtcagtaataaaggatgaaagagctggtttacttgttttcaagttgtgcattaaaattaaacatgagataatcatgtggttttgtttttagttctggtttctgtgatgaataacatttattgattcatgtttgttgagccaaccttgcaccacaggaataaagcctacttgattgtggtgtattagcgttttgatatgctgccagattcagtttgatcagattttgttgactatttttgcatctatgttcatcaaggatattgaccagaagttttccttttcagctgtgtctctgccaggttttggcattaggtgatgctggcctcatagaatgatttaggaaggagtccctcctcctcaattttttggaatagtttcagtaggaatgataccagctcttcctttcatatctggtagaatttgcctgtgaatccgtctggtcctgggcttttgctggttggtaggcttttaattactgattcaattttggaactcatttttgcttggcttggagattgaatctaaatgtccatcaacggtagattggatttttaagatgtggtacacatttaccatggaatactgtgcagccgtaaaatatagtgagataatgtcctttgcacgaacagagatggagctggaggccgttatctaagcaaactaacacaggaacagaaaaccaaataccgtatgttgtcacttataagtgaaagctaaacactgagtacatatggataccaagaagagaacaacagatacttgagggtggaggatgggaggagagtgaagatttaacaagccaccttttgagtactatgcttattacctaagtgacaaaataatttgcacaccaaacccctctgacatgccatttacctatgtagcaaacctgcacatgtgctcctgaatctaaaataaaagtaaaacataaaattaaaataaaaagttaaacatgggagaaaccaaagatgatttactattagataaatttcctagatagagtggtagaagtaagaacgatttggggatgaaaccggcacttatctacaagtcttttcaaacacagcacaattttcttcttttctgccttaccccataatttctgagtccagtttaaaatgaacagttcttgacacatcactcatatttaaacaggagttactgtctatagtttttaatttaaatgaattcagaagggattggtgggccagatgaaggactggcaaatgacagtcatggggaactgtggcctgctgcctatttttgtagggctctgactacaatggtttttacattttgacatctttttaaaattaaagtaagaaaaatcatttgataattaaaatattcataaaatttatatgaaatttacatatttgtgtccataaagttttattggaacacaaccatgttcactagtttacgtattccccatgttacactatcagggccaacagagtagttgcaacagagatcacagaagctagaatgtcccgtcctctcacctggcctaaccgggccttcaggtggaaatgctttgttaccaagtagaggtaacaggccagtaagtttgtacatttctaatcctatcccatgtgaatgaaaataaaccaagaaagaagccttagcaagattgttatttccagtgaataggttaactccatggtcaaacctgatatttctttttggagaggaaagtttgggttaaaataagtgatagataaaaagaaggtgacataattgcctaaataagagatctaacaaatatactatttaaagggaaaaatcaaacataactttgcttctagagagtcttacagcaaaaaaataattttctctcttaccttttagtctgatgtctgttacagtgaaataccttgtctcacaaagaccctactgagaggcgacagtgtgctggcagccctcgcagccttcactcgcttttggtgcctcctcggcctcggcacccactctggccgctattgaggagcccttcagcccactgcactgtgggagcccctttctgggctggctgaggccagagctggctccctcagcttgcggggaggtgtggagtgagaggcccggagggagagacatgggcaggaacccgggctgcccacagagcttgtgggccaggaggacttccaggtgggtgtgggatctgcaggcccacacttggaatggccggccagcacagccagcccgggcagtgaggggcttagcacccaggccagcagctgcagagggtgatccgggtcccccagcagtgccagcaggccagcgcagagctcgaactctcaccaggcctcagctgcctccctgtggggcagggcttgggacctgcagccagccatgcctgagccaccccgctgccatgggctcctgtgcagccagagcctccctgacgagcactgcccgctgctccgcagcgcccgttcccattaaccgcccaagggctgaggagtgcgggtgcagggtgcaggactggcaggcagctctgcctgcagccagctgtgggatccactaggtgaagccagctgggctcctgagtctagtggggacttggcgaacctttatgtctggctaagggattgtagatacaccaatcagcactgtgtgtccagctcaaggtttgtaaatgcaccaagcagcactctgtgtctggctccaggtttgtgaatgcaccaatcagcactctgtatgtggctaatctggtggggacttggagaacctttatgtctagctaagggattgtaaataaaccaatcagcactctgtgtctagctcaaggtaaacgcaccaatcagcaccctgtcaaaacagaccaatcagctctctgtaaaacagaccaatcagctttctgtaaaatggaccaatcagcaggatgtgcgtggggccagataagggataaacgcaggctgccccagccagcagtggcaaccctcgggggtccagttctacactgttctttccctctttgcaataaatcttgctgctgctcactctttggttccacactgcatttatgagctgtaacactcactgcagaggtctgcagcttcactcttgaggccagccagtgagaccacgaacccactaagaggaacgaacaactccagatgggaggaacgaacaactccagatgggaggaacgaacaacaccagacatcccaccttaagagctgtgacactcactgaaggtctgcagcttcactcctgaagccagtgagaccacgaacccaccagaaggaagaagctccaaacgtgtgaacatcagaaggaacaaactccagatgcatcacctttaagaactgtaacactcaccgcgagggtccgcggcttcattcttgaagtcagtgagaccaagaacccactaattccagacacactaccattactaaaacaaaatgccatggatctgggaagcagcaggcttgagcaacatcattactggagtgatgtatagcatatgcttcagtgaaacaaaggaaattcaggtttctcacacacacacatgctgatgtggtttgtatctgtagaaaaaatgcatcctgtatgacccagtggtggtaggacaaagaagtctgcgtgtgagttctatggatggatccctcaacgaacaaccctctcctactgctgctgtgccctttgcctgtgatacagcctttttgtgagcataagttgtttgagtcctgtgaattccttcagcaatccaacaccaacattcttaccacctggtaagactaaacaacttaatatatataaaagcaaataaaatacttctacatgaaaactatcccaataaatgtctatgtctttcattaaatactgcttcagtcattaaataatgtatatttgtaggagtacatctgcatctctgagtttcatctgcaaaatggagatgacatttttgaaatcagaatttaattcacaaatgtatgtaaataggttttagtatactgggcatttaacaatacttataaccatatagtaagtattcaataaatcgaagctactgttatcatttatattattcaaaggaaaacagagttggtcagtagaaacctactttttctttttgcatcagcctatgtaacaagaaattttttctcctgcaacttgatcacacaggtcagcagcagtgagttaaaggcagcttatagatataacagatacaaaatcccacatataaaaactataacaatataataagcacattaatagaaaaagatgaaagacactacaagaatttagacaaaaaataaacaccctcttggaggccaggaaatagatctgaaaggagatgatatttcatgtgaggttcaaacttgcatataattttggtaggtagatgcggagaaaatcaatacttaggagaaacagaatgtgaaagaccaacaacaagataaagaaaaaacataattgggaagtttcaaaaagttagcatgactaaaactcagggtattcactgtgatgagtgatgtgaggtatggaatcagaaaagattttaagattttatagacctgacaagaagactgaactttactcagagagtgatcagggagccatggatggattttaagcaagtgagatgcatagacagacggaccacggtttcatgagcgtggagactgaattacagtcaggaagtcaggagttaacaatatagaatgttcagataggagcagcactatttgagacatcagtttctaccgtgtgtgatttgtaatatccagtacaatatctatgcaaaatgaatttgacatttattgagacataagaaatactttttttaagtatcaggtttcttacttcataaaggtgaaatactaaaatatttgagaatacaaaaatgggcatttgtagccccaataaacatcaaattcaagaagaaaattaattggaaattccatgcaaatcatgtacaataaaaaattataatattaaaaactgattcaatttactgagaaaatcagtgatgttccagtagaaaggtacaggcataaataattcatacagttaaagcaaaatagtaaacaagtaaatggaaagtgttcaaaaaatgtaaatacttttgtaaaaaacagtagaatgttttattataaaattagtaagattaaatatttaagcctatacagttatggtagaaacagtttacatatacatagtttgagtcagcataaacagatatgtataggtttataaacaacatgctagggtttaaccagaacctaaaaaaatgcaccaatattttgtcttttccttcccactactcaaaatttacgtaaataactttttaaaatattatttacaaacaatttttctgcaacttcactataaccagaaaaactgagagcactcttattacccaaaaagaaatattaaattatatgacaggagttgtaaatacttaagcttacattaaaataaaatcatattaatggttttaaatataacatgaaatgtaaaatctctatactgttcttaaatgattttaaaactatccacaaatatgcaagaaaatagaaaatccttgagagtggttgacagacaaacaagaaagatactgaagtgtaaagcttgactgttttgggaacaaaaagttatcctgattgagttgaaaaaaggctgaagaaggaaatgaaggtgttttccattagcaaccattcataaattactttcagggcaccaaacatgatataaaacatctgagagcatttttagtaaacttgcacaattctgctatgagacatatttttctaaaatggtttggtcttgagcatcagtaggaagaatatgtcctgtaagtaaaggatgggatgtataggaaggactttatggagtacagctggagaatgctggagctcttagcaacggaggaagctatggattaggtaaactcttgcatgatcagcttacatgatccctggaggaaaatagcatgagtaggacatcacaacctgttctcatttctttgctcagttagtaggtaaaagtcaagtcattatccattaaaacttatcaactgatggaacacaatgggcaccgaaaacagagaacacaaaacaaataaaaaagatgaaaataaaatgtgttgaagtttgtaaaattatacaggattttagaaataaattaatgtttgtactttatatgtgcataaataaatcaattaaaagtttttcagttttttttgagacagggtctcactctgtgctgatgtcaattccctggtctcagttattgtacttgataatacatgggagggcataatctactgaaattacttaaaataagaaacagaaaaacaaaaggaaaatctaagtttccaaattagaagaatggaagaaatattcagcaaaaaaattggaaaataattgttgagtactgcttcaaaaaagaatagacaagagaagatactgttaattcaactaaaaattggcactagctctgtgaaaattaactctgtgctcataaataaatgataacatcccctagattcagacaagccagtatttaaatgtcagagagtttagaagaagccatcaaaacattgacatggtgaagcctttcagacagaagagaaaccaggagaatgtgttgttccatagaccatgtgaagcaggtatttcaaaatggaaggatgggaaactcatgtgaatttttgctgattattcagtttcaaccaatggatttgattacaaagaagatattgatgactgttacaagagaggtttaagtgtagtggtgggaatgaaaaaatgaaatgaggcagaaattgtagctaatacattggagtcattgtattataaaatgagaagagaattgggagcttactagaaagagatttggttccacaaaggattttttgagctttttttgttgttgttgctctttaagatggaagatgtttggtattttcgcatattggcagaaataatttgaaaaatggagaaattaatgataacagttgagagggaataattgaaagagcaaaatccttgcatagaaaagaggggatcaaatctggtagagaccataacaggataggagtaaggatcaacatccagtgaaacaggagacaatgcaaaaaaggatgtgtgtgaacagcaggtagttttcttctgattgcttctatatctagatgaaaaaaataaataaagtcattagcaaagtacaaggtgaggactgatggttaaggagggagataataaaacagaggaggagaaaggaagtgtcaaaatcatttaggcctatgatcattaatttaaagcaaggcaagtcagcaccgttgcatttggttttttttttcaactcttcataatgtaaacctttatttatttatttatctttattattatgctttaagttctagggtacatgtgcacaatgtgcaagtttgctacataggtataaatgtgccatgttggtttgctgcacccatcaactcgtcatttacattaggtatttatcctaatgctatcactccccctgccccccaccccatgataggccctggtgtgtgatgtcccccgccctgtgtctaagtgttctcattgttcaattcccacctatgaatgagaacatgcggtgtttggttttctgtccttgtgatagtttgctgggaatgatggtttccagtttcatccatgtcccttcaaaggacatgaactcatcctttttatggctgcatagtattccatggtgtatatgtgccacagtttcttaatccagtctaccactgatggacatttgggctagttccaagcctttgcaattgagaatagtgccatgataaacatacgtgtgcatgtgtctttatagtagcatgatttataatcctttgggtatatatacccagtaatgggatggctgggtcaaatggtatttctagttctagatccttgaggaattgccacactgtcttccacaatggttgaactaatttacactcctagcaacagtgtaaaagtgttcctatttgtccacatcctctccagcatttggtgtttcctgacttattaatggtcgccattctaaatggtgtgagatggtatctcattgccattttgatttgcatttctctgatgaccagtgatgatgagcattttttcatgtgtctgttggctgaataaatatcttcttttgagaagagtctgttcttatcctttgcccactttttgatgggtttgtttttttcttctaaatttgttaagttctttgtagattctggctatcagccgtttatcagatgggtagattgcaaaaattttctcccattctgtaggttgcccgttcaccctgatggtagtttcttttgctgtgcacaagttcttcagtgtaattagatcccatttgtctattttggcttttgttgccattgcttttggtgttttagtgatgaagtccttgcccgtgcctatgtcctgaatggtatggcttaggttttctttttgggtttttatggttttgggtctaacatttaagtctttaatccatcttgaattaatttttgtataaggtgtaaggaagggatccagtttcagctttctatatatggctagccagttttcccaacaccatttaagaaataggaaatcctttctccatttcttgtttttctcaggtttgtcaaagatcagatggttgtagatgtgtggtgttatttctgaggcctctgttctggtccattggtctatatctctgttttggtaccggtaccatgctgtaccatgctgttttggttactgtagcatagtttgaagtcaggtagcttgaagcctccagctttgttctttttgcttaggattgctttggtaatgagggctcttttttggttccatatgaactttaaagtagtttagtccaattctgtgaagaaagacattagtagcttgatgggaatggcattgaatctataaatcaccttgggcagtatggccattttcacaatattgattcttcctatccatgagcatgaaatgttcttccatttgtttgtgtccttttttatttcgttgagcagtggatcatagttctccatgaagaggtccgtccttcacatcccttgtaagttggattcctaggtattttattctccttgtagcaattgtgagtgagagttcactcatgatttgactttctgcttgtctgttattggtgtgtaggaaagcttgtgatttttgcacattgactttgtatcctgagactttgctgaagttgcttaccagcctaaggagattttgggctgagacgatggggttttctaaatacacaatcatgtcatctgcaaacagagacaatttgacttcctcttttcctaattgaataccctttatttctttctcttgacggaaatccccggccagaacttccaaaactatgttgaataggagtggtgagagaggacatccctgtcgtgtgtcagttttcaaagggaatgcttccagtttttgcccatttagaatgatattcgctgagggtttgtcataaatagctcttattattttgagatgcattccatcaatacctagttccccgagagtttttagcatgaagggctgttgaattttgttgaaggccttttctgcatctatcgagataatcatgtggtttttgtctttggttctgtttatgtggtggagtatgtgtattgatttgcatatgtttaaccagccttgcatcctagagatgaggccgacttgatcgtggtggataagctttttgatgtgctgctggattccgtttgccagtattttattgaggattttcgcatcaatgttcatcagggatattggtctaaaattctatttttttgttgtgtctctgccaggttttggtgtcaggatgatgttggcctcataaaatgagttagggaggagtcccgctttttgtattgattggaatagtttcagaaggaatggtaccagctcctctttgtacctttggtagaattcagctgtaaatccatctgctcctggactttttttggttggtaggacattaattattgcctcaatttcagaacctgttattggtctattcagacattcaaattcttcctggtttagtcttgggaggatgtatgtgttcaggaatttatccatttcttctagattgtctagtttatttgcatagaggtgtttatagtattctctgatggtagtttgtatttctgtgggatcggtggtgatatcccctttatcattttttattgcatctatttgattcctttctcttttcttctttattagtattgctaggggtatattaattttgttgattctttcaaattttcagcttttctgctctggtttctccccatctttgtggtttttacctacctttggtctttgatgttggtgaccttcagatggggttttggtgtggatgtcctttttgttgatgttgatgctattcctttctgtttgttagttttccttctaacaatcaggtccctcagctgcaggtctgttggattttgctggaggtccactccagaccctgtttcctgggtatcaccagcagaggctgtagaatagcaaatattgcagaacagcaaatattgctgcctgatccttcctctggaagctttgtcccagaggggcacttgcctgtatgaggtgtaagtcgtcgcctactgggaggttgtctcccagttaggctacataggggtcagggacccacttgaggaggcagtctgtctgttctcagagctcaaatgccatgctgggagaaccacctcactcttcagagctgtcagacagggacgtttaaagtttgctgccttttgtttagctatgccctgcccccagaggtggggtctacagaggcagcaggcctagctgtgctgcagtgggctccacccagttcaagctttcaggccactttgtttacctactcaagcctcagcaatagcggatgcccctccccccaccaggctgttgcctcacaggttgatctcagactgctgcactagcagtcagcaaggctccgtgggtgtgggacccaccgaaccaggagcaggagagtgtctcctggtctgccgtttactaagaccctcggaaaagtgcagtatttgggcaggaatgtcccatttttcccaggtgcagtctgccatggcttcccttggctaggaaagggaaatcccctgaccccttgcacttccagggtgaggcaatgccccgcccagtttcggctccccctccatgtgctgtacccactgtccaaccagtcccaatgagatgaaccaggtacctcaattggaaatacagaaatctcccatcctctgcgctggtcacgctgggagctgcagaccagagctgttcctattcagccatcttggagcggtgaccgcatttgtttttcttgtagacacactctgctgcttcagttcagagacagggcaggcagagaatttatttgcaaaggtttgaggttttctaaaacttggattacagatagaaagaaaggaatgggcaggagagtgtgtgcaagggattgacttacagtgatgaaccattgaatctaatttgggtatggtgggaagagagaaagtgaagggaaaagaatagtgaaaaagcatcagtgtcattgaatggttggaacaaatttagtagagtaagtgagctaaaaagattgttgaaatggtctagagtgtgacactttagataatttaggtagtttaattggaaatgataaggtttagatagactagaatcaatagtggagactagtagctcacagagacttctctggtttcttgattgaacatagctatatgcattcccattgacttctgaaccaccatcagtaagtttcatcttagtggaagtccttaggctgtccctttctccaaattttgccattaaatttttgactgactggccactttgttgcttgccccagctaatatcctctacacatactaatcttctctacttgcttcccactgtaacctctttatattcaataggatccttgggcagggaattttccacgctataaagtcactcccctccagtggagcagcagagtttccagtccacacagactgcttgcctacccagggttcaacttctgagccacagaactgagctgtgagacaaaggtggataaaagcatccactcttttttactgagatttatgtggactttctggaataaatatttcccaacagtatgctctttggccaatttctagagattatttttataattttatccagttttattgctgccttttggtggtgagtgaatataccaagacccagaaatacccattctcaaagtcccatcagaacaaaattattttgaagtaaaatttgttcaacaattttgggaaccattacataccaaaaattattcttgatttgactttttatagtctaaaaatatgaaaactattaagaagttacctcattcttttttttttttttttttttttgagacggagtctcgctctgtcaccctggctggaggggagtggtgcgatctcagctcactgcgaactccgcctcccgagttcacgccattctcctgcctcagcctcccaagtagctgggactacaggcacctaccaccacgcccagctaatttttgtattttcagtagagatggggtttcaccatgttagccaggatggtctgaagttacctcattcttaataccagttttaagtggaatttataactagaacagtgatgctgttatgttaagatgaggactgatcaccttcacttgcttgcctactgatgtagctgaactcttggctagaaaaaagaaggggcttcctctttcctcttcaatggcccatttctgaatattccaaactcagagactcagggaccacaacaaggaaattgaacagcttttattttgctcaagttaatattacatgataaactcagagtattattgtgaaaacactgattagacactatttgcttattttgcacaaccctccatgaactttgatgtttaccacaaaggactttactaaactagcttccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggtaagttcaaaacagacctgaatatttagttcctttttcagatacatttatcggtttttgtgtgtatgcttacatatttttaaatgaataaatggatgaaaatattttaaatgagttataatattaatctattttatggaaatactttctaacatgcaattagcaggaaaatagaataaaattagttctctccatcctctaagttgcaaaggtaaatggccaccaaatagagaatgtaaagaggaattaaatgagggaaaacctgctatactaacggtggcaaggtgaagtattagtgtaattctgcatacactctgcaatgccactaactagaacaatcaatctcaaaaagatttggccaccttcaaaatgctttttggattttagtttcctagatttgatcatttaaattttaaaggtcattaaaatggaggaattcccatttcaattgaattatccttcaacagagggaaatatattttactgaaacaatagaaaatatcatttatatataaaccagtgaactgtcaagaaattgcttcttctgagctcttaaatgttgagaatgaagtaatgtatcacctctttattaatactacaaactgcttcttatgatattttataaacggtcccattttatttcatgttgaaattaaggccaccatatcaaaggaattgcaaacaaaatctctaccaaggtctaggatactaattaaactatgtctgtacatggagtttcgatcattatgctttaccctttgatttccaaaaagtttttactttactgtttggctgtttcctaatgtttccagacctttgaacttttatttgaacagtttctcatcagtcctgacataacagaacaacatgaacaataacatgctttcctttaaatatttgcccttagaaatgttgcaaaatattatttctattgcttgaaattcatttttttttgagatggactttcactcttgtttcccaggctggagtgcaatggtgtgatttcggctcaccacaacttccatctcctgggttcaagcaattctcctgcgtcagcctcccaagtggctaggattacaggcatgcaccacgacgcctggctaattttgtatttttagtagagatggggtttctccatgttggtcaggctggtctcgaactcccgacctcaggtgatctgcccgcctcggcctcccacagtgttgggattgcaggcataagccaccacgcctggcccttgaaattcgttttattttgttttcacttttagtgctgagttgtaatcacaggagtgtgattgtatgagtgtatttgatttttcttaagtctgtgtttatggtatttattaagtggcttatacacctattacacatggcattacatgaggatttctaaataggggggtagcagaggaaaataagtgaaaaatatgagagaaatatgtagaattttgacaattcctaaccctcctcccaccaaaaaaaagttcaagcttcaatccagtctctgggagaaacttcagtgaaattctatctaaaggttgcctagatgttaaatgatctgtaagtgtgtgttacactgtcatttaggtgtctactgagagacctgccaaacagcaaaaacaacacactgaagcaacacatttgtatacatagaaagctgcatgcttccagtagcaaaatatttatcaagcactatgttgtgcttcatgtagcaaagaagctggaagaaaatgacaaccctaaccacacctcactgcaacttacagtgtcctaaagaaaagcaaaatgtaaataggcaaataaattgcaaggctatatataggtgactgtgagtgagtgtgtgtgtgtgtgtgtgtgtgtgtgtataaacagtcatgcatcacttaatgatagggacactttctgagaagtgcgtccttaggcgatttccttcttattcaaacattatagagtggacttacacaaacctaggttttatagcctactaggtaactaggccatatggtatagcctgtcgctcctaggctgcaaacctgtacagcatgttactgtactgaatactgtgggcaactgtagcacaattgtaagtatatgtttatctcaatatagaaaagtacaataaaaatacagtataaaatattaaaaacggcagacttgtatagggcttttaccatgaatagggtgtgcaggactgaaagttactctcagtaagtcattacatgagtggtgagtgaatgtgatggcttagaacatcaccatacactactagaggtggtataaacactgtatacttaggctaaactaatttattttatttatttatttacttgaatagttttgggggagcaggtggtttttggttacatggataagttcttcagtgctaattactgagcttttgatgcacccaggatagactaaatttattttaaacttttcttcgataataaattaaccttagtttatgttaacctttttacttcatcaactttaatttttgtgtctttcgagataatatttagcttaaaaaacattgtagagatgtacaaaagattttttctttctgttcttgtgctataagcttttatcttttaaatattttacttatttatttactttttaaacctttttgttaaaaacagacacaaacacacacattaacctcggcctacaaagagtcaggatcatcagtatcactgtcttcttcccccgctcttgtcccactggaaggtcttcacggcagtaacaggcatggagctgtcctctcctatgataacaaaggtttcttctagaatagttcctgaaggacctgcctcaggaaacattaactgttttacagttaatttttttaatcaatagaagaagttaactataaaatactaataacaattatactatatgaaatacattaaccagtaacacttctatattatcatcatcaagtattacgtactgtacaaaattgtgtgtggcatatttttatgtgactggcaatgctgtaggtttgtttacccccggcattgccacaaatatgtgagtaatatattgcactgcaatgttacgatggctattaggtgataggaatttttcagctacactataatcttatgggtccactgtcatataagtgatcagtcattgaccaaaatgtcattatgtggtgaataactgtacgactgtatatatatatatatatatgtgtgtgtgtgtgtgtgtgtgtgtgtgtgtgtatcccagaagaaatgtattcacaatattctatcaaaatattgagacaataaaaattattttctacttttgaaattggtggttgtgtaaaggaggcttgcaagaagacattaacactcctagctagcaccattgcagatatgcacaatgaatacttgatgaatgtcatagaattctttctgaagcataggtacaatataaatggttgatgaaaaccaagttattctggatagcaaagaatatgtaggtacaaatgtatgaaaataaactactataattttggaggagtgaaggataattgaaagagttatggtaggttaatactatcaagacgggagtctttccctcaacacctttaccaaaactatctaatgtcaaattttaaacagttagataatcaatttcaggtttcacaaggtgaaaatatttcaaatattgtgcaacattaaacattacttctagatagatgaaaaagagaaatttctcttgatttgtcagcttaatttctgcacacatctttcaaataaggtgaaaaataaaattatttcttatgcagcagtactatattgcaaaaatatcttgacataaaaacaaagagcagtattatattgaggaaatatcttgagctaaatacgtactcaaagataaagcatatcaaacccatagaacgtacaacatcaagagtgaaccccaacataaactatgaactttgggtggtaattatattgacagtgagggagcttatgcatgtggtagggaagaggaagtggtatataggaaatctctaccttccactcaatcttgctgtgaaaaacctgtaaataaagtataaagtctaataaaaaatatgtgtgtatatatatgtatgtgtacacaaaaaaagagtaaaaagtatgaagatttcacccattttctacattgttttaatatatcttgcaccatagtgtgtatggatgtatttatacatatatacagtagtcctttagcatcctcaaggaattggttccaggacgctacccacccccagcagataccaaaatccaaggatactcaagtgtctaagagagaatggtgtagtatttgtacataacctgtgcatatcctcccatacaatttattttattttattttaattttttttgaggtggagtcttgctctgtcgcccccaggctcgagtttagtggcatgatctccgctcactgcaacctccccctcctgggttcaagtgattcttctgcctcagcctcccaggtagctgggatcacaggcgtgcaccaccacacctggctaatttttgtatttttagtagagatggggtttcaccatgttggccaggctggtctcaaattcctgacctcaagtgacccactcacctcagcctcccaaagtgctgggattacaggcatgagctaccacactcagccctctcatacaatttaaggaatctctagagtatttataatacctaatacaatgtaaatgctgtaaaaatagttgttatattgtatctttaattgcattatttttattgttttattatctttattgtttttttcaaatatttttgatctgcagttggttgaatcagacgaagtgaaacgagtggggctgactgtatatatatatatatatatatatatatatatatgtgcgtgtgtgtgtgtgttcacaagtataaatatataaatacaaatatacaaatacatatttgtatatacaacattaaccagaatttagctctaactttatcttgattgagttgttcttagtgattttcttatattccctaaattatttccactgaaactatattaactttgtaaccagaaaatattcaaaatgatattaataaacaaaaaacaaaactacatatccaacatctttactgcaccagaaaaaaaaataggacagagtttctggcagagacacctatggcagtcaatgagaatagagaaaataagtaaattgagagctaagaacaaccctatcacttttctactgtatactatgtagatcaggaagatttgctactcttacactctgtcttcattcttaaattgttgtgtgtgggttttattcttgaagacaatgcaggagagttcatatttcatatcactccaaaatataaattttatattcattaacaattacctcctcaaatagtcatgtactcctagttagtgatgcttttcattcctaatttgtacactggaaagcatttaagctaaaggcatttaagctaaatgaaagaaaaacactataagtgagatgattaaaatataatctagtgatttatttatgtaacttattatgtaattcttcagttttatgttattttcccagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagtgagtaaatgctctgttcattaaatggatgtcattcagtgaatagagaaggatatgccagacaagatcataaggtcttgataatcacagggacagtgaccaaagaagctggaaagatgggagatgtagtccccctattttgagatgcctcctataagaatcaatgaagaataaatatgtcaactgtcttgtgttacctggaaatgctctacgtgttgaaatatattaatttttttaaactgatctttaatatatttgactgctaatatttctttactaatattcatttcgcagcagcctgatcaaagttttccttttaaatgtcatttttatacatattctgttttgaatttaccattctttagcatattgaaaggaggtttagcattttcacttttatatttcaataaataatttctttggtccttcacagtgtagctatattaattctccaataaatgtagagagcagactccaatgataacaggtgtattaaaagaaaaaaaaattgggagacagatacatgaggcaacaaaggagatagcaatgatctttctcctaagaaacatttatgagagttaagagagaaatagatatatgaagaggttcttttgtccctaaaaggttgacaaacataaaatatttcattataaaaaccatagagcaagaaaatgaaatattttcttctatatatacatataaaagaaccaaaaatatgtttcatcatatatatagtagcatgagttaacttcttttgaaagtgtttatatttgatttcagctttgaaagctttcctttttaattttttttgttcgtttgtttgttttgttttgtttttgagccatctcaactcactgctacctctgccttctagattcaagtgattctcctgtctcagcctccagagtagctggaattataagtgcgcaccactatgcccgctaatttttgtatttttactagaaacagggtttcaccatgttggccaggcaggtctcgaactcctggcctcaagtgatccactcgcctcagcctcccaaagcgcagagattaccagagtgagccacttcacccggtttattaaaatattttaaaatgcagttgtactttttctttgctacttccatcttgtacattaatccgtttttggtccttaggactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactggtaagtacaatgctgttctctcatatgctgttatctattataaagtttgagagaaataaatcttttttacaggttaaatataggttttgccacatacttttatctttattcatttgattttcagttccaattgtgtccaagtggatgttgaataacatagtttgcctacctatataaatcaaatgttctcaaagtgtggtcgctaaaccggtagcatcatcatctccttggagattgtttgaaatgaaaatacaattccataagctcattctagacacacggaatcaaaaatgtcgaaatagaaccctgaatctgttttaccaacccctccagggaattctatgcacacttctgtgtgagaagcattgctatagtctattatcactacacatggacctgaaactctctgatgaattttgcattgttcagcatagtatccttaatcattggcaattaaattatctgaagttatttttattattatagacttattttcttttatttttccacatctccaatttagatcctttgattaaccattcttcttctctactaacttgggtaattttcaaaatgtgtttttaaatctttgcttattcactaagaaaatgcctatttgtgtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaaagcttgtacctgacaaaaaatagtttcatgtcttttcttcaatattacatttaaatttattaaaatcaacaaaatatttgatgagattgtctacttattttaaattcgtcttgaaacatatttgtaactgtattagttgatttgctactcaaaatgaacactaggtggaaccacttcttttttttctactcagacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaaggtagagtattatatttcttttaacattttgggggagtatagcagggttaaaatatgttgatttaaacaaaatgaagtcatttttattaatagatttttcaaatgcaaataaaatgattgatggtgcttaaaattcaattcttcctgtgaacagaacacaagtaatagggtgtattatttttgagaaagattcgaccaaattaaaagagttggaacctgaaaaacaatactttttaagcatcacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaataaatagagatggagtaagggaaaccagaaaaggaaattgtatcttacttacctttatgttttaaaattaatgttgtcctgtgtttttttttttttttcactattttacttagactctacctatgtttattattgaagtgagtttttgtagacagcatatagttgggtcatgtttacatatccattcatcctttcatggcctgttaactggtgcacttggaccaattacacttaacataattattgatatataggacttaaacctctgtcatttatttgtttctgtctgttccctctgggtttcagtcctatttccctattcctccattccctgtagggaaaattattaaggagattaattttgattcatatgtattgttttccattgtatctctttgcatagcttttcttctccttttaaaaagttgttgctctagctaatactatatatatgtaataatatattactgtctactggcactgacatttaaatcaacaactggaatatggaaagcttactttcatgtagatccatttatactctccacattgtaagtataaatgccagtcgtattttctctgcatgcattgagcaccatattaaactcatttgcttcaaatatcaaacataattgaaaaaacttatgaggaaaaagatatcgtgttatattgactcctctttttatccattatatcgttctattttttcaggatcctgaagtctcaagctctttcttttatctgttttattttaatttgaagaattcctttagttatctttaggcataggtctactggagacaaattctcttggtttccctttctctgagaatgtctatatttacccctttacttgtaaaagatcgtgtcactggatatcaaatttggagttgacagttctttgaacacttgaaaactgtgccacatggttatagatgaaaaacttaccatcatttgaattgttgatcccctcaaggaaaagcatagtttttgtctagttgctttcaaggtatttttttctttttttaaagtagttttattttaatgtatattggtataaattccaatgtttttatcctctttggagttcactcagcttcttaaatataagtttatgccttattgtcaaaatgggaagttttcaggtatccttttatttattcatttttccagcccaatatcctttctcttctttttctgcatctgcattatttgttgttgtatttttctgaatgtctcagttcagttttttgttttcagtctattttcagagtgggtaatttatattgctgtatgttcaagttcatggatttatttgtctgtcagctccccatgtattattaagtatattcagtgtttttaaaaaatttttatcatacttttccattttataattcctacg

SEQ ID NO: 2201 - DNA, 6702 bp, Homo sapiens
  source 1..6702: mol_type = genomic DNA
tcatttcttgtagagttggttatatttttctttctctgtccatgtagtctgcatttggcaatacaaaataaaagtcagcactgaaatttattttgccaaggttaaggatgcatccaggagacaggtctgtacttatctccaaagatgattgtgagggcttcaaaatttaaagggggaaagacagatactggggaaagaggaaaaaatgttttaaagtgtgggtaaataggaggcaagcagtggcatgctttcgagtctttgataagcccttcacttgtgagaagtaggtagaggaatagtcacttatgcattcatctggctcaattaatctgcatttttatataatataaacataaggcagaatgttggggtgatcagacccaacaccaggtcacgggagtgagaaagtctggcagagtcaaaggactgagaaaaagacagttggagaagtaaagtgggaccacgggaccatcacaattgtggaggctgtgaaggcccggagctctgggagcccagtgctatttattggtaatccagcaaagaaacaggtggtaagaatgtggaggctgaaagggcgtgttgcattaagcacatgatttacagctgtgatggtttagcatctgctctgctacttgagaaaatggagagcaggttcttttaactcaaggtactgttgatcctgggagggcaaggagcaaggagcaaggagccagcaagtctagacacattccagagctgcgagccctggattctgtccaagccatgagggattttatgccctgggcttagattatggtgcatcagggtagccttccacccattagcacagagcttggtgttccaaagaccacaaggggatttagaccctgaaccctggacatgttccagagctcttttacgttatgtcagatatgcaagccccacctcagcttctcccaacactcagcttttcccaacacagaggaagaaatctgatatgcatttgtctcaggtgggcagaagaatgactttgaattctgccctttgtcccatacctgtgaagatacactatcaatttacattttcaggctaaaattcagcagaactattttagggtaaaggaatttcctaatgtacaaattgtgaaggaggtatgtagcttttcttttcttttttttttttaatctttgaggttatcttatttaggaataaaatgggaaacaaatttccctgatgcagttcccagcttgacttttcgcttttgcttagtgagcccggagtcctgagatttattttcctttcacagttcccatgtcaaagttggacatggatttgctggagtggaggcaagaggcacagataccaaaggacctttggggctgagtgttggatgggtcatctacacagatttgaaagggggcaggcctggggttgggagagcaccatgcttttgtcttagagacctgacctctgagaaggatcgtcattgacccgaactggggtctgcccacccagctggtaagaccagatatatacactgaggtttgcagcagtaaaaaggaaggcagttatttgcagagcaccaagcaaggaggaccaggaagctaatgcttaaatcctgacctctgaggtggcttgcaggtaatggtttttaaaagcggggtaggccagcgcggtggctcacgcctgtaatcccagcactttgggaggccaaggtgggcagatcagctgaggccgggagttcaagaccagcctgaccaccatggagataccccatccttactaaaaatacaaaatcagctgggtgtggtggcagagccagctgtggtggcggcgcctgcaatcccagctactcaggaggaggctgaggcaggaaatcacttgaacctgggaggtggaggttgcagtgagcagagatcgcaccattgaggcggacgttgcggtgagccggggtcatatcattgcactccaccctgggcaacaagagcgaaacaccattaaaaaaaaaagaaaaaaaaaagcaggggtaaatttcaggaaagctacaggcaaagttgtaaatcaatcctggaggttacacattggttttgacctaaacgggtgggatatcttgaagtggggcttacaggtcggggtagattctaagattttctgatttgcaatggttaaagagttttgtttaaaaatcaaacaaaaaagaatattagtgctggctcatgggtatgaccttctccaggcccctcagaaagaaatttctaatggcaatcacagttcagtccttagttctcccttatctgaggtctgtgtgtctgcagttccattttgtggggctccaggtttctgaaaactagctcaggaacatatgttaagatattatctttaatttctatggggagccaaacatcttctggctctagtttctttggctattgttttaaactactattaccttcttgcttatcaaattgttcatttacttttctaagctagctaggtgcctggaattttccttgaaggtactcaagaatttcttttatgtccatgcctgggggacccagagacccctaagaggggtccctgctctgtctcaggatccaagagccagagcaatgaggagccagaaattagctgcggtcatcagcctctgtctgtggaaagcgaagaacagcctctacctgagattacgacagggaaaatcgttcctcccttcatctttaagcccctcaagcacgctgcattatgttcagttacctggagcaatggtctacattatatttcgtactcttttctgcaggaggcaacagaagattggttctgcatttttgtcaaatttcttgtagggccaagcgcagtgtggctcacacctgttatcccaatgctttgggaagccgaggcaggaggatcacttgaggccaggagtttgagaccagcctgggcaacatagacaccctgtctctaccaaaaacataaaaataaaaaattagtcaggcatcatggcgtgtgcctgaaatcctagctacttgggagactgaaacaggaggatcgtttgagcccaggaatttgagtttacagtaagctatgattgtaccactgcaccccagcctaagcaacagaatgagaccctgtctttaaaaaaaaaaaaaatctagtaggacatcatccataatgttcagagttccatataaaaagattcctataatctctctcaaaagtttgttctgttgatgatctaaacttgctttgtgtgtgctaattccctctcaaagacagccacagccataaattagtttcctggtacagtgaccctccccttcacccattgtataacacagctttgtaatattttccttagtgtaacagttccaatagtcctcatttatagataccttttgttgacaaaaaatatatatttgaagagattttattctgagtcaaatgtgagggccatgactcatgatgcaacttcagaaggtcctgagaacacgtgcccaagatgcgtgggttacagcttcattttacatattttaaggagacctaagacatcaatcaatacatgtgacatatacattggttcagtcctaaatggtgggacaactcaaaacggggctcacgggtcacaggtggcttcaaagattttctgattggccgttggttgaaagagttatgttattatctaaagacctggaatcactagaaaggcgtgtctaggttaacataaggggttgtggagaccaaggttctcattatgtacagaaagcctcaaaggtggctgcccttggaggcaagaggtggcatctttaacacatgtgatgctgatacttagttggtgcttgttaatttttgttggtgaatgattcttattcttgatctaagatggcaattttctgttatttgaggctttctatgtaactcttcaaacatggaaaacaacatggagtactatgtgatgatagatttcaactttaggggcaacatttattgattttagacttttaatagaaatcagctgtcaaaaaattagctgggcatggtggcggatgcctgtaatcccagctactcaggaggctgagaatcgctggaacctgggaggcagaggttgcagtgagcccagttcgcgtcacggcactccagcctggacaagagcgaaactccatctcttaaaaaacaacaacaacaacaacaacaacaaacagaaagaaagagatcacctgtcaaaccccaaagactaatgaggcaatgtgccatagtcaacataaagtttttatttcagctagaactactgagatgaacaggtcatgtagaatcggccacactcctcatctcctcaaatgctggagcatcttctgtccctagaaatgtgtgcggacaagagattacaggcttgttttttattcattatcaccctcccaaacgtaaagcaataggcaactattctgcaacttctcctcagtcactggttcccaactcagcacaaaaaagcactttcaaaattccattttctgacctgaagtttcaccaattgggtgtccccagtctttgaattttcacctcctctaaacattcctgattgttgtgtagaaatagaatatattcggcagctcatgtacccaacttttacacatgtggatagactaacagaagcatgtaaactaagcattattggttgttatgactgaatgttgcccctaaaaatgtatatattgaagacctaacccccagtacctccagatgtgactgtgcttgtgttactggaaggagggtcttgagtgagttgtctgggtccttggcgttttgaacaaagaattggacaaaatgcacaaagtaacaaaggaatgaaacacaggaatgaagtagcaaacgcagggattaaagtgagaaagcactccgcagggtgggagcgggtcccagcaagccactcaaggacccagttacaaggttttctgggcttcaagtacttcttttgaggttcctatgggtaaccccttatctggatgaaggatttggtctgtggctgaggctgaggtgaactggcaacctgtgcagatgcagggatggtccctgcttggccctcaggcagttcaaggcactctccctttcgctgtgagccttggtggagtggggaggtggtaaggagagtagcctttgagcctttgttatcggtgtgggaagatggggtttttcctttgggtttagctgtaggaagtttaagttaattggccttagggtccctgcccccagacacaggtgttttccttttgatccagctttatgaaattatcacgaatcggcctcatattccctgcccccagaccttggtgttttctcttttaggaagttagcacaaattggcctcagattccttgcctctagaccttggagattttccttgatttggcatgaattggccttaagttccctgcctccagaccctatttattctcctgcccccagaccctattctcctgcctcatttggagatagggtctttacagggtaattaagttacagtgaggttattagtgtgggccctaattcaatatgtcgacaaaaaaattatgaatgttgttatgttgttttcataaacgtttgtgtacaagtttttgcgtttacatgttttcagatatctggggtatatacctagaagtggaacttctgaataagatggtagctctgtttaactttttgtaaaattgccagtgttttacaaagtagctgcactattttatatttccattagtgtgcagggggttttgcatttctccacaccctcaccagcatttgttattgtctttttccttgtagccatcccagtattgggccccaggacaagatgtgctctggtggtggctccagtcccattcctgaacgtgccatgctgcagcaacctgggtcctgggccactgggggaacccagcataaattctttctctggaataataaagtcatatggactctaggcagcaccctctactgcacttagggactgtgagcaaccttgggctgtgaggtatgaagtatcatctcgttgtgggtttttttttttttttaagacagggtctcactctgtcacccaagctggagtgcagtggtgcaatcagctcactgtaacctcaatctcttgggttcaagcggtcctcctgcctcagcctcccaaatagctgggcctacaggcacacgccaccattcctggctaatctcattgtggttttgatttgcatttccgtggtggctaatgatgttgagcatattttcatgggatttctggccatttgtatattttctttggaaacgttaacagtcttttgttacctttcctttttacttttaatggctaaacacaatcttttccctttttaagctatttaagaaaagcaacaccttaaaataatacaacaacaattagatgaaactgaggtccagataactctcctttgctgattctattctttgtactcagaagtgccagtgttcatgaagacctgtagtccccacatgatgagaggcaaaaacatgagaattattagtttaggtcacattgtacactgagttttgtggtgggtggtttttatcttatttagggaagtttaaaacaatcttatttagggaagttttctcttatttagggaagtttattttatttaggaatgtttaaaaaagtttaaaacaattagggaagtttaaaactacatatttcatcctactgacagagttaagcttgcttca

SEQ ID NO: 2202 - DNA, 5950 bp, Homo sapiens
  source 1..5950: mol_type = genomic DNA
acatattttaagactggcagaaaataaaccaatatggtagtaataggaagtttttttgcatttttgaattttccaaattttctttattaaaatttatgacctttagctgagggaaggaagcattcaaaataaaaaggcaaaaaagcaaaatagttaaaatgatttagagtcgaagtaagcaggggaaatatgaagctatagaagagaaaacaaagaagacaataaaaatatctgaagaatactgtcttaataattctgggactaggtgtggtggctcactcctacaataccagcactttgggaggcccagccaggaggattactcgatgagcccagagttcaaggctgtagtgagtgattattgtgccgctgcactccaggctgggtgacacaccaagacccagtctctaaaaacaaattctggaaaacagcttcatggctccaacataacattgaacaaagccaaagatgggaaaggaaaagggaatgtttttattttcattgtagcattgggtttttaaatgaaaactgatgtttcatatgctcttctatgactattcagtataggtgtttcaccatcattgtaaggagtatcttctgtgtatgtaagtatgtgttcactagtgcattcattttttcaacatgtgattaaacagtttgagagtcaccatatgccaggtactgtgcaagcaaatcaaaggtcacagtgtaaaatgagaaagggtatgttttggccctctattctagaattgtttatagaaagtgcataatttaagcccatatgtcccatgtcctaaagatacctgtccattaaatacagtgcatttcattgccttttcagactctcttcactatgcacataagtgacaatgtaattgcaatttgattaattcatataaactaagaaaggaggaattattcattcatttctgatttttttttttttggaaagtatcccattcctactatagtttgccaaaccctctcagggtagacctctatttacttaaaagaactagtttcatagattgctgtcatgcaccctaattagacaaacgtgttttccaggtctatttgaaggacattctgatataatgcatacctatcttcttaatcttcttattcagcttatgcatatttcttttcctttaaaatccatcaataaatgatctgtgatctgtaagtaattaatttaatgattacatgaattaaaataatgcacattgctttaaaggagttagtattttcggtttatgttacaatattggccttgggtaaatatcatccattgcctgaatttcataatggttcaaggataaaccatttcctctttataattcagtaagtttgttccaaaggagcctattgctcctctactcaacaatgaaagaaatgcattcagggaccttaggttgcctattcttaataagatggaatcctttcccggtttgttaaattcactgaatttataactcattgttactgatgaaggaattaatccaagcccgttaccagattgatctcctaaaatccacagagcgaatttggtgtcatttttaaaaagaaataaaataacaaaaataaaaatacaaaggatgtcagtaagttacagacaggagggcatacctcatatttatcacctggaaaactagagaaaagtttcatcaaaactgtttcatgcatctgtgcagggctaaagtcatctgctaatcagcactaataatgatggggataacaataataatctgctacctttacataacagtttttaccttgggaaaagattttcacatactactcttcatttagttcttataatgactttgagaaactaacataaatgttttacaagtcccattttgtgaaagagaaaattagagtacaaagaagagactgacccaacaataacatttaactggagctagactcctacttcaggtttttaaaatgctttcaaatcaatagaattcatgatttgcaatgttttcctaaattctgttaaaacacacttaggaccgtaaattttcaccaaccataacagacacctggtaagcgggcatgtaataaacaattgagatgttagaaaaaaagatatgtctctgatgagcagggcaaaagtgaatgtaagtcaaaagatatctaaagactctatagcttctggaataataaattggtagttttctttatttttcatttgttgtttcagaaagtgtttaacttttgatactaccaccaatgtaaaatataatagattgttagtaacaataaatcaatctctacgttgtccaaataggtgtgtttacccaggtccacactgttcaagttttattaaaactgtttcgttttatccaggtttccagtattgcatctcctaagacaaacactgatatttatctgctgatgcttgttttactaaccaaatattacattacacatggtttatcacattacccagggaggtgacaatatttcaggaaaaaaattaacaaatcaaaataactttgaaaactgtttataccccatgtacaaaagtactgtctatgcctagttattcactactatcacaagatatacataaatcagagtttttaaataatactgacttccccttataaattcctttaccccttgtgaaaggaacctagcaccattatgacacagttaagcattagtcacagtttaataaataatttcgttatagcctcctagtctatcagtattatttggattctcagaatgcatgtaatcatgtaaattacaaaatttcctttgtatcagggataaccaactgtcttttataaataatgttatttttggtgatttttcaatatcagaacagtatagttttggctagagaaattactataagcattcaaataaagattaatcaatttatacaaggcaaataaactttttgtactcttaaatacttaaagaataatatatacattcaaatatttgtaagaaattcatatagaggggagtataaaacacatatggaaaaggaggtatgtctgcagaagttactttgtaaagaaacatagtgctcaactaccaccctccctcaaatatcatgtcaatcaaattagcatcataagaagaactccagttctactgtgatagagtagcttatatcaaatcaccccctcgttgagaaaaactattaaagatgaataaaatgaaattattttaaaaactgtttgaaggcaccaggcaccaaccaaagtaatttcaatttaaaactcaatagtctataaaggaagtaaacacgttaaagtaagccctatgttgtttattacttttcaaattcaaggcatttgctgtttcctaagtagaacagaatgcgagactgagcacaaagctccagattagaacattaagaagtcttgtaaagagaggagggcacaaataacactttggagctgtcagcacagccaagacatgaagaatcaagatcctggataaactgtaaatgcaatgaggtgaggcctgtattctttttccacttttaacccctaaaacatttccagttcctctttcttggagtgagaaaatcaaaagagaaacaagcagaaaacagcaacctaaatactaggacattaaaaagaatattcagtagtcttataccaacgaagcaaaaactggagtttagtgactacttgaaaagcactccaaaattttatttgaacctctaaatgactatttataaaactaagggaaaaccataactagagtagccatcacaaagatggaaacccaacttcaaattgtcttaatccctgataagattaagtaaattacctttattctaataatctgtgaggagaaaattaaatccccatggaaaaatataataccatacaaaacactctaaatttttaatatgaaaaaatcatcaagcatgctaggaagtagaatcaaagaaccaaaacaaagagaaaaaataatagacaaaaacataaattcaaaaatgatacagattaaagaattatcagatatagtcttttaaaaacagtgataaatatggtttcagaggtaaaggaaaagagtgagaataatcagagaactgggatttatattaaaaacccaaagattattctagaactaaaaataaaacaaaattaataactcaatcgcagccagttagacacaacagaagatccaagttgtgaacttgaaaataggttaatagaaaatatccagaataaaacaaagagagaaataaggatgataataaaagaagaagcattagagatatatagaacatggttaaaaaatgttttaacatacaaatatctctagtcccagaaggaaagggtaaggagaataggcagaagcaaaattcaaagcaataatggccaagaattttccaaaattggcaaaagcatcaagccacaaattcaagaatgtctaagaaccccaagcaggataaacacaaagaaaccaactacaaaaaaaaaaaaaaagcctgtttgtaaaactatttaaaaataaacaataatcaaaaaggcaatctcaaaatagccagaaaaataaaaatgcattactttgtaaggattagtaagtctgataactgattgctcatgaaaaacaattgaagccagagaacaaagccatgatatctttaaaatgcttttaaaaagtaactaccaacctaagaaacccaaacaacagcaaaaaactaaataacctgattaaaaaatgagtaaaagatctgaacacacatttctcagaagaagacataaaaatggtcaacagatatatgaaaaaatgctcaacgttactaatcattaaggaaaagcaaattagaaccacaatgagatcacctcacacctgttagaaaggctaccttcaaaaagttaaaagacagtaagggttggcaagaatttggagaaaatgaaactctcatacactgttggtaggaatgcaaattgggtacagccattatgaaaaacaatatgaagattcttcaaaaactacaaatataactaccatatgatccagtaatttgacttcaggatatatatcctgaggaactgacgttagtatgttgaagagatatctgctctcccacattcatcgtagcattattcacgatagctaagatacggaagcaacctaagtggcatcagcataaaaacagataaagaaaatgtgttaaatacacacaacagaataatattcagccttagaaaataaagaaatcctgtcatttacaacaacatacgtggacctggaagatactatgttatgtgaaataaggcagacacagaaagacaaatactgcatgatctcacttaagtgtgaaatccaaaaaggccatagatacagggagtaaaatggtggttactagaggctgagtgttggatggtgatgaagaaaggggagatgttattcaaaaagcacaaagtttcagctagacaagaggaataagttttagagatatactgcacagcatgatcactataatttataagagtgtattatatattttgaaactgctgaaagtatactttaaatgttcttaccataaaaacacgataattatttgaggtgatggatgctaattagcttgatttattaattctacaatgtaaacatatactgaacatcacactgtatctcataaatatatataattgtcaatcaaaagtaaaataaaaataaagcaaaacatatatatacacaaaaaagtaaataccaacgtagaattctctaaccaatgaaagtattcttttaaaaagtcaaaataagaatattttcagaaaaacaaaactgcggaaatatttcaccgaaagattcatactataaagaatactaataggtatctttcaagtaaaaggaaaagcatctcagacaatgatagagaaatgcaaaaaataaagtacacagacaagattagtatgcgtataagtatagaaaaataataaaaataatgttttaggaatta

SEQ ID NO: 2203 - DNA, 2098 bp, Homo sapiens
  source 1..2098: mol_type = genomic DNA
aaccatctcttattgaattatttttcctttccatattaatttagaatgatacctgtgtcatatgctaagatctctttctaggtgctttattctgttccattagtcttatctggctttgtgccaatactacactgtttccattagtaaaactttgttttgttttctgatggggggaaatcctattttttttcttattttgcaaaatgaactagcttattttggagattttgctttttcataagtattttaggatcactttgctaaatttaattaaaaaatccttttggaatttttattagaattgtatttaatttatagatcaatttgggaaacaactacttcttcagaaaatttataattttttaatgtatgaggtatgttgctgtttgttagatttattccttgaaagattatgattctgctgttactgttgtaaatgtgatattttaaaaaacacatttagtaatttgtggttgttgttgtatagagactttaatttctgtacattgatattgtatatagtgatgtccctgaactttattagtacgatttgtagattatcttggattttctgtattaaagtttatattatctgaataacatttgtttcttcattttctacacttgtaagtcttacttctttatcttattacctcagctaaggccttcagtacagtgatgaatagaagcatagatggcaggcctgtcttctattgttcttagatttaaaaggaatgctactgatgagttgatccatagaatgtgatatttattatgaatttctaatattccttactgaattaaagagtttaccttccattcattctttcttgttaaggtgtttataatgaataagtattaaattttatctaatgattttttgtttccattgagattgtaattttattttgttttaatttgttaatgtaatcaatttaaattaatagtttttctaatcgtaaaccaatgtagtattcttaggataaagttgagatagtcatgtatttttaaatatattgctgtatttactaatggatcatttgggagtttgaaaataagcttatatttgaattagtctttaatttctttgttatccttgtctacttctatatcaatcttatactaatctcaggaatggaattttagaatttcctctctttttatatttcctagattttgattcgatgttttatgaatatttgtaaaactcatataaaaatgctagaacctggccaggcacggtagctcatgcctgtaatcccagcactttgggaggctgaagtgggcagatcatgaggtcaggagatcgagaccattactggccaacatggtgaaaccccgtctctacgaaaaatacaaaaaaattagctgggtgtggcggcgcatgcctgtaatcccagctacttgggaagctgaggcaggagaatcacttgaacccgggaggcagaggttgcagtgagccgagattgtgccactgcactccagcctggcaacaaagctagactccgtctcaaaaaaaaaaaaaaaaaaatgcttgaatctaaagtttcaaaaaattcaatagatttttgaccactgaaaatttttatatattattgagttcattttgtagtttaattcctctagaaagtatgttttttatgtttttaaagcaagtgcctgaaaatatagtaatttttgatatgttttaaaattccttatctgtttgtgattctcttttctttcctaatattgcttatttgtgcctacgttctttttcttaattaagatctttattctttccaatgttcatggcataattgttgaaagtatttaagaaaggcaacctgttttacatgaattattaagtgcatttttgatgggaaaagtttaatttctcagagagccgtgtaatcatttcatttaggctacaactcactagtttttcatattctgattgcaaagcagtaatttactggttttcatattatgttttaatgcattgaattcctttagagtggggctaatgtttgggtattagaatggtacctttttgtttgaataaagattttcatcaagtttttatttgggagaataatttttgaaatacatatcaaat

SEQ ID NO: 2204 - DNA, 333530 bp, Homo sapiens
  source 1..333530: mol_type = genomic DNA
tttcagttggaaggaggtagggaaaataagtgctttaattcctaggattttggaagtaaaaatggaacaccagacaaaaatggaatttttaggcaaatgtaaagctttgtacttgggtatctcaaagtattatacagtgtaaactatcatgattattaaccaactagaagtagttcttttttttaaattttatttttaattttagacatgagggtcttgctatgttgcccaggctgaagtggctactgacaggcacgatgtggcactgcagcctggaactcttgggcttaagtgatccttcctgcttcttctatcttaaaaaaaaaaagttacgcttgcttgttaaaatatttttaaaatgctgtgtttaaactaagaagtaaatatccaccccacctctgacttctaaaaattatctaaagtatgactggtaagatttttacctttaatcccacataagtctaaaatttgtgttcatttccaacaaccaaagtgtgtcacttttataccagaattttgtcctgcttatacgtttagtacagaaatctcatgggagagagcatccatgcatttacaaattgttattgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagaaggtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcacgcggcgcgcagctctgattggcctcggcggcacccctcgtcccgcgactactttgtgtgctggggcggcgcgctccggtcctcccgctcagctggcggtctgggctgctctggggcagcccttcggtccactgctctgcatcgcgggcgccgggaattttccgagtccgagcgggtaggacgcatcctagggcaaagcctctcccctctccccgtgctgttctctttcccgtactaaataaacttccgcctcagaggggctgtcgcagccgcgggtcgggagaggccgggcatcgaactcaggccctcgtggggggggtctttctcttcgagtgaatgtggaaacagctcttacaagataaagtagggcttcgctgagtctcctgggggagcgatgccattgtaggatcgcgctggaagcagcagtcaagcggccaaatgcgggctgcaggggctgagcagcagcagcgcgcacccctaaaagtagcaaggagccagcttcaaaacctctagtgcgggtgccccctagggccgccgactgagctggcacgggccggtccattcccggcgctgtagggagcacagcattctctggaggcgagtctcctcccgggatccaggatccgctcgcgccccgctcagcctccggccttcaggcggtagagggcggcctacgcctgtgtgcgagccggagccggcgtgcgcagccgctgccctgctggaactgtgccgtcccgctgtggcccgcggctctgctaggcggtggatgctgctgctacgctctccaccggcgcagcgaggaagggggcggggagaatccctggcacatgccagggtcgccgtaggtggcagcggccggcgcatgcgcgccctctcccagaagccaggaacgccgaggggcgcgctcccccattcgcgcgcgcacgccggcgctggccgaggcttccccgcctgcgctcgttgtcagagccgctccggcgcgtgcgcgcgttatctccggccgacccgagcagccggttccctcctctccaggccccctccccatcccacccccgccgcctggccccagccgacccgtcccttcgtctccccgcggaatggggccggcactgctcagggtcgcgcgccctggacccagctcgctctcggtctcgcgctgtcagcgactgcccggctcgcgccgcctcgcgctctgcctcagtcagtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctggggtaagggggcgttttgggagccgggccccgcgcgcctcggggtcttgggctgggctgcgcgcgggatctgaggaggctccgcggctgtccctgctcgttcacccgggcctgttgctgcaactgctgccggttaaccagcggctctcggaaaagtggggagggagcccccgggacgctctggcggatgccttggcgcagccccgggggcgcgggcagagggtgaggggcgcccgcctctccagccgggacgcggagctgcgccgctgctgccctcggcgtcgcgcatccttgcctagggcaggggccaaagcctagggaaggagaagggttgggggcgggggtgggaggtgtccgtcgtttcccctccacacctaccttcccttcgtcagcagctcggtccctggagtcgcggtttgtggggaggaagatgcccgtgcgttatgggctctttctgagtgctgctcgggctagaaagcagggagtggaccctcacaaagatccgcgagggactgatgcagggcagttaaaggcttgagtgcagctgtactcccttttgatgtgcaaatgacgagctggcggcttttgagtatcaacttatttgggaaggttaaatgagtccatatttatcagttctaggaggtttgtcctgcaggattgagtgggttgtcgggtgcagcacctgttctttcttcacagtggggattgcaatcttcagagacgcagtgtatttcttaagtggcagtgtcatgcttagggtttgtcccggatgagcttttattttagcattttgccatataatatatagattgaggccttggttaaaggcacggacaggtggtgtttttttccttcctatgttttaattattcacagtttatttaaacccactcaggaaggtggacccagaaaagccaaattctgtagtacataaccccaaatttcaaggttttgcggaacaaattcaacacaagttttgtgtcagtttagagttaaacgcatctcaagtaactgacttaactggcttgcctctatgaaaactgtaggcaggtttcattatagattttttttttcttgttattccggcggttaggtgcatgtttattttcttgattaaatttacattctatgttttatgactaattctttaaataggtgcatcatatagaaagtattttaggagagaaattattatttaagcactacagtatatcagatatatgagaaataatggagttgtagtctctgctctttaaaataactgtaaaaacatcttaaaaccctatgccaaataataaggccctgtaccttgctgtccttgtgaaatctggtatgtgtatagaaaatcttaattacttgatttgtaaatactacagtagtattgaaaaggtgggaattcaagcatttgtaattgtgatttcacaggtttagtgtgtaaaaaatgcagggagttagagatgaataggctataagacacgtacaaaggtagttccaagacatggattttctttttgctgccttataaattgagaattctatttgaattcaagagctgaacagctggaatgaaacttgcatagattgcagaaacagatgcaaaaatgtatctttggtcaagttgtgagttaacttgaagagtgtcttgtgtaataggatagtgattcaaaataatttccataaagtacggccttatataggttatattttgaggatatttttgaatttaaaaagtcacctgaagttgttttcctacaaatcagttctgtttaagatgtatggaatcgaaaaaaacaaaacaaaactaattctgattacatcctgcattgttttgttgcaaattcttaccagttatttttacgcaattggagtgtccttaaaagtggtgaatcttaaaatttgccagtggattggaaaaaactgttaacttattatttttaaaaatgctgttatattagtacattggtctggagggggagctagtgccaaagcaaagtatagcttaatagctgtttgaacttttaaaacacccaaaaccagatttttatgaccaaaagaaacataaatttttaattaaaagagtaggaaattgatgtgggcatatatatgtacatagttatttgtggagtgaatatattgtgtattacaaattagtttaaaaaagtcttttcatgcgctgcaataatggaaagctaaatgcttaaagatttattggatttctcacttaaaaatctctaaaatgtacccccaaacttagagtatgttatagtattttcttaaccttcttgtcctgttcatcagaatctaaggcatgtattcttgacccattgtacatgttgtgtgttcttaaattttgtttttataatagctacaatcctaaaatttcaaaaacgaagcttcaagtagaatcttatatgggcgaaggtattaattgtgtggtaagctaggtatttatcaaaagtagatataattccttttttttttttttttaaagtagagataattccaataaaaaaatggaccttttagacatctggagaacaatatccccaggtcacttaacccttatctcctgcagtataatgcagtgcgtccagctgatctaccaaattgaatgtgtgcctttgaatacgaagcagttgttttgtggcctgtggcatttcatttaggtttctaagctgtaataaattagtatgttaatttacttctttccattcacatattctttaaatccaagcctagaaactgatagttatatgtatattaaaatcattggaatattggtttttttgcagatagtgtttgggctgtttattatccatagctcttcattatgtaaatagaatctcaatgctgataaagtaaatagattcttccatttcattaatggttatttttgatttatgataaactgcatttaataaatctcttgatttagttaaatggtggatacatcatttcatattatagcaaattgataaatataaaagaaagttttacaatcataagagtaaatatttaaaaaaacttgaataagttactttactaaacataaaattaagatttttaaacaactctgaaactaaaagtattactattatggtacctttttttttttttcccccaaagagatgtgatcttgctgttttgtccaggttggccttgaactcctgggctcaagcaatcctcctacctcagtctcttgagtagctgggactataggcatgtgctaccacagccagctttattatagtacttttgtaccctgcatcaatgctgcttctgttgatacttttcaaaggagatatcaacttctggtcttcaacagtagtgtagcatcctcttattgattctctggctcatatttcactaccgtatagtatggagtttctttcttggagtttgaattgtttttacattgcagcttgttatagtgaaacaattaaacatatttaaaagtaaaagatatttacgactgatttttaaagaacctgtaaaaaaatctccaacagaagaatattatatggggatgtgtagatttaacattttattttctttaatttttttttttttttttttgagattggggttgggggttgtctctctatgttgcccaggttggagtgcagtagtggcgtgatcacggctcactgcagccttgaactccctggttcaagccattctcccgccttagcctctggagtatctgggattatgggtgcatgccaccatgcgtggctaattattttttaatatttgtagagatgagaccttggtatgttgcccaggtttgtcttgaactcctggggtcaagtggtcctcacaccttggcctcctaaaatgctgggattacaggcgtgagtcactgtacccggctcctttattttattaaaaagatttttgtttgtttgtttgtttctaagtttaaaagagacagggtcttgccatgttgcccaggctggtcttgaactcctgacctcaagtgatcatcccaccttggcctcccacaggcgtgagctaccatgcttggttgtaagatttttaaaaaatggattagtttcaaatctcaacttctctttctttcaacattctaatctcctggcatttttttcctttccccagctaccccccatcatccaacagtcttccatttggaataatgggaaatcaaaccaataaagttaatcttacctcccaccaggcaaaggtttttcttaatctctacaatattctgaacataaaacccatataaactttatatgatactacacattttccttttaacggaggaagagcaaatgggacctatggaattatgccgtatttgtcaatataagggttacttttgtactcttactgaaagcagagttatagggctaatttcatttaaattttcttacccatctactttaaaaaaatacctctttgtggtagtcttttttttggtcagaaaatgacaatgtgaaggagaaatacgttttgaatttataaatcttcttttaattaacaaattataccaatataagggtagtgttaatgtggttcaaatttgcctttgctattctgccttttcttctatagtgattgtatagttatactataacttcttcctcgaagcactggaataaaagaaaaacttttaaagatcactacgaaatgctcactgtatttgttgtattttataacttgggtttttaaaatttatttttccataaactgaataaatatgaaaacgaacttgaaagatcttgtcacagccttgatgactggtcagtataaagttcacattataaaataataaaacattgataataatcttagatgaaaatggaaaattaagctaatgtttattttagaacctgagtaatgagtttatatcatgtagcaatgaggcacatgaagacggttagaattagtttttctaatgaataaacttcatgatataaacttgaaagtgcataaatgctataactttctgattgtaaacttgaacaaaagtaaaatgaaaatgggagagtcctcttaattacctttaacgtataactaaaatgaacctgtgtatctgtctaagtcttatttgatcaagactttcaatggacaatgaatgagttttaagtttttatcaatgttgtgactgatttttctataatatcccttaaatgagatatcaaattctaataatatctagaaccagattaaatttggttagagtataaacaatatttacaaaccatcaaaactataataaaagcattgtaatgttatttaatgacttaagccaacattccataagctaatctaagcatttttacaattaatacaattgatagtaatatcttaattagtggtaaagtggacagatataatttatagattctgtattgtctgggaccttggggcagtcagtgaagagagggagatagagagaggagcatactggttgatgagcttgccttatttggagatgaaggagatttattcagtttttctctttccctctacttacttctccttgtttgtcatcctcttctagcaatggtaagaaatgcgggaattgaccatctttacagtatacttttttccttagagttcatagaacatttccaggtaaaacattagcttttatgttataataggtttattataatgatatcatttccttttgaggtggtaggcaagagactagaagaacttcatttgtatagcatttaatattatttattaaaaatgattttataggccgggcgcggtggctcatgcctgtaatcccagcactttgggaggccgaggcaggtggatcacctgaggtcaggagttggagaccagcctgaccaacatggagaaacctcatctttactaaaaatacaaaattagtcgggcatggtggcacatgcctgtaatcgtagctacttgggaggctgaggcaggagaatcacttgaacccgggaggctgaggcaggagaatcacttgaacccaggaggcggaggttgcagtgagccgagatcttgccattgcactccagcctggacaacaagagtgaaactctgtctcaaaaaacaaaacaaaacaaaaaaacaaaaacaaattctaaccttcatgtgcctcattactgtaatgtaaaaaaaaaaactatgttcattgaagagaactaacatattaaactaaaaatgaagcacagtgttctccactcatgggagtactgttagcaggtttaagacagttactgtgagaagttcacaaggtgaaagtgtctttgataattagggcctaatcaattgggatttgacttactcaatttctccaacacatggaattgtactggtacctgaaggagaaaaatatataatagaagttgtattagtttttatgtcttgagctctctgaataactacttgattcattcagttgccaaatgtcaaaagattgtaattttgagaaagttgattctttacaattagaactaagccagggtaaacaatttgctttctttttctaagttttaggtttttctttctctcttaggaagtttagtgaaactctaggggttaggcaggttgtaactgaaattcttgaggccaaaaggtcctgtcttatgcttggtaaaccgaccccctcaacagcgtgagaaatgtagatgtactgataaccctgattgcttcgtgacataattacagacatccagccctctatcaactaaaattccgtttatttttaaggttcaaatattagaagtatctgcttgatacatctcataggttgtcaagtgtgcatacgatgagagatataatgttacttttaatttgtaagtaaacaaacacacaatattatgttctcaatgctgagtaagctgaaaagatgtatacctactgaggatgcaccaaataataagcaacagaaacctggtaatgtgcaattaggaatagttcctcttaataataataaaaaaaagattagtgtttaggttttaatggcataaagatgtaatgaaaataaaattaccaaagaagtctattttggagaaatttttgtcagactagataacaaagaaaagaacacatcctttttttatttttattttttattttattttagagatgaggtcttgctctgttgcccaggctggtgttgaattcctaggctcaagtggtcctcctcccttggcctcccaaaatgctgggattacaggtgtgagccaccaaacttggccagaacacatcctctatatgactgtctacagaggcttagagtagtacagaagtacctgaaaggaaataatgataaataatgaaaatgttttaatagggatcatgtgttcatttctacatgtatatcagtatagtacctatcgtttgctgtttctgcttgtaaatgcacggttggaaaataagatacccaacctttggaaattattcagggaagtgcatctaaagtttagagaaaagttggtttcttcatattttaatgacacttttcagcacgtatagttcacccttgaacagcactgggtttggggcacagacccccatcaagatgaaaatccacatgtaacttttatctcctcaaaaacttaattactaataaactactgttgacttccagccttaccgatgacatagtcaactaacacattgtaccttatatgtattatatactgtgttctcaaagtaagctagagaaaagaaaatgttattaagaaaatcataggccgggcgccgtggctcacgcctgtaatcccagcactttgggaggccaaggtgggcggatcttgaggtcaagagatcgagaccatcctggccaacatggtgaaactccatctctactaaaaatacaaaaattagctgggcgtggttgcatgtgcctgtagtctcagctattcaggaggctgaggcaggagaattgcttgaacctagaaggtggaggttgcagtgagccaaggttgtgtcactgccctccagcctggcgacagagcgggactccatctcaggaaaaaaaaaaaaaaaaaaaaaatcataaggaagagagaatatatttactcttcattaagtggaagtggatcatcacaaaggcctttatcctcattgtctccacattgagtaggctgagaggagaaggaagcggaggaattcgtcttgttggtctcagcatggtagaggtggaagggggaaggggaggcgtgagaggcaggcacacatggtgtaactttatggcaatacgtcatacttctgccttttttgctttttcatttctctgaaaacatttccatatggtaccaatccttcttccaccgtttgctttagtttcagtgcccatatcagagaagggtccatgtcatgaaggagtcaaaagcagtcttgaacaatcagacagtcttctgccatatcgtctgatgtcattttgttttcttgcattccttctacattacctggtactggattggaagcacttaccgagtcatctttttaaattcctcttgtgtgatgtctatttcttgaatttctccaagatttgtatcttgaaaccctttaacccacccccccctttttttttttttgccatatccacagtctttttcgtgatttccttgattggccctgtggcaaatcctgtgaagtcatgcacaacatctggacacagtcttctccagcaggaatttattgtttcaggcttgatggctttcatggctttttccataacaacgacggcttcttcagtggtgtaatccttccagactttcaggatggtttctttattggcattctctttcatagagttgacagtactttctgtagtgtactgtgtccagtgatcctcgtgaccccctgatttagaagctgaattagagacattttgtttgggggcaagtagactacttcagcacctttggtgttgaactcatggggttccgggtggccaggggtattgttcaataataaaagaacttacaggcaaaatacttcctgacttcagggacaaagcatcaatggaaccaatccagaaaaagggttctcattgcccaggctttttttgttctatgaccaaaagactgggagctggtgtttatcttttcccttcaaggcttgggggtttgtagcattatagataagggcagttctgatcataaaccacactgcattttcaccaaacagtagagttagcccatcccttcctgcctttaatcctggtgctttttctcttccttactaatgaatgttttttatggcattgttttccagaatagggcacttttgtctatattaaaaacttgtttaggcggatattctttctccatatttcttttttttttaagagatagggtcttgctcaattgcccaggctgacatgcaaatggcatgatcatagctcaccgcagtctcaaactcctggacttaggcagtcctcctgcctcagcctcccgaatagctgggatgcaagtgtgcaccactatgcctggctaatttttaaatattttttatttttttgtagagacagggtctcactgtgttgcccagtctggtcttaaactcctggccttaggtgatcctcccacctgggccttccagagtgctggggttacaggtgtgagccattatgccttcccccagctaattaaaaaaatgttttttgtagaggcagggtctcgctgtattgcccaggcccaggctgatcttgaactcctggcctcaaacgatcctcctgcctcatcttcccaaagtgctgggattacagggatgagccactgcacctggcctcctcagtgattttctttctttctttcttttttttttttttttttcgagactgagtctcgctttgtcacccaggctggagtgcagtggcgcgatctcggctcactgcaacctccgccttccgagttcaagtgattcttctgcctcagcctcctgagtagctgggactacaggtgtacaccaccacgcctggctaatttttgtattttttgtagagacggggtttcaccatatcggccaggctggtctcgaactcctgaccttgtgatctgcccacctcggcctcccaaagtgaatgattttctttcttttttttttttttttgagatggagtctggctctgtcggccaggctggagtgcagtggcgcaatctctgctcactgccagctccgcctcccaggttcacgccattctcctgcctcagccccctgaatagctgggactacaggcacccatcactacgccaggctaattttttgtatttttagtagagactggggtttcacagtgttagtcaggatggtcttgatctcctgacctcgtgatccgcctgcctcggcctcccaaagtgctgggattacaggcgtgagccaccgcgcccggcctaagtgaatgattttcttaatgtcatctggaaagtcgtctgctgcctcttggttggcagaagctgcttctcctgttatcgtgacgtttttaaagccaaaactctttctaaaattatcaagccatccgtggctggcattatattcttcagctttagatccttcgccttccatttgttttaagttgtataatgactttgctttttcttgaaacttattaaagtttatagggatgcctttctttatagcaatcctgtacccctataaaagctacattttcaacatgagataaaaaactatttcacaaaacgtgcacaatttttgcatctgctggtgtgccttcagcaatggcttcatgaattctttttttacaatggcccttatgctggattcatttattttgaagtagcacgcaactgcagctgcagacctcaatctacagtacgtatcaagcaattcacctttttcttgtaatgccatgatttttctctgcttcttgggagcacttccggcatcactagtggcacttaggtgtcatttgaggtttatagtatcgtactaaacataatgaaaccgcgagagatcactttttactggaatatacaatttattggaaagatgaactgcttgcttggagatgattaatgtcacatggtactttaagcaaatattcactcttgagctcacctcattaacaacaggaggtggctacaaaattatttcaatagtacagggtgtagtacagttaaatttatgtagttatgatttaatactgcatctttactcttttgagacagggtttctctcagtgtcaaatgccaccatgtgtggctaagtgtgtggtataagttgtgacaatttttaactttttataatagatttgtatatatttgtagtagtaaatgataaaatagactagtatctacatatattttaagcactcatgacatacctcttactttctatttttcttttcttttcttttttttttttttttttgatgaagtctcattctgtcacccaggctggaatgcagtggcacgatctcggctcactgcaacgtccacctctggtgttcaggtgattctcctacctcagcctcccgtctttttctttttttgacccagggtctcactctgtcactcaggctggaatgtcatgattcaatcatagctcactgcaacctctgccttctgactcaagcgattctcccatttcagcctcccaagtagctgggactgcaggtgcatgctaccatgcctggctcatttttgtgttttttgtagagacagggttttgccatgttgcccttgtccagggtggttttgaactccagtgctcatgatcctcctgccttgacctcccaaagtgctgggattacaggtgtgagccactgcacatggcctacttttttgatatttctaggttatatggttgtctatgaatattttcaaattgtcacaaacctcccccaaatttatcaacatatttattgaaaaacattagcatatgagtggaccctcaaaattcaaacctgtgttgttcaagttttaagccctgagagctctaagagtttaaagctaaaaacaattagaaaaaaaatggagtttctttttttttttttgagacggagtttcactcttgttgcccaggctggagtgcaatggcacgaactcggctcaccacaacctccacctcctgggttcaagcgattctcctgcctcagcctcccaagtagctgggattaaaggcatgcaccaccacacccagctaatttttttgtatttttagtagagacagggtttctccatgttagtcaggctagtctagaactcacgaccttaggtgatccacccgcctcgccctcccaaagtgctgggattacaggtatgagccaccatgcctggccgttttttttttttttttttttaaacatgaaatgttctttttccccctggttttattgaggtataattggcaaataaaaattgtatatatttaaggtgtacaacttgatgttttggtatatgtgtagattgtgaaatgtttaccacaatcatgctaattaacacatccgtcacctcacatagttatttttgtgtgtttgtgtggtgagaacatttaaaatctcctttctggctgggagcagtggctcatgcctgtaatcccaacactttgggaggttgaggcaggcggatcatgaggtcaggagtttgagaccagcctggccaacataatgaaaccccatctctattaagaatacaaaaaattagctgggtgtggtggcgggcccctgtaatcctaggtatttgggagtctgaggcaggagaattgcttgaacctgaaagacggaggttgcagtgagctgagatcacgccactgcactccagcctgggtgacagtgcaagactctgtctcaaaaaaaaaaaaaatctactttcttagcacatttagtgtgtacaataaatattattaactgtggtcaccatgctgtacgttagatctctcgaacttactcatcctgaataaccctttggccaacatctccccatttcctcctcaccccagcccttggcaaccaccattctgttctctgcttctatgagttcaccttttttagattccatatataagtaagatcatgtagtacgtgtatttgtctttttctgccagtcctattttacttagcctaatgtccttcgggttcatccatgttatttgcagataacagtgtaaaggggaggcaaactttacctccacctttttaaagttttttttttttttttgcttggcctcacaaattaccataagatagattatcaggagaaaagcacacaaatttattcaatacaagttttatgtggcacaggagccctcataaggaaacagacccaaagatacagttagaattgaatacttacatactgaattggacaaaggataataacttgtgaaaaataaactggattatatggggaggcttaaaggatagaagttattttaacaaagtctgtatggaattctctttgtctccatatcccgtccttgatgataaaaatgttgctttccttttagtttaaggaggacatcattcacatgggaatttcatctgcttttaagaaatagaagaaaggtcagagcgctcttcttacacctgctgtttttcaagtgcctttgactcaaaatagtcaatatgtcagaatggcgtatttaaactccaacaggattgtcttactttttaaaagctgaatatgaatcctgtgtgtgtgagcatgcacacacacatgcacacataacacattttctttctttttttttgagacggagtctctctttgtcgcccaggctggagtgcagtggtgtgatcttggctcactgtaagctctgcctcccgggttcaggccattctcttgcctcagcctccctagtagctgggactacaggtgcccgctaccatgcccggctaattttgtttttgtatttttagtagaaacagggtttcaccatgttagccaggatgatctcaatctcctgacctcgtgatccgcccgccttggcctcctgaagtgctgggattacaggcgtgaaccaccgcgcctggcctacataacacattttctttacccgtttatccattggtggacgcttacgttgactccatatcttagctatatgaataatgctttcatgaacattggagtgcagatacctccttgacatactgatttcatttcctttggatgtatacccataagtggaattggtggagcatatggtagttctatttttaatattttgaggaacctccacactgttcttttataatggctgtctcaatttacattcccaccaacagtgtacaagattcccttttctccacatcctcatcttttgtctttatgtgaatagccattctaacaggcgtgaggtgatacagaattgtggttttgatttgcatttttgtgatggttcatcagtattttttcatataccaattggccatttatatgtcttcttttgagaaatgtctatttaggtctgtagcccattttttaattgcattatttgttttcttgctattgagttgagttccttatataccgaattccttcttagtaattttaaaaatagcattattaaggtataatttatataccataacattcatagttcaagttctagtaaatttatatagttgtgcaacaattatcacaatccagttttagaaaactttcatcttccaaaaaacccattcttgtccatttgcagtcactccctgtgcctatccccagctccaggcaaccactgatctgctttttgtctccatggttttgccatttcttgatttttaatattaatggaatcatacaatagtgtagtcttttgtgtactcctcctttcatttagcatgattctgtttagtaatgggaatgaatggataaagtacaaaagctttgaacttggaatcaggagacttggatactagtagtgtgtgccaccaaatatataaacatggttaaccacttgtcccctctcggcctctgctttttcttccataaaatgaattattttgactttcttatatcccacttttcacagctgggtagacattcactgaccttttcttaaaaggtacattaactcttcctcttaaatgtagccactgtgtgtgtgtgtgtctttttctggatcaaaaaaatgaggcttatgtcagctatggtctgaatgtctcttcagaattcttacgttgagacctaaccttcactttgatggttttaagaggtggggcctttgggaggtacctacgtcatgagcgcagagctctcaggaatgggattagtgtctttactattaaagaggcctgagggagcttgaacccccactttctgccatcaccagacaccaaaccttgatcttgcacttcctagcctccagaactgtaagcaataaatttctgtcatttataagttacccagtctaaggtattttgttatagcaccccaaacggactaagacatggtctaatggatgattcagcaatgaacaaatttggaattgtctggaagaatcaagatgggtgattaaacattttcttgggcatttcttagttcacacatacaactctgaggatggggataatcttaaatgctgagttaataaagatttttgacgagaacaaagccatagttgaataattctgtgaggtagagcttcaaaagtgattgaaacttgttatgaagagaagtacaagactatatgctgttttagttttttgttttgggagtagaaagtgggttggaacaatttcagtgaagtttgtgccaagctgcactcaaggtagtcaagtggggttagatagtttttcaagaagaacgaaggaaagtgcatgactatcattgggaaggttgtcctagaggcaaagctgacaggtaacattcaggttataaactaggaaaacaatacatgtatgggggatttaaaaaatagtgtacatgtgtatatgtgtgtgtttgtaacaggagtagacaattgactgagtaggctggtgtcaggtatatgctaaaagagtaatgttcattttcagtatagtataaaaaaagagaattgaatcacagctgcctaaatttaaaaatcagtgttgtaactgctttcaaataatcaataatttgacttttagaaaccttcagggcttgttattttacctacagtagtaggaagtatggctattaaatgattgaactttatttttacccaacatactagagcatatgagtgataacccacagagcagacactggaggaggggaatgtagctataaatgtattttaatgatggtgtcattacagcggcgtaagaaaatttgtttcatgttttagagtcacactttttgttcaaaagtagcatttccaatgtaggtaaaccactttttgataacaaatatctccaaatcaaaactatgtttattttatgaagatttgtcactctgacaatattataaacattatattaagactttaaagcaggccaggcatggtgcctcatgcctgtaatcacagcattttggaggctgagatgggaggattgcttgagcccaggaatttgagatcagcctgggcaacatggtgataccccatctttacaaataattaaaaaatcagccgggtgtggtggtgtgtgcctgtaggcccagccatttgtgaggctgagttgggaggatcacttgagcacgggaggtcaaggctgccggtaagctgagattgtaccactgcgctccagcctggatagtagagtgagactgtctcaaaaaaaaaaaaaaaaaaaaaaaaaagacttacaagagactttaaagcagctacaaaagttgaatcccaaagctttttatgaaatgtcagtgtcagcgttatggaaataaatgtagaactctctgaggtgactgttcttattgcaagaatctttttttgtttttgtttttttttttgagacagggtatcactctgttgcccaggctgtagtgctgtagtgctttcatggcttactgcagcctcgacccctggggcagaatctatcctcccagctcagcctcctgagtagctgggactgtagacacataccaccacgcccagctaatttttttttgtttttgatattttttgtagagacagggtttctctgtgttgcccaggctggtctcgaactctgagctcaagcgacctgcccacctcggccacccaaaatgttgggattacaggggtaagccattgcaccagccaagaatgttcttttgaaaatgtgttatgccatatttattttaaaagtcccactgaatttttaatacatataaaatactgaaatatgagttgtgtaattggaaaaatgtcaatgtaaatgaaaagagacactttttctgttctgaagcttcaaaatattaaagatcatcgttcatattttcctggggaatttttatttttagtcataatagtaaatgagcagccgtcagaagatatagccatttctaggtttagaattccttttctttatatagttctcttgaatacttgtctttaagaaaatagacattaaggatttcttgtgtaatcaaatactactttgatatttgtacagagcatgagagcaagactagaaccacattaaagcaggaagaataattaaaagttttgtaacatagcaaagaatagatggggtaatttacaatggaaaagtagacgtacagaacatcattagatgggatatagaaagctctctttaaaaaagggatatcagatcaaatagactgaagaatttgtatcctacaagttaagtaaaaaatgagatgagcaattaatgagaaaatgtgctctaaaatacttggttgcattgattggcaattcttttccacttcctataggggctatttcagaccttttctactaattttttttttttttttttttttgagacagagtttcactcttgctgcccaggctggagtgcagtggcgcgatctcggctcactgcaacctcctgctcccgggttcaaatgattctcctgcctcagcctccggagtagctgggattacaggcatgcgccactatacccggctaatttttttttttttttttaaagtagagacaaggtttctccatgttggtcaggctggtctcaaactcccaacctcaggtgatccaccctcctcggcctcccaaagtgtgggattacaggtgtgagccactgcgccggccttttttttttttttttttttctctcaaatgagacagggtcatgctctgttgcccagactaaggggagtggcgcaatcccagctcactgcagcctcaacctcctgggctcaggtgatcctcctgccttagcctctggagtagctgggactacaggcatgcgtcaccatacccggcttttttttggtattttttttgtagaggctgggttttgccacattgcctgggctggtcttgaacacctggcctcaagtgatttgcctgcctcagcctcttaaagtgttgggattacaggcgtgagccaccactctacttcttcctagggcctgattccagtgtactgctcttagactttgtaggttcactttttttttttttttaatgtaagatcaagactatccaacagaagcttcttcagctttgcttttctctctctctaaattgtgtaagttctgtctcccatttggtgtcagggatatgcaatatgccctttaggttttcatggctacctcttttatcccttctactgttagaatgtataggatcattaattaactcttttatcatttttattttaatcttccctagcaacaatttaatggcttaaacaaaaacctttccttattattattatttttaaatactgtgcaacaggccaaaggaaaaaaaacaatttatgtctgttgtttcaatttggttaccttattttttactaaaactgttctttctgttgttaccagtgaccttctgaattgccaaatggggattcttcagtcttgttgcttcagatttaacactgtgaaccacttttcctcctcccttctccttataactttgctgtcctcttggctcatttacaaagtcaacttgtttctcaagtatttgccttacatgtttttcattctctagattctttttcttgaaatgttacctattcttttggctttagtgagaatctcttccaggtgacccctatactgtaagttcctgaacgtcagtttccagctggagattgtcatctaattgtcatgctgtcatgcttaacccactcaaatttgaattttcttttcttttaaaatgtattttttctactttccttttttttttttttaaattattggcttttccttcccattatccaaacttgaattgtgaatcatctttgtattccccgtcagattcattcgcttgtcaaactatcagaggcctgtgaaccagagcaattgcatcttaaacaggagttgggtaaaatgaggctaaaacctactgggctgcattcccagacagttaagacattctaagtcacaggatgagataggaggtcggcacaaaatacaggtcataaagaccttgctaataaaacaggttgcagttaaggagccagccaaaacccaccaaaaccaaaatggcaatgagagtgacctctggtcatcctcactactacacttccattagcaccgctctatgacagcttacaaatgccatggcaatgtcaggaagttaccctgtatggtctaaaaatgggagacataaataatccaccccttatttaccgtatcatcaagaaatagccataaaaataggcaaccaacagcccccgagactgctctgcccatggagtagccattcttttatgcctttactttaataaacttgctttcactttgcactgtggactcgccctgaattctttcttgtgtgaaatccaaaaaccctctcttgggatctggattaggacccctttcctgtaacatgtttctctgtcctgtaacctatttctggcaaccacagaagagactatagtgcagaaaccctgacccaacggctacctttgggtaagtgttgggatcctgtaacaaaactgcgaattctatcactacagtgtttatctcattcatctgcttttttctgtttcatttttttttgataacagtttaggttctcattaccactaacatataaatatataattataattcagtaattgctatgatgaagggtgaggtggcagaggaagttctagtaggatatggtacatagtgatgattagcttagcatcaaaaacaagtaggggcattccaggaagacaaactgaagaaaggcttattaggagtgtgctatgtgtttgttgtcaacttgtgagacttcttctttaatccttactgcagttgtgtgcttttcgtatttgcatatgctattgcctttcttcagatattgattaaaatttgtgaaagagcatgcaatggcagaatgacacaaagtaacatatatctttattacctagctttaagtgagtagagtggtaaaatgtaaggtaatgaaaagtgagtactgcctgcactgaagatttaaaacctgatataatttgcattaaaagctgtcttgaaggtttttcactatttgtaatgtaaatcttcactaggcagctgttctcagtctactgttgttatatgtggctttatcttttatttctacctctcttctgtctcttctctctctctctctctctctctctctctctcgctgtgttgcccaggttggaacacagtggctattcacagatgtgatcatagagcactgcaacctgaaactcctggcctcaagccgtcctcctgcttcagcctcctcagtagctagggctaaaaatgtgtgccaccaggctcagctatttctacctctttcaaatgtgtgtgattgccctacagtggggttgggtaatatcttgatattagtagccactaatactgaaaataactgaaggccacagcaagtaaagagagaatttactatttttgtttccttagagaagccaaatattttgtgattttaaaatgggaagcattaaaaacaacaattctaaaatgccttatacagaaaggtgatttattggctatgtaaataggaagaatagagatggagaagtccaggaacaaccagatccaggaacttagatgctgtcttcagagtattctagcttcattttattttttctcctgttggcctcattttctgcttatgttagaaagcttctttcatggcaaggatgcatggcctcagacagctgagaacttagttccctaggatggcctctgacaggcttatctctgggctaatcactgtggggaattgtcgttgacattaacatcagaaccacacaaatcgggggtagtgtcagttccccagaggatagatgttgttaaccagagaaatagggaaaaggaatttgaagtagcaaaaacaatgtaaagccatttcagaggcagaagaaagaaaaggcaatagtagacacagtgaaagagaaatacttacataggagagagaagcagggaaagggaagggaactagaatttaagaattcaaaactaagaatttactgtgtggtaagcctgtgttaagcgttttacattttatctttacagctcagtggaggcagctgtattatctccagaggataaccatttgtagatctggtagtgaaaagcccccccaccttttttttcttttatcccaatttggcatatttcctttattttttatacaacttttttcatttttaaattatgcattaatacattaaaatccacactgcgatacacagttctatggattttggcaaatgcatataatatgtatctaccctcataatcaagacacagaactcctgctgcccatttgtagttaacctctccccctaagttcatcgccctggaaaacactgatctattctctatggctaccattttacttttccgaatgtcatacacagttgtcactccttatctgagggaaattagttccaaaaccccttcagatactaaaattcacagatgctcaggtcccttatgtaaaatgacctagtgtttacatatacacacacatcctcctggtactccagtcatcgctaaatataatatacaatgtaaatactatatacatcgttgttatgttgtttatatgtattatttttgttgtattttttttactataatattttctatccatattggttgaattctcagatatggaactagtggatatggagggccaactgtaagtgacattgtagttatatagacttttggatcagcctcttttacttagaaaattcattgagattcatttatgttgcgtgtatcaatagttcgttcctttacattgctgagtagtaatctgtggtatgaatgtaccatggttagtttatccatttgtctgttgaaagacgtttagcttattgctggtttttggcaattatgaataaaactgctatagacattcatgtatagctttgtgtgtgatcataagttttcatttcacttgggtaaatacctaggagcagattgctggatgatatggtaagcatatgtgtaattttgtatgaaactgccaaattgttttccaaagtggttgtaccattttgcatttccaccaacgatgtttgagagttccagttgctctacatccttactagcacttggtagtatctgttcctttttctttcttttttttttttttaattttagctcttataataggtgtatagttgtatatcatgtggttttagtttgcattttcttacaattgacttttggtgtatttttattttcgtgtgctttaagatatcttcccttttttttttttttttttctttaaaagacagagtcttgccgtgttacccagactggagtgcagtggtgtgatcatcactcactgtagcctcagacgactctgaactcaagcagttcttctacctcagtctcccgagaagctgggaccacaggtgtgtgccaccatgtctggctagtttttaatttttttgtagagacaaggtctcactgtgttgcccaggctgtaaaatatctttcttgagctggtcctgatggcacaagtgtgtaatcccagctactcaggaggctgaggcaggagaatcgcttgagcccagaagtttgagatcaccctgggcaacatagcaagaccctgtctcaaaacaacaacaacaaaaacttttctttaacattccgagaatgcttattggctttaaaaaacaatgatagtggccaggcacagtggctcacacgtgtaatcccagcactttgggaggctgaggcaggcagatcacgaggtcaggagatcgagaccatcctggctaacatggtgaaaccctgtctctactaaaaatacaaaaaattagccaggtgtggtggtgggcgcctgtagtccagctactggggaggctgaggcaggagaatggtgtgaacctgggaggtggagctggcagtgagccaagatcgtgccactgcactccagcctgggcgacagagcgagactccctctcaaaaaaaaaaaaaaaaaagtttttttccaaaatagaatagtaaatggccctgacaaggtctttgacaagcattggggttgcacactcaactgtatcacacaattccaggggacatcattcacataaaatttttttttcttttttcctactggagttgtgcagtgtagcagtctgggctatatatttacagttattatctaggattatcagtgattaggttccatggaaaatttgagtactaccaaatgatgcatttaaaaagcatttttcaatgtttctctgaaatgaaatttttgtccaggagctagttctgaagaaatgccctacaggcagtatgtctaatggatcagacctgggagacataaaggcctatttcaggtactcaactctgccatttactgcatgagtgaccttgggcatcttgtctagcttctttgagttcattctttatcagcaaaacaggattgataatctctcctttttatagatgtgacaagaattataaataatgcatgtaaaatatctgatgtagagcagacctcttcaagttgcaactgcttttacttctgtttattagcacttagtactgattagccacagctttttatcaaacaaaagcttagggtatcagcaaagcagaaagaaaagaatttgaaaaacaattgaaagcatttactacctaacatttaaaaaaatactgaagtagaattaggaaagaaataagaatttattggattaaatgttagctgtttagtattgtttttattttgtatttaatagggagagaatagagggctatactattatattttctgtacttgggacctccaaaggtcttaatttggtcttatcaccactaacaccaccactgccatctccatgtcatgcttgtgttaaagaaagactttgaaatacgtcacctaatgtttagggtcgtagaaatgcaatttactgttttgggactagagtacatgaattcatattacttgacatcattagttcttcccagtaaaatgagaatatttgaggtcccagagtattttataaggttttaaaaacttcataatttcttaatgtttttttgttattacccatagtgattacaataaaatccttaaaacagcaaggaaggagaaccaaggagattagatgtgctttatggatgcaaggagagaggtttagcaagcaatggagtagggagtaaagaagaggagtttagcctgagtttctggatctaggaagtaatgtagaagtcttaactgtagaagagtctttatagtgatagtgattttttttctttgattttaaattatttctgctttggtgttttctgtttgttggacatgttggtttcatacctctgtatagtaaagaggttttaaaactttgacccaaactattttggctcacacttttacttctcatatgggcttttataataatatggagagaggggataagaagttgtctaaagtaaaatcaaaagttgtttgtccatttcctctctcaagtaagaatatatcaagaatatttcagtctagccattttgtagcttgagattagagaaggaaagtttacattcacatgttaccttcatctgcctttcttgtctttgacctgttacaacagaaattaggcagttttttttttcccctcacatattcattctctgcttctctcaagttaatgaaacctagatagagggcccaattgccacttgctgaaagaacaaatttctgaagttctcttgtagcaagttactaccttgtgactaaattctggtcagttagatgtcagtagaagtatttggtatttcccagaagtctatttaaaggaagagctttaccattctttatcattttttccagctgccaacttagatcatgaggataggggctatacttgtaaggatggtagaatggagagctggaaagaccctgtatatttatgtcatggtagagcagctctggagtattatcagattattttatgtgagagagaaataaacttctgttttgtttatgccatagttattttggattttcttattatgcattgctgaacccacgatccttcacacctccatctaaggcatcttcccttctgcttcctgttctgtggttgaactcttggtgctgtttcatctctccactgctaagtccctgaattctcttgctctccacattttctataatgattgttcacaggcacagtgttgcagttagaagctgctatgcattgctagttatgtagcacctgaaattttaattttttaaaaagaaactttaacaggaatatgaaggaatgtgtaagcacagttacacatattttatttcctaatgaaaaatataatttctaaagaacgatgtgtccattaagtctcccctgccctccaattttagttgatacagattggtttggctaattggctgccagcagttcctctagagaatatgtctagatcactaacagacccctttttacttgcctcttttggaaaactcatcctatccctaccctagtaacatgatccaaatggaagcttgttactgtcacagttattggttcaaggatggatatgtaagcaaaaataccagctctgtcctgggtttttagaactgcatctagcagaaaggagatcctctctacttttgaggctataaggatgtggacaaactggtttaggaggatcatagtaataatactcagaacagaagtagagatggagggaaacaagtcagtcttcctcagagaatggacatgtacctcatataggctaattagaatattttgtttagtaacttgataatttcaagtcagactctgttgggcacttgaactggagggtcatgtgaaggacagaagtttctttaaagccatactcctaaatgtaaataaatatatttaaaaaattttaaagggtgatagaaactatttcctttcttactttgaagggggttcctagctggtacataattcatactgtctcagttattcaaacaaattactcatttaataaagcatttcatggagaggaaaagaaactacaagttttttctctatggatgtggagtacttttaaaggaaaataaatgctcccttaaacaccaatagcaacaataaaatatgcacaaaagcctcctagtgttgagaaaccatcacgtaagtgctgagcactctagttctgctcgtggatctctttacaaatagaaaattatcttatctcttatgtttgttaaagcattatttgccatagctaagatatagaatcaacctaagtgttcatcaacacatgaatggataaagaaaatgtgtgtgtgtgtgtgtatatatatatatatatatatatatatatatatatatgtacacacacacagtggaatactgttcagcttttcaggagaaggaagtcttgatatttataagaacatggaagaacttggaggacattatgctaagtgaaataagccagacacagaaagacaaatactgcgtggtctcacttatatgtagaatctaacaaagttagactcatagaagcagagaatataatggtgattaccaggagctgtcagctggggagaaatggggagatgtggttaaagtgtacaaagtttcaggtatttagaggaataaattctggagatccagtgtacagcatggttgactgtagttaataataaagtgttgtatacttgaaaattgcttagaaagtagttttttttttttttaaattgaaatgggatctcactgtgttgcccaggcttatctagaattcctgggcacaagcaatcttcctgcctcagcctacttagtagctgggattacagacatatgccaccatgcccagctagagagtagattttaagtgtccttactattaaaacaaaaaaagcttggatatatgagataataggtatgttaattagcttgatttaatcattccacagcgtacacatatatgaaaacatccagttgtacacaatacatatgtgtaacttctatttgccaattaaaatgaagtttaaacattgtatccatctggagttcctcttgtgggaaaatgacttctttggccacctaaggtctttttttttaaactcttaaatttgagacatctatagttggtataattggtaagtcacaagtattagtgagaattttatttgggtccatgaagaaccaatacaggcaataaaacacaccaagaattagggaaaagctaaagcatagtccaattatctcaattattgtaaatgagaagtacccttcacctaaatgaggctgagtagaaacttccttacctctgcaacaatttataactgtggaattagaatttagattcaagctagcaaaactagagctacattttatactcaaaactatgtctgccacttaaaagaggaaaaaaaagaatgaatataagctggttatattgaagtatattttacacagattttttttagtagttaatttcttatttagataactaggaagggtaagtggaaagatacatatgtttttaaagaggggcaggtaacttttaattttctttgtaactttcagaatttctttccctacttgatatatggagacctactgtagaggatgtttgtggagttagaagagattagggttgttgaaatacagatgtcagtttaattgtaattcatagtattgaaccttagaatagtgaccattttctgttttcacaaattttagaaaagtatacatatatgttgataattattaaaaaatttgaaccaagctttcgttcacagtgagatttgtttagtaggtaaattattttatgtttaaaaatgagtacaggtctgggcatggtagtttacacctttaatcccagcactttgggaggccaaggcaggttaatcacctgaggttgggagttcaagaccagcctggccaccatggtgaaaccccatctctactaaaaacacacacacaaaaaaaaaaattagccgggtgtggtggcacatgcctgtaatcccagctacttgggaggctgaagcataagaattgcctgaatccgggaggcagaggttgcagtaagctgagatcgtgccactgtactccagcctggtgacagagtgagattccatctcaaaaaaaaaaaaaaaaaaaaaaaaaaatcagtttgtatttactcagattttttttttttaattatactttaagttctagggtacatgtgcacaacgcgcaggtttgttacatatgtatacatgtgccatgttggtgtgctacactcattaacttgtcatttacattaggtatatctcctaatgctatccctcctcctcccacaaccccacgacaggccccggtgtgtgatgttccccaccctgggtccagttgttctcattgttcagttcccacctatgtttactcagatttaatgggattttatctgggttttcaaagggctcccagatttaatctgggttttcagagggctccctagataattcttagatgcatccagattgagaagcatgaatccagagcaaaacagaaacagctaagggtggactttttttttttttttgaggctgagtcttgctctgttgccaggctggagtgcagtggcgcgatctcggctcactgcagtctccaccttccgggttcaagtgattctcctgcctcagcctcctgagtagctgggattacaagcatgtgccaccacacccagccaatttttgtattttgtatttttagtagagacatgtcggccaggatggtctcaatctcctgacctcatgatccgcctgcttcagcctcccaaagtgctgggattacaggagtgagccaccacgcctggccaagggtggacatttgagggcacaaacatttgaggtactgaccatcataaatacatacatacatacatacatacatacagtataggcccgctgtggtggctcgcacctgtaatcccaacacttggggaggccgaggcaggtggattacttgagcttaggagtttaagaccagcctgggcagcatggtgaaattctgtctttaccaaaaatacaaaaaattagctgggcatggtggtacttgcctgtgatcccagctacttgggacgctgagatgagaggattgcttgagcccaggaggcagagtttgcagtgagccaagttgggcctgggtgacagagtgagaccccatctcattaaaaaaaaaaaaaaaattaagaatacagtatagaggggcatcctacaaggaaaccttactcatgcaccataaaagtggtcatcagaaacagggaaatctataaaactgtcacagacaggaggaacttaaaactatgggctttagttaatatatcaatattcattaagtatagaaaatgtaccatactaatataagatgttaataatagggaaaaccggatagaggagtagtatatggaaacttactgtattatcttcagaatgtttctgcaaacctgaaactgttctaaaaaatgaagagttttggggtgggtgtggtggctcacgcctgtaatcccagcactttgggaggctgagatgggtggatcacgaggttaggagatcaagaccatcctggctaacgcggtgaaaccctgtctctactaaaaatacaaaaaattagccgggcatggtggtgctcacctgtggtcccagctacttgggaggctgaggcaggagaatgttgtgaaccctggaggtggagcttgcagtgagccgagactgcgccactgcactccagcctgggcaacagagcgagactccatctcaaaaaaaaaaaaagagttttgaaaatcaaggctgggtgcagtggctcacacctatgatcccgcactttgggaggctgaggcaggaggattacttgaggccaggagtttgagaccagcctgggcaacatagcaagatcccatctctacagaaaatttaaaaattagctgggtgtggtggtgtgcgcttgtggtcccagctacttgggaaactaaagcaagaagactgcttgagcccaggaggttgaggctgcagtgagtcatgattgtgccactgctctccagcctaggcaacagagcaggacctctaataaaaaaaaaaaaaaagacaccccaaaaagtagttgattttcaaaaatcatgagtaatataaactccttgagttcagagtcatttgacttaatattggtatgcttagggtttagcagagttaatacaaaataagctttaaagaagtgctaagtgacaatgttacatttatgttattttgtagaaatggcttttggaaagatgagaagtaacttgacaagctttttaatgttttcaataagtttttactaaaagtttataaaaaattttaatttagtaaaacaaattgaaaatatttgcataaactttctcttattgcttgagaggccactttgaaactcttaatgttgcacatggttctgaaaagacatcaagcttagtttagtttataaaagcatttcattaacagagtgggtgctaaatagtaaacatagttctttgacaagtagagttaaatgtaatatttcttttaaaaaactgagtacataaacctatttatccagtaggaaatgcaagtagaaatcacgagataccattacttacctattagaaaagcaaaacaaaaacaaaccaacaaacctagacaatagcaagctgacagagatacagagcaactagaactctcctgccctgcagatggaaatacaaaaaagtatacagctacttcagagaacaatttggtggtttcttataaagttaccatatgagctggcagtcccacttctaagtatttacccaaggaaatgaaacatgttcctgcaaaaaccagtaatgctctgttcataattgcccaaaactggaaacaacccaaatggtaatgtacatatagacaaatattaatgtgtgaatggacaaactatggtacatcatacaatggatgatgtaccaattataaaaaggaatgaactgttgatacgtgtgttgtagcaatttggaggaatctcgaagacattatacttttttaaaaaagctagtctcctgattccatttacatgatattttcaaaaaaataaaactgtagtggtagagaatgtgtactggttatccagtgctatggtttgaatgtttttgtcccctctgaaaattcatgttgaaacttaatcaccaatgcaacagtgttgggaggggggcccaatggaaggtgtatgtattggttcatatgggggagccctcacaaatggattaatgttgttataaaaagggcttgcggccgggcatggtggctcacgcctgtaatcccagcactttgagaggccgaggcgggtggatcatgaggtcaggagttcaagatcaaccaggccaagatggtgaaaccctgtctgtactaaaaatacaaaaaaaattagatgggcgtggtggtgagcgcttgtaatcccagctactcgggaggctgaggcagagaattgcctaaacctgcgaggcagaggatgcagtgagccgagatcacgccactgcactacagcctgggagacagagcgaaactctgtctcataaataaataaaaggataaaaagggcttgctctcttctgcttttctgccatgtgaggatgtaacatttgtctcattttgtcctccacctttcaccatgagtgtttacagccagaaagatcctcaccagatgctggcgccttgatcttggacttaccagcctccagagctgtgagaaacaaatttctgttgtttataaattaccctctctcaggtattctgttatggcagcacaaaatggaccaggggttatggtgggggagggtgtgtgactatggagagacagcatgagggagtttttggggtgatagaactgttctgtatcctgagtatggatatacatgtgttgaaattcatagaactgtatactcctacttcctcccaaaagtctgttttactgtatgctaacttaagaaataaaatggaagacatacaaagaaactgaacatgtgtctactttataaggcatttggtctaactactggtcaaataaacttgtataaatactgtctaatgttttctctattagattttttttacgtctcaaggatttgtatgaaaagtgactgatgcacagaaaacctttattttttattttttaaaaagtagaaacagagtctcactatgttgcccaggctggtttgaactcctaggctcaggtgatccccctgccttggcctcccaaagtgttgggattacaggtgtgagcgactgtgcccagctagaaaacctttcatattaaaataattagcactataatcatgtgcaaagaattgggatggtcacctagtacagcttcacattttaaaataggtaacaactatcatttattgaaataatgctgttcattggttttataacccaagtgatactatatccttagacactgtaatactacgtatatatgtatattttgaatttgatacgtcttttaagccttttaatctacagatcccccatctcatctgtctctttttcttacaagttagctattgaaccctgggctgtttgccttgtagagtttcccacagtttgcattctgctgattgcatactaatagtgcagtttaacactttcctctgttctctgtatgccctgtagattttcagctggattcagaggcttgatcctaattaggtgtgatccctttggcaaggcaataggaagtgtgtcatcagaaggcacttggctgtttggatgactctctttgtgacgttagcagccattgatactcactacttagatggattaattcattggaggttgcaaaatagtgatagtgatattctaaattatttctttttaatttattacttagcatacttccatagaatattttcttcatcactgtttggttattaaatagtataattcacaaggaaagccaggataaatacttgattctttatttttatttaccagttttcaagatactgaaattgttacatctaaacctgtgaagatgttttagggctttttttttttttttaacatgtttagattttcattcattgcaattaatatgcttaatgaagctcaaattgttgttacatctttgaccagtgggagcctgcccctcaccctctctctctttttttttttgtaaagataggttctttctctgtttccctttcctttccttacttttcaggcagagttttgctatgttgcccaagctggacttgaactcctgtgctcaagcaatcctccagcctcagcttcctgagtaactgggactacaggcacgtaccaccacacccgactctgctattgtttctttaaataaacattctgcccctttgtctgtctcttctctctcttcagctcttataatctgaaaattttctctatgctatcctataaatgttgtaacctttctttattttcatgtttttcccttctgggtggtgaaatctggtctctactaaaaatacaaaaaattagcagggcatggtggtgcatgcctgtaatcctagctgcttaggaggctgaggcagaagtcgcttgctcctgggaggcagaggctgtagtgagctggatgtcccacactgcactacagcctaggtgacagtgaatgagactctctcaaaaaaaaaaaaaaaacccaaaagaaagtaaattttgtttgagtttgttactaaacttggtgaatataagctgcattttttagtttccagtaaatcaaggcgcagtgtaatcattgtacattttatgttgaagagttataggaaaatacctttattttataataatgaaggaaaaggactttttggattggaaaggaatgttttgacaaaagattaaattaaaagattaaaacaattttttcttctgaaaattttttttcttcaaccagacaagataccattttttcaaatacatacatttttttcaaatggtatcttgtctggttgaattactagaatgtttttggcgtgtttagtagcaagtggtaagttcaattgaaatacaagctgaaaaattctaatggcccctggaagatggcagtataggcttttcatctcagaattttagatctggaggagacctttaaaatttattccagttccttcattataggagaatatctagacatctagggataatgatatgttatttctgagatcacatagtaaatttctgtttagagctgggactagtactaaacctcttcgtttctgtttcgggattagtttctcaatgccagaatgtgtttcttgaaaggcacgataaccagctcctgggctcctcatatcctacctaaattagtgcaactaaggcagtgtgacatatttatattggtatttttataaaggcacagaaacagacatgatttattcagtatcacagggatagtgttaggtcataagacccctgacctgttgattctatctctttatcttacctagtaagagatagcttagagatagtagccaaaatatccaatggttatgaactatagattgggagctggaagtggagctggtactagaaaccataaaaacgccagatgatgtttgtggtatggtgaagagtgctgggatgatgcaggcagggggtgatgaaagctttggtcatgagtaagtgggtctagaacctatagaatgggggggcggaataaaggaggcaatggagctaccatcaaactcatgcttatcaggaggatcgtttgttctgttctcattccctatagcatattgctactttccagctaagatttagaataatcatagacaataataaaataaaatacatctgatatctgcacaatattttaagcacagtactcataaatattgtactgtttgatccttgcagtatccttgtgagataagtagaagggatattggtgagtagaaactattaaatataatatgtgttaaggtagtgtgctagaaatcactaagggatataaaggtgaataaccacaggctctgttctcatggtgtgcccaatcttttggggatggggtgggaaaaataaacagttacaatgtataggaagttgaaaaggatttagaaattcaagctgtgtcccatgggaatttagaaagagtgatggtattgtaacaggaattttggtattttgccttcttaattcagactaactgaaaggataatgactgtaaaagcatcttgactgtaatagatactgatacgattttcctttataattttcagattattttttattttaggtgattttacacagctatttatatgaatgaatttatgaattaaggatgacagaaatcacttaaattgttttagtgatttttggcatattagtctggtttgagaaggagggagaaaacaagggaattgattttgtaatgtcaaacagaacttacaaatttaggacagatttacctagaccattatgaataaataaatagatccttttaattggtaagaaactagaccaaatttaatatagttgatttagtactagtttatgttgatgatgtagacaacttcaccaaaggaaggggagtagtgaataaattagttataacttattttactgtaaagtaatgttaattgttagaataattataggaaatatttgcttaccaataaatatgactttgacagtcttacaatgatgaattcgtttttgttgaaatagcagacaaaacagactttttcgttttgttcacttattcctagaatccattttagtctctagtttttgttagtatgtatcacctaccttaactatttttctttttgccaaaacagaaagaatgcggcttccgttgatatactggagtcacttagaatatcaatatcaacactacagagaaaggagaaggaaaggaagcaatataccattgtcagtgtgcttttctcttctgaggctttcatccttcttgtgttttctctcttaacattggcccatagctagaagacattgaggtcctgccttactgcatttttatcttagccatgagcagcataccccatactatatttaggttgataaattttcaatagtaaaattcttcatagtgagcagcctcttctaggctgtcgccacccctgccttaccctatttcactgtggaaagctcactttcttggttgaagcatctccctgtttgaagtccagctttggggaaacctagaatggccttaggaccatcagtgttacaagactcagtagtgcctgagtcatacttagcttttaaaacatgtttatagctttcactttttatgggtaaatagcccttttattatcaacacagtacttttctctttttcttaaaaatgaccaatttcaccactgatagagttaatttttgtcatctgttaaacatgttttcccatgactttgggttcttcttcatttcatatgtgattttgtgtgcatatgtatgcatgtgtgtgtggtttccttttttagaacaagatgtatttctttgaagatgagactcaatgggccatttgctgtttttctttcctcatctagggtaccttcagtttagctcacagttgtctttcttcctaatggtgtgggtaaaaatgactgactctgttcaatattacagattgaaaataaaacctgtgattcctagcctctttattttatacttctttattttaaagtctaacatttttctttctttatgctttcttttttctatcatggagataacttaagatgtttatttagttctataggtattctgtttctcctgaaaacttatacttatcgttttacttctcttcctttattatgttcatgttcagttagtctacagcagatcttgtaacgttcgactgaattctagttccactaacgataagcaagtatagcatttcttcttaagtgaataatttcttccatatatttgatgtggatatgatattatatgctgcactcttggttgtatcttttcaggtatatttctttttctcagagaaatctttcagtttgtatcttttctaaaatggggtttttcttacgttgggtttttattattgctgattactggatattgtttattctttggatgctgttgatattcacctatcatgaaagtaaactttcatggttaatcatttttttctattacgtaatgaagcaggatatttccctgactcctttgtgggactcgcaacaggggtgccttgtttacccagcctaccacccttccaccctattttttttttttttgagagggagtcttccctctgtcggccaggctagagtgcagtggcgctcactgcaagctccgcctcccaggttcacgccattctcctgcctcagcctccctagtagctgggactacaggcgcctgccaccgcaccccgctaattttttgtatttttgttagagacgaggttttgccgtgttagccaggatggtcttgatctcctgacctcgtgatccgcccgcctcagcctcccaaagtgctgggattacaggcatgagccactgcgccttgccccagcccaccactcttaactccttgtggaagggagtgcacaagtgaacgggtgtgggaattggagtgaatgagtactgaaaccagccggctgctttggcgccagagggctcaacctccactcactcagacccactgcgttctgcccctcgcaggagggagtgcgcatatgagtgggtgccggaacggccggatgctttagccacagcaggagtgaactctctgcaggccccacagcagtgtccaggagcgggtgcctgcgactattgaagctccagagggtgtgttacagtgctcttttagctccgctgtccgtggacagcttaagtgctaacaactcagtggaccctttgccttctttttgtgaagtggcagccctctgccagtgaggccaaagggccactgtgaaagccttttgtatccacacttgtggctcctgagctcttgtctggcgcccaggaaaaatgaggttacatgaatgaattgaaagatggtaaatgcaggggattttattggaaatgaaagggactctcagtggaaatggaagctgaaaaggggacagggtgggtaggtaatcttcccctgggaagttcagccatctctggcaagattcttctctgtagtaatgccatcaagctgtccttctgaagtcaagccacctctctccaatatctagccatcgtcttgtctaccagctgagtctggggtttttataggcacaggatgggatggggcaggaccgtgggtgatttaggaaaaggcaacatttgagccagaaaacggagatataagctctcactttgggccatggttacaggctttttggcttgagggtgaggttatgctggggacccaccattttctgcctagaatttctctgtcccccgttcctgtcaataatatgcatttcttaaatatctttagtttctcctatggtaatattttgttttcatatgagttccttctcattcttagatcctatttatgcttctttgctttaggataacttattgacatataagtggtatttattgaatacatctaatttttagaaaatttcagcattcagtgctgtcacaaagttaattaagttcatagtccccctttaaaatacagtgtttccaggtaagatggactaatagggatggtctttccacctaagacaactaaagaatgggacgaaataatgaaaccacagttctcaagacatttgccgtcaagcagcaaaagacattgatccccaagggatgggaaacaaattaggcgagatcatgcggttgctctagctcacacctagagagggtttgtagggatggaacaaagcagtggaacccaggaggagcctagagatttctctgtattgaagaggtagagctagctgggagattggggggccaaggcagctagagttcacaaggtagagtatgagaaaggagaaagctgcaagagacagaaattcacagatctgtagaaattgctttcaataattcaattgactactgatcaatacatgcctgtaaggaaactatgggaagctgcggaagaaccaccaaaaaggaattgagggaataatataataattagagctcacacatggttaggagtagggcctgaatccatcagacaaaaaaacttcataattcaacaggtatgtcaggtagaggacttccaacgttctagtttttatttctagatgttcaacttgggtcttttttgtctgtgtcttaatatacttaacctttcttctggcttttagtacatatggaacagatatataataacttttaatgtcctagtctcctaattctatcaaccctgtcatttctgggttggttttgattgattgatagctttccttctggctctgttttcttgccttagtttttttaacctgctagttaattaattgatgcatatcaggcatgtaaaataagacactgtaaattgtgccctgttgggtgctggacatttttatattcctatattcttttttttttttttaagagatggggtcttgctctgttacctgggcagtagtgcagtagcatggtcataggtcatggcagtattaaactcttgggctcaagtgatcctcctgttgcaacttcttgagtagttgggactacaggtgtgtaccaccagccctagtgcctgcagatatttttgaactttttcctggtctgtattgaagttatttgaaagtgttttttaacttttaggtattgcttttaatctttgttaagtgtaaccacttaatttaattttccccactactgaggcaaaacccttctgaatattttatgcttcatgaattatgagacttttccattctggctgttggttacagatgttaaattgaggatcagattgtcctttcatggcttgtttttaagctctattgggatcattatagagtcatctttattctagggcaaatttagccctcctgaggtctgtacctatggcctagagtgtaaagagatgtctctgctgtggctggatggaactcagatgtctccaagctcagtgtcagcccagagttgttcatattatagctcctggaggatgttttttgtctgactttatggaacttcaccctaagcatgtgtagattagtatttagttgatgactcaagtggaccccaatgtacatatctgtagcttttttctgcttaagtttctcctttctggtatatcattctagtaatttttgccacctccactgttccaaactctgttcttttcaagttagcaagactgctgtattctgctttgaatttccctcttggcaatggtgtctagaacatgtctctaggcagaaagccagggtggtcataggccttatctagtttgttttcttgtttcagggaacacagatctacactaattgttgttcactatctggaaactgtcatgtattttgtctggttttgcagttgcttaccatctgagggtaaatctgttaccagttattccataatggctggaagcatacatttcacactattggattattgaggagtttggcaaagacttttgggtgaagttacaggaaagaattacaataaacctttgctgactttagacttgatggctgtttaataattgtatgtttatgggctttgggagtagttgactatgtcttcttcaaatagatgtatgagataatgtaaataataaagcattatacaggctgggcatggtggctcatgtttgcaatcccggcactttgggaggctgaggcacgaggattacttgagcccaggagtttgataccagcctgggcaacatagcgagacccagtctctacaataaagtaaaacaaaataaattttaaaatcttaaaaaaaaagaaaatagttgtgttacctttgtggtgggaggagtttaagttggtgatattgcttttatattagttgtaattgcctaaaattgttttcagtagactttgatgtcattggagaaaaactgcttctcacaattaataatgtcaatcagagaaaaatctcatgttgttgacataagagtaaagcaagtggcagaaacacacatttctatagaatatattgtgtctttgtactgttcttgggtttttgtacttggtgacttgcgcatactacacactcagtgaacatttgatgtgcgaatctttattaaggccatttcacttttcagttaatcatattgattactgtgtgccaaacatgatactggatgagggagaggcagcaacaaatgaagtaggagaagggcccctgatcaaaagactgcatgagatggtgcatgtataaggcagcaaaatactctactgaagattaatggagtatagaatgattatgtcagctctcaggcagggaggtatagaggggctggattttgagaaagttgatggatatgcattgattgataaaggagaaaaaaatccctgttttttaaaaaaaggaatgttgtattgcagggtgacaactgagaataaacaaattgttctatggaaagaaagcaaaattaaattggtgttagtggaagtttgtgtagaagatagtaagaaactaggttatgtagctaaccgaggtgtcatacaaaatcgaggggaaatacaaaagattttgagctttggtctgaaaagaggtacacttctgaatgccttttatgttaaaagatagacaaagttaaagaattttatattcacaaagcaagttatatgagcgctaacttattgtaagttgaactatgaagcaaattaaaccactgagtgttactgagtttgggtataatttgcaaaatgaaaacccattttttgttgacatttggaaagtgcttacagaataagtcagtgtacaaaataagtgaatttgcatgttatgactggctacataaagaaaagttaaaggtatttaaaaaattatataataatgctaactgaagcttgagtagggctgaatttcatatatttttattttgtttcaggttgctgcttttgctcagaggacatccatgaccctaatggtctttttgttcaagataaagtgattttttgcctttgttgattaactggacaaattcaggttagtgtattttgtggacagcacttccctgttctaattatatgttaatattttgagaaatagataattttgtggttaaagctacatgttatgtaccagtaaagcagaaaggccaagtcagtctaaactctgttgaattgtgtattagttaagaaacattttcttactgcctactatatacaatattcactgcataaattgaaaaaaatttacttccttttaaatagttttgtactttaaattatggggctggataaaacaagttgtggttgaatgcggtacactgaacttttggcatcgttgtgtggcatatttggtgctaaaaataagcaactcatcttaaacatttctgacatttttagtagctggcttttaaaggtattcttgtccagatttcagtcctacattaacatttttatttatttttagtgttcattctattaattttgacaaatatatatcaccacaattaaaacattctctaaaccttccaaatttgctcgtgttgcctatttgtagttaacctctccttatacctcaatccctagcaatcactgatctgctttctatccctgtaatttgccttttccaatgttatttaattggaatcatctaagatgtagtttttaaatcctggctttcacttagaataatatatttgaggtttattcatgttgctgtgtgcatcagtagttgtgtatcagtagtttgtccttttttattgctgagtagtgttccattttatggatataccataattagtttattcatatacctgtttatggatatttaggctgtttttagtttttgatgatcataaaactgctgcaatcatacattaaaaaaatgtgactctatgttctttaaaaaatttggtggggcatggtggctcaaacctgtaatcccagcactttgggaggctgaggcgggcggatcatgaggtcaagagatcaagaccatcctggccaacatgatgaaacctcatctctactaaaaatacaaaaattagttgggtgtggtggttcacgtctgtagtcccagctatttgggaggccgaggtaggagaatcgcttgaacccgggaggcagaggttgcagtgagccgagatcacaccattgcactctagtctggtgacagagtgagactctgtctcaaaaaaaaaaaaaaaatttttttttgcattgatgcatgttaggtgtacatacttatattcagggtacatgtgataatttgatacctttatgtaataaaatcagggtaattggaatatccgttaacttaaatattcattttttctttatattaagaaaatttgaattattctcttccctagctattttgaaatgtacagtcaactaagtaaggttaactataatcaccctattgatctattgaacaccaggtcttatttcttctaagtgtatgtttgtacccattagtcaacctttcttcatcccctgaccccatgtattttttactaatagaaattactttttgttgttgctactgttaaagcgctgtgatgatttaactattgccttttaggccatggttgcatttcttttttaaaatgttattaaaacataatgagaacacaatttaacagacattgtggctaggggaagaaacttgcaatttatggtcattttgagtatagaaagagaaatgatgtaaaattattagaaaggggatctattggaacttgtggtgttccctgattttggagatactaggtagccttcttgaatatagtggtagtgtagcaagacgagctgcagacaaaacctctcagacaccgagttatagaaggaagggctttattcagctgggagtatcggcaagctactgccttaaaatctcagctccctgagtgcacaatttctgtcccttttaagggctcacaacactaaagatttcacatgaaagggttgtgattgattggagcaagcagggggtacgtgacaggggctgcatgcactggtggtcagagtgaaacagaacagagcagggagtttcacaatacagtgcctgaaatctatgtgtaacatcgggttctaagtcatgagttgatttttaactactaggtttaggccaggcaggcccaggcctggttttgggcctggtgccgggctgcctgtctttgatttcacttccttgttttttttcttaaaacaggtactgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttaggaggctgaggcaggagaatggcgtgaacccaggaggcagagcttgcagtgagccgagatcctgccactgcactccagcctgggcgacagagcgagactccgtctcaaaaaaaaaaaaaacaaaaaaaacaggtactgagtgtaaaacaatataaaacaacatgagagggtctctcttccctcagtagaccagaaatatacaggtagattaataacgtcaagcctcatataggtagcttcaaaagtcatctagaaaagtcaagtaaattagaattctatattaaaaacatacttaaagagggtaaaggttgggcatggaaaagtcagtttaaactttcttgaatgaatatgtaggatgaaagtgatagaaactgtctttctgccttggggaaattaatgacctcaaaaagtagcttgaaaccctatttgaatatttataaggaaactgtagttcattatttgttatagaaataaaaaggtcttgagaaagtattatgctctgactcagaaaatgtaggatggtttagactctagcttctaagcctggacattaaaagacttactgcaactttaaattgttttcttgtttctgaacatttttagatgaattatgtaattttcatagtatctctgtagatacgtggcctgctgtattgtgttctcagaaaacatttctttaaaacctttttttcctttcctttcttttcttttctttcttttttttttttttttgagacaagaatctctctgccactcaggctggagtgcagtggctcaatttccgctcactgcaaccttcacttcctgggttcaaacagttctcatgcctcagactcccaaatagctgggattacagatgtgtgtcaccatgcccagctaatttttgtatttttagaagagatggggtttcaccatgttggctaggctggtctcaaacttcttggctcaagcggtctgcccacctcagcctcctgaagtgctgggattatagatgtgaggcactgtgcccggtcagagaacatttcttaaatagacaaaacattttaggcagagtcagagcattttagagctatttctgaaagagaatagttatctgttcaacgggcaaatacaacacagagtcaaagataatgctgtgctcagaagtcatgatttcttcaggattttagggtatttagattttaaaccacaattctaaggtcaatatttatgtaaagtatttatgaaaataaaagccatatttaaatttaaatttaatatgctttaattcacataaaatattttgaggttgttacaaaataaaaaaatttagatttttctagctatatattcaatatcagcatattttttgcatatttgaaaattgagattctgtcttgtaccgtttaaatggtagcctgtttaacttaaaattaactgcaaaagaaataaacaaaaactgagtttttgtaaataatattaaattgagtaatttaacttaatcccacccattaggttaagcaatgatcccaggataaagagagagagagaatgatgagtaaaatgaaccctacactgcaatgtctccagatagctgtatgagtaaaagcttaccatctcagctcttgggtctttattttcttattttaaaaaaaggcgttaaggtccacattaaagtcaggtataattggtaaagtttaaaactgctagtctcttttatttcacgaacactgccaggccttggaaattattgataaaacttgattcactgtgagaaacagtcaaaaaataataaaaaaaatagcattttattttaaagttaaagaataataaaataaaaataaaaacttgcttgagatacttttctagaaatggaacattttacaatgaaaataggatccaaacatataagtatttacttttggatatttgatagataggcttgttataagattgtgactcagctgaagtggttttagtttatacagatttttgagagaagaaagtacacctttttgctctatatgttttctctggaaacatctcattgtattgtaccaattttgtcttgattctctaagaatctttttagtcttttaggacaaaggaaataggtattgagagacatttctcttcaatccatggatctcttctgtttctgcacattcgctgagcagagtactgatagcttttgttgggggctatctttttcaaagaaatctgtttagcaaacagcctaggaagatagaaatagtgcttccattaggacagatggcacatttctttgctgtccaggataattaagataatctctctagggaaaaaggttgggcatatttgcttgtagctccttttaaagattggagtttcattaagctcaggttttcttgtcctgtaatgcaacccacagtatgtgcacttggttttcctttcattggcctttaggaattagagcttgaggaatcagtaaaaaatatggtactctgtctatgctattgttgtgagtagtaaactgttctttgtttctgatctaggagtgtcataacttctgccaggattatctgatgctagcttaccagctacactactaacacatcctattgataaaacaaagctgagttcattgcttattgtggtaagggagaacacctaaaaaaatctttggtagggtcttagagaggtcaaaatttgagaatttgaagtttgttttaagttggatctttcagtggtggcgatgaggcttgattaggattgggtaggtatcatgataaaacagtttaggtttggtggaaacagtaagattttgaaaactgccgaagagttgatgggtctttccagaaggtctgtaatgaacaatcacattatatttctgctgtctcctagaatagcagttatgctaattaagacagtggactggtaaagtcatgttaatgtacctagaaagctgtgtgtgtgtgtattagttttctagggctgctataacaaagcactgtaaactgggtggcttaatatagcagaaatttattctttcagttttggaggttagcagtctgaaatcaaggtgttggcagggccacactctctccgaaggctctaggtaagaatcctttccttcttcttttagcttatggtggatgccagaaatccttggtatttcttgacttttggtagcataactccaatctctacctcagtattcacatgacatcttccctctgtgtgtgtttgtgttcaaatgtccttcttataaggattccagtcatgtattagggtccatcctaatccagaatgacattatatcaacttgattatatctgcatagaccctatttctagccgttacacattttgggaggacacttatttaactcagtataggggacatgtagtttcagtcttcagtgcccaaactgtatgtaggtacagtgtttgctctcagtgtccatgaaactatggcagactgatgttagcttgcatgtagggtaaaatcttaggttcttcagagttcttgacaacagcatggtatagtagaaagaaaaccagtctggaagtcagagtaccttagttctgctctgttaataactagcttaagaaagttactgtcttctttagctattagtttgttactgatacaccaggagttcagtctaggtcctgctgcttgctgcatagaaagccaatcactgagacaatgagtattgccaaggaagaaggctttaatcaggggcggcagctgagaagatgggagcttggtctcaattccatctccctgactgactaaaaccagggtttatatagcagggaagacatagattttaacaatgtgtaagaaaacaggaacttgggaggaggggcgaggaagcaataatggtgaatgaggggtctggcatctggtagggtgatctggtttcagttctttgatactttttgtgccaaaagaacagtctgtgggactattgggtttgtttcaatttcctcatagataaaatttgaggcctgaggaagagaagagtaaaccaaatgatctttaagacatttctagttctcacattctgaagttttataatgttgagtggctgctacatactgtattaatattagtcttgttggagtcacaaaaagggaatagaaaatgctttaagtgctaatcagataggctctaacttgtgaatgtagcttgcgtaaattaatttgtttatttgggtgaagctaattaatgaagacattaggtaaacatgatgtttgccctgatctctctgacttaccattttgtttttcaacttgaatagtgtatttggaagaagagcattcttcaggtcacttaaagttagaaaaatgctgcactctcaggctgagttcataaaatgaaataacctttcctgaagtgaatatgagaatgtggttccccttcccccttcattgcccacgtttgtctgtcatgtcattcttgtggtcaagagattttagaaaaattcttactagagaatggtaatagtactgtgaggtggagcatggtgttagaattctaggtgtaagtgaatcatgtgctattgaattttctttgcgttttaaataggtcactgtagtatcgtatttgaattctttgtttgaatcatgttgaaagtatgtaataattactgcacagagatattgtgggcactgaaaaattctttggtactaccaaaaccccctgtggtcatgtatgtgcttgttctttgaagttacaaatgaacaatgactacatattgatgataagtataaatacaggttgaaccaatgtttttagatctggacaaaagttactgaagtaggagaaaggacggatttttattaattccatatggaagaaattcaaaaccatataccagggggagataggattgtctcaccacttaacttaaggatcttcctgtatgtagcccttccatcacacacaaattgtactaagtgttttcatagtggatatttgggcaattcagagactctcactacatgttgtaacaatggtaatgtatttaattaattttagaagatacattagaatatagaattagcagtaacactccagcaatacctgaaataaaatgtgttaaaacagacagaatatagaaattaaatagacataattacaataataaaaagatatacctctatcatatttctattcacatttctattctagtcaattaaaagagtaggagaattttttatctttctttattaatttttttgagacagggcctcactctattgcccaggctggagtgcactggcgcagtcacggctcactgcagccttgacctccttggctcaggtgattctcccacatcagcctcctgagttgctgcgattgcaggtgcacaccaccatgcctggctaattttttgcattttttgtagagatggagttttgccatgttgcccaggctgatcttgaactcctgtgctcaagcagttccccacctcagcctcccaaagtgctgggattacaggagtcagccaccgtgcctggctaatatattttcttagtgttaaagaaaagaatgttaaggagttactcagaaagtaacttgaacttttggtgtgggctgttttgatgattgttgggaagattttctttttttcttcattcctggggccatggtggctgatcatccaagcttggattaaactctgttccttgtacttttccttctcattttaggttttggagtcagtatacttatattaccaagaaaataaggttcctccaacttgtaagaaatattttctagtttcagagaattatgaattggtaaagattgaaaaagatggtatggatgtgtttgaattattcacttttatggtgtatagtcttcactttccatgttgtgttttgttggactcaaagatgcttgagaagttagagagattctccctggctcccccagccacccctgcagccccactggggaaaaaaggaaacaaaggaggaaaaccgtgttgaacacatattttttcttaagcacctatactggattaatgtattactgtgaaagttgtttaattggagtttttttaaaatagatttttatttcttagggcagttttaggtttacagagaaattgtaatttcttacagagagttcccaaatatctcccccttttatcttacaatctgtagtaattgcttattatttccaggagtttgttggtcagtactttgggttttttttttttttttttttacatagatgatcatgtcatctgcaaatagagagttttatttctttcttctcaatttgtgtaccttttatgtccttttcttgttttactgcattagctaggatgtccagtatgatgttgaataggagtggtaagaagggaagtccttgccttgttcctgatcctacggggaaaggatctggtttcttaccattaggtatggtgtttgctgtaagttttttgtaaattttatttatcaagtggaggaaatcctcctctatttctagtttgctgagaacatgtaattattaactgatgtagaattttatcaaatacttttattgcatctattgatatgatctgattgtatgattttttttttctgtttcctggattacattaattgacttttagatgttgaacctaccttgcatacttggaatatactctacttggtcgtggtgtataatgtgatttgctgagatttttgagaacatttgcctctgtgttcatgaaagatattgttctgtaattttcctttcttgtaaggctgttgcctgggcttatgatcggggtaatgttggcctctgagaatgagttagaagtgctcactctgcttctacagattgtagaatattggtatcatctgttccttaaatatttgatagaattcacgaatgaattatcttgagtgtggtgctttctgttttggaagattattaattatttattcaggttttaaaaattgatttaggcttattcagattatttgtttcttcttgtgtgaattttggtagattgtgtcttttaagggattggtccatttcacctaagttatcaaatttaagggcatagaaccagctttgagtcttgttgattttctttgttttcctgttttcaattttgctctgatttttgttgttttcttctgcttcctttggatttaatttgttcattttctggtttcctaaattaaaagcttagatgattaattttacctttcttcttttttaacatatacattcaatgctaaaaattaatctcttagtcctgctttgctgcatcccacatttatttacttacttacttacttatttatgaaatggggtctcattatgttgcccaggctggtctagagctcctagcctcaagtgatcctcctgccttagcctcccaaagtgctgggattacatgtatgagccactgtgcccggccataaattttggtgttttattttcatgtacacttagtttaaaatattttataatttctcaagactatttttttgatctacgagttatttgtaagtgagctgtttaaacatctccaaatattttgagattttccagctatgtttttgtttaactagtttaattccattgtggtgtgtctatttgtatggtgtctattctttaaaatttgttaaggtatattttgtagtctctctttgtgaaatgttccctgtggatttgagaagagtgtgtatactgctgttgctggatgaagtgttctataaatgtcagttagatctagttgattgatggtgtcatcagttctatgataccttcctgattttctgcttctgtcaattaccgatagagggttgttgaagctccaactatgatattgaattcatgtgtttctccttgtagttctatcagtttttattataccttatgtattttgacactctgtagttaggtacatacatataaagatgattatgtcttcttggtgaataataacagattgaccatctgttattaggtaatgcccctctatcactgataatttttcttggccttaagcttgctctttctgaaatttttatagccattccaggtttcttttgattaggtttagcatagcctatctttctccatccctttacttttaatctgtcttcatctttatatttagagtgggatttttgtagacatcatatagtagggtcttgtcgtttgatttgctctcgacagcatgtgtcttttaactggtgtatttagaccacagatgtttaaagtaattattgatatagttggattaatgtctactgtatttataactgttttctactcattgtccttgttctttcttttttcgtctttcactttgtctctgccttcttcattgtaattcagcattttatataattccattttgtctcctgttttaaaatataaattatacttaatttaaaattatcttttaggctgaggatggttgctcatgcctgtaatcccagcactttgggaggccaaggcgggtggatcacctgaggtcaggagttcgagactagcctggccaacatggtgaaaccctgtctctactaaaaatacaaaagttagccaggtgtgctggcgcacgcctgtaatcccagctactcagggggctgaggcaggagaatttcttgaacccaggaggtggaggttgcagtgagccaagatcgcactactgcaccctagtctgggcgacagagcaagactgtctcaaaaaaaaaaagaataaaatgaaattattttttagttgttgccccacagtttgcaataattacacagttaaactgatccaagttcactttttaaataacactttaccacttcatgggtagtgcaaataccttacaacttagtattgtcagttcctttttcccattccttataacattacttttatttgttttacttttccataatttacagtcactaaatatattgttgctattattattttgaacaagttgttatctgttagatgaattaaggatcagaaaaacaaaagatttagttttacctttatttttttcctctacactcttcctttctttttgtaatccatatttctgatctatataattttccttctttctgaataacttctgttaacatttcttgcaagtcatgtttattgggtttcatttctcccagtttttatttcagaaagtctttatttcttcacttttggaggatacttttgctgggattctataggcattctagtttggtattttattttattttttttaacagcccagaggtcttattttattttatttttttgagatggagtctcattctgttactcaggctggagtgcagtggcacgatcttggctcactgcaaccactgcctcccgggttcaagcgattctcctgcctcagcctcctaagtagctgggactacaggtgcgcaccaccacacctggctaattttttgtatttcttttcttttttatttttgagacagagtctcacactgtcgcccgggctggagtgcagtggtgtgatcttggctcactgcaacctccacctcctgggttcaagcgatcctcctgcctcagcctcctgagtagctggaattagaggcgcccatcaccacgcccagctaattttttgtatttttagtagagagggtttcactatgttggccaggctggtctcgaactcctgacctcatggtctgcccgcctcagcctcccaaagtgctgggattacaggtgtgagccaccgtgcccagccagtctagaggtcttttattttttttaacacctgttatgctatgaattcacagggaataggttccagcagctcaggctccttcccactggttctcacaaagtgtgcttctctggatggagcaggctggtgcttcagtagaacccgggtacctttctctttggcttctttctttttccgatcattttcctttacgtgtttcaggaagctattttggctcttagagtgctgaatgtgctcaatacgcacattaattctcttggcaagaatcttgcccttaacttgtttgttgacaagttgtttacaataccaacagcatgctgagtaacgtgtttgtttacaacttgcttacagtgccaacagcatgttgggtaacactgcagactcttccagttttgccatgataacactcgcggagcattcctttttgaatagtacccattcccttgatgtctacaatatcacctttcttatagattcgcatacatgtggccaaaggaacaactccatgtttactaaaaggcctagagaacatatatcgggtgcctctcttctttccctttgtgttcgtccttttggcgaattactggaagatggtggttccggccgaaaggttggatttttttttttttttttttaacactaaatatttcacttcactctttttgcttgcatggtttctgaagagaaagtttgatctaattctttatttctctgtggataagatgttttctgtgtgtgttgatttttttctttacctcttgcttctttcgagatatcttattggtcttaaagttaataaggaaaaaactaaagttttgcttttgatttagttttctctttgtcttattttctgcagcttcactatcatttgcctatgtaaatattttggtatttatcttgcttggtgttctctgaacttccaggtttggtgtttcttactaaagacattctttcctgttacagtgttattgatttgtacactccccttcctcgcctcccctcttcactgttttttccttctctttactcttcctttctttccacaggatctcactctgtcaccctggctggagtgcagtagtggcgtgatcataactcgctgcagtcttgaactcctaggctcaagtgattctccctcctcagcttctcaagtagccaggactacaggtgtgtgccaccatgcctggcgattaaaaaaaaaatcgtagaaacagggtctccaatgttgcccaggccggtcttagaaaaaaggacttagctgggcatggtggtggcatgcacctgtagtcctacctgcttgggaagctgtggcaggaagattgtttgtgcctaggagttcaaggctacagtgcgctgtgaatcaccactgtactccagactgggtaacagtgagaccctgtctcaaaacatatatataaaaaaaaattcctggtgataatttgataattcctggtaaaaatttctgccacatccgagtctgtttccgaggcttgctttgtttcttcagattgtattttttgcctttatagtgcctcataattttttttcatagccagacagaatgtatcaggtaaaaggaactgaggtaaataggcctttagtgtgaggttttatgtttatctgtttagaagtcaggctgtgtttagtgtttgttctggctgtggtatcggaggcaaatgttacgggatctttaaggtgttgcttttctgtctagaaacctctgtggccagtggcgcctttgcccgagttcttgtcctgtgtccaggaagaattatgtatgcagacaagtggagggtgagcaagacaaagagaagctttactgagtgttagaacagctcagaggagagctgcagagggcagcccctctctataggcaggttgtctcatccagtgttcagctctcagcagagaggaggccctggagtgagtggctcctctctgcaggcaggtccccattgacttcccagctctcagcagagacgatagctcctctctgcagctagtcatctggctgtctctctggcctctgccctgctctggctgatctcggggcttttatggacctcagtggggaggaagtgtgtcaattggtacatcggtggccatgggtgggctggaaaaggcaccacaagcccccactgcagtctgcgggactggcagcccggtccccaacgttcaggccctccctggcctgaaggtggggtctatctggggacgtgcccccttccacccaggagcctgtctgcttcctgccactttccatggctcccaggctgcttgtgccaaggggcacctgcctgccagcatggagcagctctccacctcagcttcctcagagggggcctaggcggcagggcctgagcatgcgcatatcctgttgggctgtgatgatatccaggcttggctccaaccccactctgagaacctgccacattggagccggtgcgggaagtggcagcgggaacaggcatttccgagcctgcaaaggcaaggggggccttcctgagcccccaagagcacacggaggcctgggtccacaaccctgacttgggtagctgcagctgtatggggttgggggacagggctcctgcctgtttccagtccccaagagcacatggaggcctgggtctaccacccaggcttgggtggcttgggctgctgcctgctcctggctcccactggcactgtggagcatgcagccctggctccgccccctttcagcctgagacaggggctccagatccttgctggacctgggctgggatccggggcaggggtgacatcgccgggagctaccccagttgccctggcgcttcagtggcccaggcagagcagataactgtccggcctggctgttgggagtggcaggctcagcagtcgcctgatgtggggtggaccctggggatgtagccccgggcagccctgcacagagcctcctcctgaggcccaggaacctggcaccctcagtggggtgggcgcagtggctgtgtcactggctggtccctgaagtgggcaccgctcccacttcctgcctcaggcccctgaagctcagcctcagctctgcatcggtctgctctctgcttgactgtgctgcacagagggcggcgggctgttgagggagggggtctgtccgcctctccctgtgccgtccatgtaccagaaagccaccgccatcactattagaggctaaaatttcttctactgtccttgcttttatctgccctgttgtctttgggtttttgtaaagaatccttaaatggggtctgaggcttgcaggtttttaagttgtaatcctgtgttgtacaagagctgtactgatgtggtggtaagggtagagggatgagggggaaagttctatagtcctgtaattagatctcaggactatagaactttccccctcatccctctgccctctaccaactgtgagcctgagttgagtaactgtctctttttctcggtcaaaggatagatggggctggagttgggtatttcccttccctccggttggttaggcactgtaaaaccgtagtaggttaggcaatctaaaagccagttggttaggttctggtaaaatagtttccttttctggaataccttttaagagaaataaagttcctggcgtatttcaaaatggtttttcttcttcccctgctgcaagcaggaggggttttttttcagatctttaccatgagaacctggtagggctcctggaggtaaaactcaggaaagtatggggacccctgtaagactggtccccttacagtttttaactctcaagctagtccacaattactgtttcaagtgttcctactgatgctggcttcagttgagagcttgtattcctggacttctgcttcctgcacactgtgattctctatctgcctgtcttgtctctccaggttttagagcagcagtttgccctctgacctcaattctctgatggctctaagaagagttggattatcagtttttttttttttacccccagctttttttcttgtcgtgaggttgggagtgatgaattacaagctctttacaactgtacttaaggttattttttgaccatttttgatgcttttgtaactagtcaaaagacttattacagtatcctttatctcatttggcagtattgttcattaagaattttatctctttctgacatcaggtctgcacattttggggataatatattctaatttgcaagaaagattaaaaaacttctccagagggaagttgatcataggactgattcttattattgatgaattgactgccttgtcttgttttgtgttgctatgtaggaatacctgaggctaggtaatttataaagagtttgatttaccgcacagttctgcaggctgtacaagaagtatggcaccaggatcggcttgtagtgagggccttaggctacttccactgatagcagaaggcaaagaggtgccagcttgtgcacaaaatgagagaggagaaaagggtgggaggaggggccctggctctttttaacaaccagctcttgggggaacaaatagagtgagacctcaagcatgcctgaggaagagcattaatttattcttgagggttctgacccctccccaccatgcccaacaacatctcccattaggccccacccccaacattgagatcaaatttcaacaggagggacaatcatctaagtgatagcatagactcaggctatttactattctgttttcaagtatagattgagggcaacagcagcctttgttttctatgttgatggccaaaggtttatttttatattcttatactgtaaaaaaaaaaacaactttatttttatagcctttttgggtgtagggtcatgtcaggctttactaattgcacttctgataagtatactgatgatgctgaggatggttattaaagccctatgctgatactttggatttatggaaccaattaatttgatgactcatttacattgaatttcttaattagtagattgcccactaattatttttatgagcacagaataaggtaatgtttattcttattttttttgtgatatggtaaaaaacttagttcatataatgaatttagtgctcaaatatcttagtagaaattgaagtagaaaaagacattgttgtaaattaaatgtaagatataattttattttctttagaaaactttacattgaaaagatcacattatagataatttagacaacttatttataacttttatttattattattattgaatgtaaaagaattacatgcagtcccatgatcttaacataactgtggttaccatgttggtatatgtgccttttagtcctttttcatacacaattttttttacaaagttataataataatttcttttcaaatttgtgccttatttcagttaacagtgtaaatgtttcccatttctaacaatgttttctcattgagtgaggtactgttaggttggtcagactgatagtttattgtacgtattgctgtaatatctttgtacatttagcttttccatgtttgtaccatatctttgggttttcagaagtctgtctctctctctgtttctctttttgtctgtcttttctatctctcaccttcatttggggagcattttgtgttctctttcacaggactaattaagttttattggatcttgaaaaacgggattagaaattttttcttacttatataattagaaaacaatgcttttggacttacattgccacggcagtttacacagttttattcccaaaaattgtagttttgtgactaggtgataaaaatgatctcctatatgtgccaaacttggtattctagacactcatacttaggatgtaaattgactgtagtccaataatttaatatgttgtgtttaattcttgtaatattttactcacaaattgaacttttccttaccaatttaatgtttgtaggcttaatttggcatctttgtcaggattattagacttctctgcattcttctgacttctccctaaactaatgtttagaactgaattgggtccagcaatttaagtggaaaatcagtatgactagagacttctagaaacttctggtgtcactgagatggtgaatttgatgattctgaccctacttgctcatctgtaaaagctattagaggattgttttaagcatttctattctatacaggtatatgtacaccatgtaataccactcagccataaagaagaatgaaataacatttttgcagcaatttgggtggagctgtaggccattattctaagtgaagtaactcaggaatacaaaactgaataccatatgttctcacaagcgggagctaagtcatgggtacgcaaaggcatacagaatagtaaaatagactttggagactgagacgcggggagaataggaagaagataagggataaaaaacgatatattgggtacaatgtatgctactttggtgatgggtgtagtaaaatctcagacttcaccactatacatttcatccatgtaacccaaaaccacttgtactccaaaagctattgaaataaaaaagatatttaaaaaaaaagaggccaggcaggttggttcacgcctgtaatcccagcactttgggaggctgaggcgggcggatcacttgaggtcaggagttcgggaccagcctgaccaacatggtgaaaacctgtctctactgaaaaaaaaaaaaaaaagccaggcgtgctggctcccacctgtaatcccagctactcatggggctgggcgaatcgcttgaacctgggaggcagaggttgcagtgagccgagattgtgccactgcactctaagagcaaaactctgtctcaaaaataaataaataaataaaaaattaaaaaagatcttctgttgtacctaatcttctagccttattatttcttagagattttataaatccatgtggcttttttactcttgtcatcttcaagttatttgccaagattgaaaaataaccatctttctcctaataccttggtgagcctgagagaagaaaatactacacagttcattttattgtaaaagtagtgaaatttctcaactgatattcatccttcatttttgtggatttgttcagggaagataagatttattgtttatttttattttgctgtattgccaggctggtctggaacttctgagctcaagcagtcctcctgcctcggccttccaaagtgttgggattataggtgtgagccaccgcacctggctggaagacaggatttttttgggaaagtaaatatcacttgagaatatctactagtatggaatctaaagttatgcatacaaggatgatctcatatttctttgtatcttgttcccagtctttcccccaatcttgtctcgctttttcctcaacaagcgtagttaacaactactatgaatttggaatacaaaatgataacgaccctgcctttaggaaactgacaatttagaaggtcaactagaaatataagttaataattacagtacaggaagtcccctgatttcctctataataacatgtctcccaaaatgtgattgaaaataaaaattccacatgtcataggcgtaggaggtatttgggtgtttgtatggagagtcatttcacagagctaaaatttattattataaaatactcaattctagttcctgggcatgttatctcctttggaattagaaatcttagttgctgcataacattaaaagtgtcaggatgatgcctgtaatcccagcacttttgaaggtagaggcagagcattgcttgaggccaggattttgagaccagcctgggcaacatagtgagaccctgtctctaccaaaaaatttaaaaaaattagccaagcatggtggtgtgtgcatgtagtcctaggtacttaggaggctgaggcagaggatcgcttgagctcaggtatttgaggctgcagtgaggctgcagtgaggctgagctctaccatatagagctcaggctctatatggtagagccactgcaatccagcctccgcaacagagtgagaccttgtcttggggggcaaaaagtgtaaggatgggatttctaggcatatttggggctgaggaaatcagtcttgggcccaacctccttgtagggggtgaggtggcaacctctggaatttgaggcctgctactgggattgtaggtataggaagttgagagggaaagggtctttctcaccctgctgtggtagtaagagcttggtgcttaatgggtgccttttagttgtttgatcacctaggatttctgcttagaacccagcaatacttgtaggcctgcacagtcccaagagagaaatcagagacttggtgataagtcaagggtaagagatgagataagagagcacctacactataggatattagaactacaactccaattactccttcactctcatctttttccctctcccagctgccaagtatatgtgactagtggtttgtccagagcaggactggaggatggggtaggaagaattattattttttcatcatagatcaggatagtgtcatgtccccctaaacttcagggaggcctggcttcatacctcttcttccaatttcctagcattgtgcaatgacaaagcttcatgcagtaactcaaaatcattgttaataaggtgatatctaaaagattgaatttgatgttctgaagttagtgtgaggatgtcagtctgttaatgtgtgaaatgttttgagctgtgtgaaactcaattttgcttagtgtgttaagtacaactgaagtaggtgtaaaagtcagtagtagcacacagaaaggagtaatgaattgtgtctagagggtcaggaaaggtctcacaaaggagaggatccttgaattctttgttcaagtggtagagttaaagaagtagattttttttttttttttttttttttttttttttttggcgacagggttttgctgtaggtctcccaggctggagtacagtggcgctatcatagctcactgcaatctctaaacttctgggctcaagcatagaaatagatctgatagtggaagtctctgcccagtaatactgagatcttggaaccttactcatttcagaaatggctctggtctgaatacattatatgggactaagctcttctaaatatctttatcccttaattctttatgcataaacttcagcaacttctaagctaccattaggaaattttcactgtaaattatatactggatgattgaatttttagaattagatttattccaaatgtaagtcaacctaaatgtaaagtttttctctacttaaatataagcttttttggcactcttgaagattctgagtatttctgtggacagttatggccatcagggtgtttgtttgaattctggaattgccctagagagcacataagctgtggagtaaagcaggtgtgtggtctgactcctgacttggtcacttaagatctgtgcaaccttgaatagtaacttcgatgctaattttccacatctgtaaaatatggataaaaaatgcagagtctttagcacagttcctggcatgaagtaatggctcaataaatgttaattattactattgttaactaaataagagttccctaggtctctgacttcaaacatatagttgttggagactatgaataccttggggccaccttgagctaagactagatgctcaggagcacctttttgattagtcatttattcattgagcatatatttttgcattgtttaaactttagcaaaatacctaagtcagtcaattctatttttatacagatatttctatatagaggagatttcctataggatgacctgttctgggtgtgtctatctgacctgcagctaatcaagtgactacagctttgctaattttttttttgaaaaaccctaatattgttaaacagtagtacagaggaaataagctgttggtcagcttctaaattctggcacgggttagatttgcctaagagcaaatcatatagcaagagttgatgagagaacttttctcatatcttctagcctgggtaagtttgtctcatttggtgtcaagtcagaggaatctgaactatagaaccaaattgtagggaaagatgactaagggtttgtgatgtctttttttttttttacccccctcaaaggagttctaggtgtaaaaagcatcatggtttaaacgttacgaggcatcagtgaaggcagcagaaaagtcagaaactaatatagccaagtctagattgtatctgttataaactctttaatcagaagattctagcttctagaaccaggtctgtaaaatgttgagagccctctaagtaaactccattatagtcatttaattgatttttctttgtctttcttcttggacatactcttctttaaagagagcgttcccccctctaccccagatagtatctatctttgaggttttgagaacaatagtattcttgttctttaggttctgagttgctgacttgagggaatttgatacacaggagtccccaaggccccccagtggatacctgaaaccatggatagtactgaaccctatatatacaggtcaggcatcccaaatctgaaatccaaaacgttccaaaatctgaaaccgacgtgacactctgaagaaatgctcactggagcattttggatttgtggatttgagatgctcaactggtaagtataacacaaatatccccaataggaaaaactccctattcccattagtttttacttgatattctgaattcttaagtgtgatttttttttctaatttggggatagctcctatttttgtgagagaaattaatgggaaattttgagatggtaactagaaattgtctttgcagtgttaaatttttagttgggaggctactaggctgggtggctctagctgtttaagttcctgtctaagcaaaccaaagcccaacttagaaagtaaaaggaaactagatattttgccaactagaaaccacctaagtaatctctaactagtgtctttccactctgaccaatgagatatgttttctttgtcttccgtgttcagcctataaagcttacagcccacactgctgtgaatgaagctcttcaaaccttttatggttcagagtgctgcctaattgatgaatcattctttgcacagataaactcttttgtctgtttttgctttaaacaacaaaggaacataaattctgttaattgattgtatgaatataacagtgaaaattccctgttaggctttggttatcagtattttaggaatactttttaaaacatcccctttagcttttaatgtgttttggttagacaagatgatgtatgtgtcagtataatgccaggctcacaaaagttgctaactaaatgttagttccttcaatacatacattcattccctgggacatggttccaaaagtagattatcataagaattctgtgagaagctttgaaaaaactacagatgtctatggcatatattaatacatggcgtctatatccatacatgtatgtaaatgtatgcaaacaatttaatctactttttccttaacattaactccttcagatagaatggttggcccaaatgatttaattattttttaggttgttgattcatagaaacaaatcccctgcagaaaggttgtaccaatttacacggttacctttcttcacattttctctaacactgggtattcttgagcttttagtatttctcagttggtggaaaggatctcttagtttgttgggatctctttgattatgagtgagattcagcattttccataatttactgatgtctgcatttcttcctccctccttccctttcttctttcctttctccttctcctacttccactttctcccgtcctgtcctccctttcccctgctctccctctttcttccccttctatccccctcccctcctgtttttccttctttgcttgtttttgatctctgttcttccacatatgaagattctattttgaccagcaataagttgaattatggggctagaagataaggactaaaaacaagaattggtgtccagaaaggtggggtaattttgattactatgcctgttgcaaacatgagcaagatgttaaatgtatcatagatctgcaaggtttttttaattcatattttttatctattgtctcattaatgttatctttgagaaatggttcttttcagtttgagaatgggggaattggatttaaaattttcttacatgaagaaaccaaatattttgctgctatcctttggaaacttcttactatgattggttctgggtggcattggaatcagtttgaaatgatgccattaatgaccacatgtttggatttcttgactatgggtaaatgtgattagaacagaaatcccttaataatagggattctttatctttgtgtccctagtgcctcatagtatctggccctaattaggagctttagaagtgcttattgactgattgcttttttatctgaatcggccctttctatcccatcattatgataacatccatcttggtagtagtaaaactgttgcaaactgcagaaatgaactgtgattttttttttttttttttttttttttaaagacagggtctcactctgtcacccaggctggagtgcagtggcatgaacatcttaatagctcactgcagcctcaacctccccaggcttaggtgatcctcccacctcagccaccagagtagctggaactacaggtacactccatcatgcccagctaatttttgtattttttgtagagacaggtttcatcatgttgcccaggctggtttcaatctcctgggctcaagggatctgcctaccttggcctcccaaagtattgggattacaggtgtcagccacggtgcctggcacaaataactttttcagacaccacttttgattcttctgggtatgtatccagaagtggaatcactggtatcatactgtaattctattttttttttttaaatggagtctcactcactcaggctggagcgtagtggtactatctcggctcactgcaaccactgccttctgggttcaaatgattctcctacctcagccttccaagtagctgggactacaggcgtgtaccaccacactggctaatttttttttgtatttttagtagagatggggtttcaccatgttggctaggctggtctcgaactgctaacctcaagtgatctgcctgccttggcctcccaaagtgctagaattataggcatgaccatcgttttcagcctctttaattcttttttcaattttttgaggagacatcatactgttttccacagtggctacaccattttacatttccatcagcactgcacagggttctaatttcagcacattcttaccaacacttattttctgctggtttttttttataatcatcatcatcttaatgggtgtgaagtggtatctcattgtggttttgatttgcatttttgaaatgataagtgatgttgagcatcttttcttatgcttactgttcatttgcatattttctttggagaaatacctatttaagtcctttgcccactgttgagtcagattttttgttgttgagttttagggatactttttaaagatgctaatcacgtgaactcctttttaagtgatttataattccgtaacatatacttttttttttctgatcgatttccttatagtttgtattctagtgggttaatggagtgtgatttttttttaaaacagctttgctgaggtgtgattggcataaaaaatactgcacacatctgaaatgaacaatttgattagttttgacatatgtatacatctgtgaatccatactcattacctccacagatttcttcttgcccccttgtaatcttttcccccactactacccatccttccttgtctccaggaaaatcctgaattgcttttggtcactataaatttagtgccttttctaaagtttttttttaaaatggaacttctagtatatacttttgggcaggggctgtccattcctgtgtttatttatcctttgtatattttctttggtaaaatatctgttcaaatattttggccattatttaaattgggttgtttgttttcttattattgagttttgagagcggtttatattcttgatcaaagttgtttataagatacgtgcttcgcagatgtatttttcctggactgttgcttgtcttttctttctcttaatagtgtcttttgaagagcacacattttaaattatgatgaaatttgtttgttctcatatggattgtgtttatctatcagtttgttctcatatggattctatttttgtttatgtatctaagatatatttgcctaatccaagggcatagaagttctctcctggaagttttatggttttgtatttagacctatgatgcattttgagttaatttttttatatgggataaaaattggatagaaattcttttttggggggtagagacatgcagttatttcagcatcatttactgaagtggtttgtgtccttttgatttttgtcaaaaatcatttgactgtatacgcgtgggtttatttctgactcttattttgttccactgacctctttgtctttcttttttttttgtctctcataccagctcagttttaattttaaagtgacaaatgtacaggtggaataaaattttaagcaacaccctccaaattcctcttacatgacaagaagaagctgaatgtaattttgctctataaccaactaaacagtagctcaggatagacataaagccaacttttccaattaagcctttgtgaaaatcaatttctaaatggatcacaactccaggatattgtttctgtgctgtgatttctttgtctttcttgatgccactaccatgctgactattatggctttataagtcatgaaatcgggtcacgttaacccatacaactgcttgttccttttcagagcaattttggctattgtgctggttaccaatctgttgcctctcagctccaaatgcatcctttttgcctgctctgtgaaaatagatcaggccctttaaatatttttcttttgtcagctgacaatgttaagttttgccagtacagagtgctggagaaacactgcagagaagttttgcttgttcgtttctgtgtacttgcttagtggactgtagcaacacactcagcttctccagtgtcaacccacattggctttcccactctacagtttctgtaggatgcatgttttcaccattatcaggcttctgcagtgctcagagggcagcaatacccagcaaccagtgacccgaggccagcaacttcttttacttccccctcagttggatttgtaacagagtatctttggtgggacacttctgtgtgaagagattttactagcaccctaaagaatggatttctggcaagttccacaaggtagacttccagtaagttctgctggtgcagcactacagcaacttccgtgctattcagtgagaggactgtgttctctccaacaaggtctggatctcagccctgggatggtttagggtcggaggaagctcttgccttggtgttctgtgtcagcctagggagcattggctactcttaagagttctctttatttctcattagttaattagctgtttctccaaccccatgttaaatagttagtgatcctttttattaagctttcacttttcaaattactgtgtggcttttctctccggaatggctttacatttccatatgaatttaagaaacagtatgtaaatatttgattggaattgcatcgaatctatagatgaatttgagggacagttgacatcttaacgatatcaagtcttctgactcatgaataaaatgtctccatttatttggatgtttaatttctttcagcagtattttattgttttcaatgtactgatcttacccatattttattaggttgatctttaagtattttatattttttgatgcttttataaatatttaaataacatatcaattttttttttttgagacagagttattggccaagtgtggtcagtaactgtcacccaggctggagtgtggtggcatgatatcagctcactgcaaccttcaccttctggtttcaagtgattcttctgactcagcctcctgagtagctgagattgctcagctaccacacccagctaatttttgtatttttaatagggatgggatttcaccatcttggccaggctggtctcgaactcctgacctcaagtatctgccctcctcggcctcccaaagtgctgggattaaaggcgtgagccaccacacccggccaataacatacaatttttaattgttcattactaatgtataagaatgcaattgatttttgtatagtggcattgtatcctgaaaacctgctgtactcattctggtagctttttttgtagattacattggcttttctgcatagacaaagcatgtcttttgtgaataaagagagctttatttcttccattctaataaaaagacaatccttttatttctttttcttgcctgatttcactggctaaaacctctgatataatgttgaatagaaaaagagcagacatcttagtcttgtttctaatcttagggggaaagcatctattctctcacaattaagtatgatgttgtagatttttcaggatgcactttactgggctgaggaagtttttttccattcctagtttgggtaaagtgtaaaagaaaattaggaatggattttgaattttgtcagttttttttaatgtgttgaaatgatcccatgtttgttttttttaaagttttttattagccagacatggtggcacacacctgtagtcccagttactcgggaggctgaggtgcaaagattgcttgaacttgggtggtagaggcttcagggagccaagatcatgccactgcactccagcctgggtgacagggtgaggccctgtctcaaaaaaataaaaaaatttgttaatatggtggattacattgcttgatttttaaaggttaatccaactgtatgtttctgaaataagcccacttggttatgatgtatatttggcttcttgatgttgccccacagttcactgatgctctttatattctttttgtgttcttttctctttttgtgttgtatttttggatcgtctttattggtatttttccaagttcatggatttttttcttctacggtgtctaatctgttaattctatgtagttttttatgttagatattatagttttcatctttagagttttgatttagatcttttttatatcttccatgtctcttaatgttttggctatatgaaatgcatttagaataacttttagactaggcgtggtggctcatgcctgtaattccagcactttgggagtctgaggtgggagaattgcttgagcccaggtattcaggactaccctggccaacatagtaatacttcgtctctattaaaaaaaataataataatttttaatgtccttgtttgctaacatctgggttggtttcagtcaattgattgctttattcatgttttcatgcctctttgcatatctggtaatcttcagctgacagacattgtgaattttaccttttttgagtgttagatattcttttattattagaaatactgttgaattttgttccggatatgtagttatttagagataatttgaggcttgcttttatgatttttttaagaggcctggagcaatgctcaatccagggctagttattcctcactactgaggcaagaccttcttaagcactccactcaatgtcctctgtgaattaagagctttaccagtttggctggtagtaacaggcaatattcctaagtctgcatgattatccatcactattctctcaaattctttcagatgtttttttccccagcctccagtagttgtctcacactttgagctaatcagtactgtgctgaatatttgagaggccctgctgcagatttctgggttttgttctctgcgtagccaccctgctactttcccggggctagctacctttgtcttcatggactctaagctcttctgtttcatcaactcaagttagtttatccacgcacctagctccccttggatttctttctcttccctgggccttagcctgaaaagtctccaaaggttgtaagctgggacaattgaagggtattgcttgtttcctgtctctctagaatcgctgttctttgttgcttaatgtccagtttcttgaaaaatgttgttttctatattatgtccgtttttcttttaagtgagaggacaaacctggttgttactgcatcctgacctccatatatagcatatttttaaccccattattttccattttttaaaactttttttcccattattttctgtagtaaaaataattctggtttgaaaattacaatttctttatgttttagcactagctaatgcaagtatctattatatacaaattgtattggcaattttctttctaaaaaatccccccaattattctgcatatataataatacctacgttttaaaaggtatttttttccaatattattttcagttggttaaaataaactacagtacatactagtggagtctgattgaactgatgtgaagaatacagaaaaatacttagaaatgtttagagaacgcattgtgatgaaatctgttaggagtacaattgttttaactgtaaagcttggcattactggatgggagacagctatagaatacttaagccttattggtgaacatataggaagaggtggaaataagagatgaattacatgaagaagtctttaagtcatggaggcttactgaaatattgaaaaaagcaaataagtagacctaacaagatagagggggctcagaagaatgcatttgtttcttatagatggtagctggagctagggcagtgtagcttatggctttgcttgaatagaaagagttgatttgggataattggatttaaatcctctatttaccacttgctaactgggtaagttttttaaactaaatttctgattttgcatgtgtaaaatgaggataagcatatttatcccgagggttgtagtgagccttaaatagaatcaattacatagaagtatatagcagtatgtttgtgtgcttaataagtgtttgtctttattattttaaagaaatgaccagagaaagctttacttttctattgcatatttccctagtgattatatggacatagaagcagtgcttacagttaccttggaacccatcaaggaaaaatgaagcaaattcctgccctgttgcccttctggaacattacatagtttagatgaaaatcagccagagcacagttagactctattagcataagattatgttagaaaatagtgggcatgataaggccctgaaggagagttctaacttggagaaggatggtggaatttttttatagggctttgacagtaggggtcaggcaaagttcagtttgaggagtagttagtcaaggatagctctcagaggaggggagaattgatcatgtacattagcaattattgggcaatttgaattttattaagaatgttggggctgggcatggtggctcacgcctgtaatcccagcactttgggaggccaggcaggcagatcacttgagatcaggagttcgagatcagcctggccaacatggtgagaccccgtctctactaaaaatacaaaaattagccaggtgaggtggtgggtgcctgtaatccaagctactcgggaggctgaggcaggagaatcacttgaacccgggaggcagaggttgcagtgagcagagattgtgccactgcacactccagcatgagcagcagagtgagactccgtctcaaaaaaaaaaaaaaaaaaaaactcagtttttagtgtcttcacagtagatttttttgtcattggctcttgcggcctttcttcttgtctcccccagttccagccccccaaaatagaagggcccattatcttgctcatgattttagattcccagctcttgattttggaaggcgctgtctttgtgaaatttcagagatcaaggagttagtgttttgtggtgtgggaaatttctctcagtctttgctccttgcattctttgtgcagttttttctttgtttatttcagagacagggtcttgctctgttgcccaggctggagtacagtggtgtgatcataactcactgcagccttgaatttctgagctcaagtgatcttcctgtctaagcctcctgagtagctaggactacaagtgtgtgccaccacgtctggctaaaaattttttttagacatgggtcttgctatgttgcccagactggtctgaaactcctggcctcaagcagtcctcccacctctgcctcccaaagtgctgagattaggggcgtgagctacctcacccagcctgcagtgtgtcttggatcctgttatgtaggtgctctgtagtagaggaaacagtaatatatgataatgaaaagcttcaaagtagacatatggctgaaagggagatttgaatagggttttgcagcagctattttagttgatgacacatcttcaacttaaattgcaattgccttttttcatttcgcttcatccttctgtgatgatcctagtagaagtcaaatgagatcatttttgatagttggtttgcaggcttcggtgtatgcacccaacctttcaaagactgcctgtgcttttcagggagctcagttttgtgactgaaaggatcagctattctcttctacctttttaatgcactactggtttctagcagctgctgcttaacgctgttcattcttgagtttggtgaattgttttctgtgctccatgtgatttctttgtctttatgaggtacattttgactacaggtgagccaatttcctgtgaatataatctatgctttgaaattaaattatctttatcctctttaaatatgtaaatcttcttagtatctgctagtttgcctcttgctttgtggctccttgtgttcctcttgtaatgcttgcttagcttttaatttaaataccagactgtgttggttagcatccatagaagacataggcctattcaggaaagtgtgaatatttggccaccatatttaggattattggggcatttctttccaatttttcagagtacagaaaaagaggtgagtttcctattccttcctaatcaagttcaccatcgaccttgtactttttgaaccaacttgaatagaaaaaaaacaacctgaagaataatatgtttactatttctacatggatatactgactataactatggaaaatatatttgattagttacatgaggctctcatggtaaatgtgtcagatatagtcaatattttagtattgtcatgtagtattaagtatttttccatcaatgattagaaagttatgattttttgttgttcagcaaattatcatgaaaaattcaataatgttgctttttctttttgatagccagaggaagttagagaacagatttatctaacactaaacggtcactggcaagaaccttttctttgtaacatgttactttgttccctaacctcattctcctccacctgtaacaatggtgaatatgaagcaagtgttcagtatcctagctttctctaattttctgggacgtatctcttttagtctccgtatattaaatcttagggaacctgaaaggcttctttattagccttttttatttctccctaaaagtattgatgtttttataggaatctctgctatccagggataaaacataacatgcaattaaaaaaatttcagccattgagaatgtttttataaatggacagatcagttacttaaaaagttctatagatttgtgattaaaaaaatagttccctatttgaataattgtccaggaaattagctgttgatcatatttaaaatataacataaaaatgagtcttaaaatatgtatagcttcatttgtgttgattgatgttgtaactttttttgagtaaaatgcatcattagaaaatgtatttggaattacattaaaaaggattctatgttttgtttattggtatcacacacgtgtcatgtgggtcatagacttgtttcatagtaaaacagatggcatggcaagggagaagaaacttacatgcaagtttttgcacaaatatcaaagaaattcagtgtactttcttttcaaaaaaacattaaaaactccaaaacccaaggaagaaaaagcttcttgcatttatataacaattcttaatctattagttgcagggcaaaaataataaaatattaattatatagtcaaaaatagcttttaactatgaagaagtcttcctatcaaattcttctgttcattaaacctacttttggttattatttaaatgtaattgggcagttccaagaaaagcttcagaacagctgtaattacagctgcagatttagtcaaaataggggctgtaagaggctgtttactctccttttgcatctctttcacccccaccccaaataacccaaatttagttgtaaaagtttttggtaagctcaggatttctgaaactggagtctatgtatttaactgcatgcagatgtgatgattacatgtgacttttaaggttcccataaccttttagttcttgtattgctctatgcacagttaagtgatttttgtcagctgtgtctgtattgaattttacagatacacatatattttaaacacagtttagtgatttttatcaaggcccaggcatctgctcaaactactgagaagggtaatagttttcaatctaaatttgagctaatgttgacattattacaagttgactggaaacatttacaaaagcctgtatctgtgttaaaaaaatatatttcttcaaattttactctactaggaaattgcctttgacttcatctgaaaacaaatttggcaaatgtcttaatttttagagaaagacctactatgataaatcaaaaactaaatacacatctatgtcacatccctccctcctcccagagctttgatctggggagttgatggcattctaaggtctggtttttagttaatcagtcagagattatatataagggttatggaagactgtggcaaaaagcaaggtttagagcctttttccctttccgagttaattaccatttcttttgcagatggcagttatgctgaatattgatcataagatacaataacatatcttggattctcaccacagttttacagtgttacctactcagaatctggttcaaaattgtagtgacttgttgaattgcacatagggaaatttgaagagccttctgctaaagccaacaatttaacacttttagttagaagaccaagtgaaacttgcctgtatttgcattggaccatattaaaactggtaagggtataaaattatataggacatggttcttacctcaaagtacagtgggtagacaaggtgcaaatatatgcattaaaataatacatcaatgattagggtaaataaacttacttttaaatccccagactcaacaactctttaaatcttgaattctaaagatcgagaccaactttcttacagatgaggaaacatattcagagaagtgcagtgaattgtcattaatcaaagggggtttataggtcattctaaatatgagctcagtaatgacaataggtagcaagttaactttgctttttaaatcttgaatgtcagctaatgttgactgattgcttgtttcaagtatttttacagagaaacttctggtccttttctcatgtgagtccagtgggaatatcagcagcatggggacaataggttattttcagactggataaaattgaacagaagccatttcagagaatactggagaactgaaaagaataataaaacacattcattaaggcaaaataagggaactatatttataaaatcacataatttttaaagcacgaattgatttataggtatgaggaaaggtagcaggtaaaatgtgatatggaatataattttgatgattaagtataacttaataattatgtgaggaaaaaggaattaacagaaaatcttttaggaaggtaaatagaactttgagactttagtaagataggaaaagtgaaatgtgaaaaacaagttaattttatatagggaggctatagatttaactcattgttaaaaacttgtcatcatcacaatctttttgtgccttcttccttaccccactggttctctcttaagagaagctctggtgtcatgtgttgtgatgtaatatagtgctgtaaagttctgattttgtcacttacagccagcctggtcttggaataaaattttgcttatgaagacattaaaaaaatgaataattttgaattagttacttggacttgtgagcttcagttacttagcaaaaaatgagattatgtcttcaatgtgcctaattatacaattgttgggacaatcaagtgaaatcacatgaaagtgttttaaaaaccaaaggtaagtaatatttttttcatattaaaactgtagattcaatccaacatgacagatatttataagcatgttaaatcaagtttagccgaaagctgccttcttacttcagtttagcctaaaggtttttgagctataacaagtggaggcatattgtgagctataacaagtggaggcagaaacagactgtagccacacttgtgccagtcactaagttttggccaatcaaatgtagtcaactgttcaaactgtgttcaaataaggcaaacaccaacctgtaaccagtccagctgtttttgtacgtcacttcctttttctgtatgtcacttcctttttctgtacatcactttcctttttctgtccttaaatcttccaccatgtggctgtgctggagtctcagcgcctactctggcttaggagcgtgcctgatttgcagattgttcattgttcagttaaactcctttaaatttaattctgctgaagtttttcttttatcaagtacctaatatgtcagacgcagtgttgtagactttagatttcaggagaaggaagagaaaggaaataaaacataatgtaaatgtctataatatatgacagaatatgaaaagggtaataagagattcagcttacctatattttggcttaggcaaagagttacccacctgaatctgctctaagtccatgaggcttgtttaccacaagtggcaaagtaggaattttgaccatttcgtgtctctgtctctccctccccacctgcttcccttctctcctcccctttatctccccactccctctctgtctccccatctctctccctgccataaggtgaaagtttaaacttgggctctccaatagttgcagataggagcttgttgatttttttgtgtacaagcgtgaatcagtggccaagtcaaagtgccataaggaatgtacaatttttagactttggtgagtattgccaatgatatagcgtctagattttaatatctgcattgtatacctttccagggcatagaggattaaagggggactttagaaacaactatttcagtcatctgtgaagatactttttacagaatcccagacttagcttgacggctttttatagtgaggaatctttctatcatgtaatgcagaccactttattatgggctccagtatttggagttcttagtcccaaatgaccaccttctccctctgttattctgtattcttttcattttgttagatatattttggcttgactgaagagagaacctgttgatggggaagctaggaatagaaagagaagggataggttcaggaagcttgacaaaaaaggaaataatggtagtaataatggttaataattcttagcactgaagtctcaggtactgtgctaaatgcttttcttatattataacctatagaattgatgttttaatattaaatattaattaaatgaaagattagtttgatagtaaataatagtatttaccctctgttacagaaaagaaactgagctacaataatttgcccagcaaaaggtagagttcttgctgggctattgattctagagaccaaacctttaacattgccatgtattgtctcttagggataaccttggaggcctctttgggaaaaattttctccttttttttttctaagtatgatagtgtttggaaataaaagattaacatttcaaggctggtaatttgggtggaagtggggaggaggtgaataaaatttattcaatattttaaggttagatgaagagataaggaaaggaaggaacctggaagcagatgagtgaatgtaatatgctttgttagtcagggagaaaggaaattttggtttagctgttgtaatgactacattttataatactatataaacatgcaagtttgatctttgtatagtttagtaaaagctatggtcattagtttatagtccagtgctgtccaatagaaatgtagagtgaaccacacatgtaattttttaactttttgttagctacatttaaaaagcaaaaagaagcagttaaaattggtttcagttatttaacgtaatgtattcaaaatatttcaacaactaatcaatataaaaatatcaattagagttttacattcttttattcatattaagtctttgaaatccatgtgtattttacacttatagcacatctcagttcaaactaaccacatttcatatggctacatttggctactgaataccttaccagacagtgcatttacatactattagaagagaaaaggtttattgtagttgctatgttcataaaaagtttctgattgaattacaagtagatggcttattctccctctgtatgtaacaaacaaggagtgaagaggaatctggggctgcaaagcatcgctctccagttgtatccagagaatctactcaggaggggcaacgtatttttttattttttattttttaaattttactttaagttctgggatacatgtgcagaatgtgcaggttcgttgcataagtatacatgtgccatggtggtttgctgcacctatcaacccatcatctaggttttaagccccgcatgcattaggtatttgtctgaggaatgaaactataaacatattaaatcctataaaaagaaaaaaaagtaaggttctgaagggttccagaattcaggagacggaagagaaaggatattttttatacttaaggaagtggggaggaaggtttaccaaatgtttaggtttctgctgattgaggctttgttgtatagttagaaggacttccaagagactccagaatttctgctatcgtagttctgggctctggttttacctaaaaactcaatgctttttctctagatagagctctggaggagaggcacacagttcttacttagtgtgaaacatggtgtttgttggtttagggactttgtacctctttctggaacctttcagaacctttttttttctttttataggatttaatatgtttatagtttcattcctcaggcaggaattactgaagtttgcttttcccttaaaaaaaaaaaaaacccagtaaattaaataatcacatttaaaaaactatagcaaatcttttctaactatgaaagttaaaaaaagtcatgtattctttgtgaaaagttaggtaattgagatacctgtttttacatattaaatgaacaggtctcaagcagagttttcactttggctgctgcttcttgcactggggttccttgggcaggagcactctggtgaatcatcacctctggtttggatgtagtagtactggatattttgtttcttttaaggagagtgtgaacaaatgggagttatgtgttcctccggggtatggtccatttgtatattgctctttatctgtgtatcatattttatttggctaagagcctaattataatatatttaatttttaaaaatcttagctatttgtagggtttaaaaaactaaacaacagcaataggatttgtattgctaattgagagataccaggttaaaatacaagttttctatataatttagcagaataaaacacacttatcatttttccattttctgaatttgtaatatgctaatgttatcagtatataatattttttgctatgactaattgtgttatatttgttgtgaatgtagtcttggttcaagtaggggtaaggaggtattttggaaaccagtgcttaccattttggggataggtggtgggaatagacaagctagaaatacacttggaaggaagaaaaccatttagtaggaacttgagatgaggggagaaacagacatttttaggaaagtgtagtgttttaaaaaataaatttagacacaaaaaattaatcattaggaacataatcagattttagaaaaatttaagtagaaaaaaatcacgttaaatagataactttgaagtaaatactaattatgtttatattttgaggggaggaaataagtctcttagttggcccccttgaggctgcctagatgtggagaaccataagactgagtttgtaccatctttgagttaaaaagctaaccctgagtgattttggaatagattcctttaacatattttcagtcatattccttttagaattattattacatagatttcctaatttgtaattctcaagtgctgtgaaacattaaacatttttagcaacctcaacccatcatagtcctatgactgcccttctttcacttttagtcatataggaacatttataagagtatctgatatggttagactttgtctcctcacccaaatctcatcttgaattgtaatccccataatccccacgtgtcaagggagagacctggtgggaggtgactggatcatgggggtcgttcccccatgctgttctcatgttagtgagttctcatgagatctgatggttttatacgtgtctgacagttcctccttcacccactcgctctctcttgcctgccgccatgtaagacatgcctcttccccttctgccatgattgtaagtttcctgaggcctccccagccatgcagaactgtgagtcaattaaacctcttttctttataaattacccaattttgggcagttcttcatagcagtgtgagaatggactctggccatgattttcttggtatgactcaggaaaattcttctatggggtatggctgtggagtggttttgtgcttgctgttgttgccgtggtgcttcagaaagttagcctagattaaagagttcaggttttggagtcacatgggttgtcttgaattctgtctctgacccttaactacccctgtgacattgggcaagttactagacctcagtttcctcaactgcaaattggaaataatagcaaccacctcctagggttgtgatgaagtttaaggataaatgctgctctttttattgagcatttatttattccagccagacactgtgttacatacttcatatgcagtatataatttaatttgtatgtgtatattagagtatgtaaaagttcatttccaacggtaatatatgtccagtaaccggttgctattactttttctatatgttgattccttaatcagaagttgatgttcctaagatgaaagatgggaatgggcattttgatcagatctgaaggacttgtttggaagttgacagtggtttgaaggtgaaatatttactagagtgtggttcaaggataatctgcatggtaattaccttggaagcttgttaaaatgtagagttttgtgtttgtcatctgaaactctgagtctgaatcaggatctctggccgtggagcccagaccctgcagttttataagcttaatcataattcttattctctatgaagtttttgaatcatctttttaatttattcttcccgatgattaaaaaatgattctaatgatttttaaatatttttatttgatgtaatgagctttccattttattggtaatggaggtggtaaattttttccatttaaatgtttacatatatgtgatttttgtatgttataagagtttaatgggtggtgacattcattcagctaatgtttagtaaatattaaaatattaaaatttataaaatacaatttacttatttggagtattttaaaatgaatatatcattttattcagttattcaaacaaaatgattgttgagactatgagtaaaatagtctcaatttactataaaatatgtcatattttactcagtttatagtctccgaatagggtgggaaaggagagcagattgagaatgtgctgttatgaagctaggtggagaggggaagggagcgattttctgctgctaactagaagaaaagcataactacaaataatttatataactaataagatttcaaagcagatagaaattttcagggagttttggtcagagtcattttattagtcatattatttaatgaaagaataatcaggaatgctcagcctctgtgttttctactattgctttgctccctaagaacgctcttttagattttatctgtctattcttttgagttttatctttgccttcctgggaagtctcactcgactttttaggaaatcaagttgtatccccacagtgcttcacatgaccttattttttttagattcttcaagtaaaatcttactcaaaggaaccaataaattgcctcacgtcataattttaaacttaagtgtttggaagactaatttcagtgagtctttgcattggtatctttagcccacaaatctttttggctccagtatccactttaataattcttatgggttaagtaactgtatttttaatatctgtagttttgttcattatcagaaactaggtcaccagggtttgttgtgtcattgttaattaaaaaggtattgtatgctttttttttggaatgtgcttgtactgaatgaagccaaaatatgttagtaatgctctgctttaaatactcatagaatataattttgcatattttaaactcaatctatctgccagtacaacaatgttatttatctctgagaattttgactattctttcatgctatttagaattcaatgaattgttaaaacttctagtaggctttttactgacagtctctgtctgacttctcctttacaagttttcctcaatattttcagaagtaacatttgggtcttactgaaataggaatttttggttctatagtagcagatggaaacagtagacttttttagaggttggaagcagtgggatacagagaaggagaaaaatcagactaaatttatgtcatgcctctttcattgtgaaaaataattatagcctcatgtacattacttttctgagggttgtagtggtggtaatggttgtggaagtagtaatagttgtagggatgaattaaggaggcattgggtaagaacgtgtctcccaacataggatttcagttacttcccaaatataaataacagtggttattaccaaaaatttttcttcaagcgacagtgatctcactgtatgttgcccaggctggcctgaaactcctaggctcaagtgattctcctgcctcaacctcccaagttgctgggactacagacacacacacacaccaccatacctggctgaatttttttttaaccagagaagagcacactaattttttctttacccttatagcattttcattaccagttattatactttcattctgaatgatttcagaatgtttggggatggtgttgataaactagaattattttgtggttaagtagaggccctcaaacagagtacagctcaagtctcaggtttaccacttttttttttaagtagtacatggggcaaattatttaatatcttattttgccataactaattattaataaatatctactttataggtgtgttgatgattaaatcaatttgtaaagaataatgggctgggtgcagtggcttgtgcctgtaatcccaacactttgggaggccgaggtgggaggattacttgagcctaggagttcgagataattctgagcaacaagcgaggcctcatatgtataaaaaatgaaaaacttaggctggtgcggtggtgtgtgcctgtagtctcagctacatgggaggctgaggcaggaggattgcttgagtccatcgaggtctatccaggctgcagtgatctgtgattgtaccattgcactccagcctgagcaacacagcaagaccctgtctcaaaaaaaaaaaaaaaatgccagcaaatagtatgtgttgaatatttagttataagtattattcactctctaaaatagtcttcttagtaaactctaattgaccttagggtaaaaaaatttttatatttaaaagctcagaaaaattcagcttagttatttttaggctggtgtttggtctcacatacacacttaacgcccctttcaaactgttatggaacaatgtttttcaaactttaatgtgcatatgggattgtgtagggatcataataacatgtagattcttattcagtagttttggaataggatgagatgttacctttccaacaagctcctgttggtaatctggatgtagctcattcttataacacactttgagtagcacagttatgcagtgttccattaagtggttctcattcctgctttcagtatattataaacacttagatattttttgttctttatgccttggctctgtgtcataccagttaaattagagctttgcctttggggttctgggcatcatcgtcgtcatcattgtcgtcatcatcatcatcattttttctttcggtaaaaatatcctggatcattctcttgtgaaactagcattaagagccaccactttagttatctgaaggagagtcataagctaagaagctacattttaggtcttctcttactttgttgtcttccattttaagctcatttcctctgtagagatgatggtggacagctggttagaactcttaaactggaaggcagttaatatgttggcctgaagttttcttttcgctagactaaaaggtttgactgttgaacctttctttatggatcctatttcctatcccttttcatcatttgtatagtcttctttggactttccctaatttctcaatagtctccttaaagtgtaataacccaaactagatacaaaactgctgtaacaaaactgaacaatggcagaggcagaagaatatagatctaaaaatctgtggttttcattagcgttgaaaacttgtatttgcttcagactttttattggccttttctttatgtttttcagggttaaaatgtgttttatgccatgatatttgtttcaatatattcctttcttaggttatgcttcttctttcttcctcaactgtgcttcttgtatccatttcccatcttgcacctattttggaggagaggcagtaaatattttcttatggacttaccatgtttgggaagaccgttttccaaagcgatcaagatcatgttaaattttattccatctagccatgatggctcagttaggatcaggtcaggaaaacagtccacactaaatactcgaggcaggaggatttcttgagaccaggagtttgagaccagcctgggtaacatagtaagacctgtctctacagaattacaaacaaaaacaaaaaatttcagcccagaaaatttaatacagggaagggattatacaggtattggagggctgaaaaagcaaacagggaacactggggtaacacagagacaatatttgcaggaattagccactattcatatggttgagggggaaataagaacttggagttgggacctcatagaattggggttcaaaacctctggagggggtacttcctgacagctgttggtatgtctgaggggaatttctgagagtgccagaaaaagctggtggttatcactgctactgctggggtggaggatctatgctgggcaatgctgactggaaaaagcatgtactgcattctccctctagtgtccttattggcagtgtgaggaagctagctgcagaagagaaaagtagttttcagagttttattttcagtattacaaagatgagtattaaagggtagatttggatctgagagaaaatagctgaataaccagtatatatagccttctcttctggtcaaaggaggccataggcctttggtctcttggtctcttttcctagctacttggaccccagacccagatattcttaatgctgagggtttggaaggaaagttgttattattatttaaaaaattaatttgtttagttaatgtgatgggggagggggcatgagacgggtctactttgtcttttcttttctttcttttttttttttgagacagtgtcttgctctgatgcccaggctggaatatagtggtgtaatcttggctctctgtagtcccgagctcccaaactcaagcagtcctctcacctcagccacccaagtagctgggactacaggcacctgccaccacacccagctaatttttgtattttttgtagagacgaggttttgctatgttggccaggctggtctcgaactcctggcctcgagtgattcacccatgttggcctccaagtggtctgggattacaggtgtgagccaccatgcctggctgggtccacttatttattgttatttttttttttgagacagaatctcactctgtcactcaggctggggtgcagtggtgggatctcagctcactgcaatctccaccccccaggttcaagtgattctcctgcctcagcctcccgagtagctgggattataggcacccaccaccatgcctggctaatttttgtctttttagtagagacagggtttcaccatgttgcccaggctggtctcgaactccagacctcaagtgatctgtccgccttaggctcccatagtgctgggattacaggtgtgagccaccgtgcccggcccgggtccacttattctgagataattctgttacagctttttttggtaacttacatttaatcattagatactccttctttgcctcttgaggtatttctgttttttaaaagcccttatttaaaatgtaaaataaataatggtaaaagtaatgatgttacccataaacaaagttttaaaattggttgcttattagccaaacagtggtctgcagtggtaaccaacctctgaaaagattatgccttttttactcattcaaaaattccccctcctgcagagcttcttcaattttaatgtgtatatgaatcagttgaggatcttggtaaaatactgattctgattcaatatgtccctgggtaaggcctgagattgtgcatttctaacaagctcccaggggaggctggagctactggtccctagaccagacttttttaactcccttccctcccttgagaactactggtttggcttagatccagtgttggacttggatggttgagtggtgagtgatcataaagtaagagtttctattgtaagcctgcccgtctagaaatattttgagcaattttagtagagctatttatagctgtttctttccaggtaggatcagagaaatatatgcttctgaataggttaaattttcttccataatataatgctgccctgaatgcagaaatgtgcctatcacttgtaattttcctggaaggcgtgagactgcttggtaattgtgtacatatttaagggaaactgagtaatggaggacagaatagaacaattaacaaattcatgcatcagataacttgctttcattaaagccattgttactcttatttattgattgttcctgatgataggacatctgcagatttcaaaaagtgtgtttagtgtgaatttcatactgatggcatttctctgcttttgacagtttcatatacttaaacttgtcattaaaacacagcatcttgccttgagccaaatgaaactttgaatagagcccaaatttatgaaattgttaatttctctttacatctagattttactttcagtaatttctatctgctaacacaaatagaaaggtaatctttcatttggttgccatccttcaagagcctctctctgcccttccctccctgccttcctggatctttccttttgtctttacagacctagattttgaaaggttctaggttccttttgtctgttgatactatgtgaatgttatccttaagtttttaattcaggctacaactagacagataatgtgtctcacaattagctggggtgagagagttaaaatggaagttaaggattcaggggattcctacagatgggtgaagaaaaaagctcaatgttaggatccttaacaaagcattttgattggcatatggagacctttgcgtgaacacaaatgttcatatttgaatatttatagaagataatctgtcaaaattactgttattttaatttgccaagcttggctgattgccgcagttggatgttagttgaattcaagttgaagagttgtaaatatgttctggtgtgggacatgctttttgtccttgaagctgtttgaatttcttacttctcccacctacacccccttctttaaaactgcgaggcttttttgtattagttgaactttcatgttcttttttaggaaaaaatattaaagtaggatgttaactgtatggattaaaaattttttttaactaaatttgttgacatttggtgatcaggaattgtttaaataattttaactatttgtccaatctttgcttcaaaggacctgttcctggagactcaaatgtagggatatatatcttatttgaatggttttgtgtgggatatgtttcacattaacagcaaagaaaatgtagacttctagataattgatgtttcccctttcttttatctcacttgaacagctaataattttagtgacccagattcaagcaataatacctgtcttcataattgtcatgtggttttgtcagcttcttatattctaggggaaggaagataagacttttttaaatatattgaaataacttggttaataaatactttttttctctttttagaagccaggaacctgttctctttccatagtgtctcctcactcagaaaacgttgtgttctcctgcctcagcctcctgaatagctagggttacaggcgcccgccaccatgcccggctaatttttttttgtatatttagtagagacggggtttcaccttgttggccaggctggtctcaaactcctgacatcaggtgatctgcccgccttggcctcccacagtgctgggattataggtgtgagccactgtgcaggagaatggcttgaacccaggaggcagaggttgcagtgagctgagattgtgccattgcacgccgggctgggcaacaagagtgaaactccgtctcagaaaaagaaagaaagggaaaaaaaccccaacacactgtattaattattgatgcagtatcactattcttactgagactacattattttagctttagagatgatatagtggctttcttaaagttatatgacatttttttgggagcagggctgtattctgtgccccatgtactaagctatcttgtctcatttaactagccactgttatctgaatagttgagttttacatgcgtaaccacttgacctgattagtcttaatttttttcctgatgtttttatttctttatctcttagaaaatgacataattgaatcagttttgttggttattactttagctagaaactatgtcaagtactacatttcagttttttttttttttttttttttttgagacagagtctcgctctgtcacccaggctggagtgcagtggtgcaatctcggctcactgcaagctcctcctcccaggttcacgccattctcctgcctcagcctcccaagtagctgggactacaggtgcccgccaccatgcctggctaattttttgtatttttagtagagacggggtttcaccatgttagccaggatggtctcgatctcatgacctcatgatctgcccgccttagcctcccaaagtgctgggattacaggagtgagctaccgtgcccggcctacatctcagttttatttagactttgttttggagtttcaggaatttgaggtttcaggaatgtattttgtatttagaaaattaagagtggaacttttatagtattttctgtctttcacaatcatccatcttcattctcatttgacttttttttgctatattttttttctagaagattttatataatcttttcctgttactacttttgcccattctttttgtgaccatctccaagtcatttcccttgtatctcaccgtcattccttattatcttcctaggaaaacttatttgtccaactctgtagctatcctctggctggataacaaaattattaataattccttaagatgttaccctagctactaattttgtaatagtccaccatgtgttcactgtgtaaagggttcagaggtgactgttgtacctaatgcaccacagatgtggaagtaataataaaatttacatatatgtaaggtgaaaatattgctaatacgttcccttgggtctggccattctgatatgcttgctaagtttggaggcttattttgtaatggttctttcggatttcttaaggtgaattagacattatgtttaccttgaattttaattggtatacttttggttaagtaggttaaaagtcaatggaataaaagttaagccagaaatataaaaagtaataagccatttttcagtgtgatttgaaaaacaatttagctgtatttcttgctataaaaaaagaagtaaagaacactatacagtggactaagattttctaagtaaactaattttgataaaggttaattccatggtgatagcagatgttggggattggcatccatatgtcagatttcacataaaaatttagctttctactgttttttatttccttaggaagaactataaaacttaaatttgtatagaaggtatgataatgctattttaataaacagaatttgttattttgaaaattgggtagtaaggacaaccagtgaattgtactacttattgatttttttaaaaaaatgtatttttaattttcgcgggtacatagtaggtatatgtatttatgggatacatgagatgttttgacacaggcgtgcaatgtgtaaaaatcacatcatggacaatgcagtatccctcccctcaagcatttatcctttgtgttacagacaatccaaatacactcttagttatttaaaaatgtacaattaaattattgattgcggcagcacccctcacacaggggcaccagctgccggggtctgcccatagaccctgacccggccacggatgaataaagtacactgacacacagatattctgttttgccagtccagctgagggtgtctcagctgtttacagactccctggagggttctgtaaacagttgtgaccatgacctcgatcagcaagtgagacttgcatttatgcggtaagattaattaacaaaggcttgagtcaacaccattagaggtaattgacattgtggactttccaagtaaaaagcccttaatcacccatggcacatcaaaggttagtcttaagattatatgagtaaacaagctagctaggtaaactactctgccttcctttattactagtttaatttgtttaaaggtaaagatcaggttgccttcaaccatgtctattactgaagttatgcaaactctcggccttccaagaagatttgtgtctgtctctataactatcttcaatatttttcccaccagcctgattgaaccccagtaattgattatagtcaccctgttgtgctgtcaaatactaggtcttattcattcatcctgtttttttgtacccattaaccatccccacctctccctcatcccaccactacctttcccagcctctagtaaccatccttctttttccatgggttcagttgttttgatttttagatcccacaaataagtgagaacatgagatgcttgtcattctttgcctggcttatttcacttaacgcagtgacctctggttccatccatgttgcacatgacaggatctcattctcttttatggctgaatagtactccactgtgtatatgtaccacattttctttgttcattcgtctgctaatggacacttagcttgctttcaaatcttggctattgtgaacagtgctacagtaaacatgggagtgcagatatctctttgatacactgatttccttttttggggctatatacctagcagtgggattgctagatcatatggtagctaaatttttagtttttttaaggaacgtccaaactcttcttcatagcagttgtactaatttacattcccaccaacagtgtatgagggttctcttttttccacatctttgccagcattgattattgcttgtctttcggataaaagccattttaactggagtaagatgatatctcattgtagttttgatttgcatttctctgatgatcagtgatgttaaacacttttttttttttttttttgagatggagtcttgctctgttggccaggctggagtgcagtagcatgatcttggctcactgcatcctccacttcctagattcaagcaattctcctgcctcagcctcccgagtagctgggactacaggcacacaccgctatgcctggctaattttttgtttttgtattttagtagagacagggtttcaccatgttgccgaggctggtctcaaactcctgagctcaatctgcctgcctcaacctcccaaagtgctaggattacaggcgtgagccactgtgcccggccgaacactttttcatacgtgtgtttgctagttgtatgtctgttttttttttgaaaatgtctgttcagaacttttgcctgtttttaaattggattattaattttttcctgtagagttgtttgagttttttttttttttttttttttttttgagatggagtttcgctcttgttgcctaggctggagtgcaatggcataatctcggctcactacaacctccacctcccgggttcaagcaattctgttgcctcagcctccgaagtagctgggattacaggtgcctgccaccacgcccagctaattttttgtatttttagtagagacggagtttcaccatgttggccaggctggtcttgaactcctgacctcaggtaatccacccgcttccgcctcccaaagtgctgggattacaggcctgagccaccgtgcttggcctagcttcttttatattctggttattaatcctttgtcagatgggtagtttgcaaatattttcttccattctgtgggttgtttgtttgttgcttgtttactttgctgtggagaagctttttaatttgatgtgatcccgtttgtccagttttgctttggttgcctgtgcttgtggggtattacttaagaaatcattgcccagaccgataccctggagagtttccccagtgttttattttagtcatttcatagtttgaggtcttagatttttgtctttaatcaatattttgatttgagttttgtatatggtgagagataggagtctagtttcattcttctgcatatatatatccagtttccaagcaccatttattgaagaaactgtcttttctgccatgtatgtttttggcacctttgtcaaaaatgagttcactgtaggcgtgtggatttttttctgggttctcggttctattgttctgtgtgcctgtttttatgccagtaccatgttgttttgtttattatagctctgtaatataatttgaagtcagttaatgtgattcttctagtttggttctttctgcttaggatggctttggttattctgagtcttttgtggttccctataaattttagggttttttttatatctctgttaagagtgtcattggtattttgatagggattgcattgaatctgtagattgctttgggtagtatggacgttttaacaatattgattcttccaacccataaacatggaatatctttccattttttggtatcctcttcaatttctttcatcaatatagtatagtttctgttacagagatctttcacttctttggttaattcctaggtatgtatttatttatttattttggtggctattgtaaatgggactgctttttaaatttctttttcaatttgttcacatttcacatatagaaatgctacttatttttgtatgttgattttgtatcttgcaactttactgaattagtcagttcttaatagtatcaattctaatagttttttggtggattttttatgtttttccaaatatatgatcatatcatctgcaaacaaggataagttgacttctcctttacaattcggatgccctttatatctttctcttgtctaattgctctagctaggactcccagtactataatgaataatagtggtgaaagtgggcatccttgttatgtttcagatcgtaaaagacaggctttcagtttttccccattcagtgtgatactagttgtgggtcttttgtatatggcttttattatgttgatgtgtgtttcttctatactcatgtttttgagggtttttattagaagggatgttgaattttatcagtgttttttcagcattaattgaaatggtcatatggtttttgtccttcatttgttgatacgatatatggtgattgatttgtatatgttgaaccattctggtgtcccagggataaatctcacttggtcatgatgaatgatctttttaatgtgttgttgagttcaatttggtagtatttcgttatggatttttgtatgaatattcatcagggatattggtccttagttttcttcttttgatgtgtctttttatggttttggtactagggtaatactggccttgcaggatgagtttggaagtattccccctcctctatttttcggaatagtttcagtaggattggtattagttcttctttaaatgtttggtagaattcaacagtgtaaccattgggtcatggcttttctttactgtcagacttttaattatggcttcaatttcattatttattattggtctgtttgggttttggatttcttcatgtttcaatcttggtaggttgtatgtgtctaggaatttgtctatttcttctaagttttccaatttattggcatatatttgctagtagtagccactaatgattcttcggatttctgtgatatcggttgtactgtctcctttgttacctctgatttatttggatcttcttttttccttagtctggcttaaggtttgtccgttttaacttttccagcaaccaactttttgattcatcttttgtattttctttatttcaatttcctgtatttctgctctcatctttattatttattttcttctactacttttgagtttgttttcctcttgcttttttagtccttaaaatgcattgttagcttgtatatttaaagtttttcttcctttttttgatgtaggcacttgtagctataaaattccctcttagtacagcttttgctgtattccataggttttggtatattatgtttccattatcatttgtttcaaggaagttttcaattttcttcttaatttcttcattgacccacttgtcattcaggggcaaatcatttaatttacatatatttgtatagtttccaaaattccccttgctattgatttctagttttattttattgtggtcggagaagatgtttgacactatgtgggtttttttttctttaaatgttttaagacttgttttgtgacctaacatatggtctatccttgagaatgatccatatgctaaagaaaagaatgtatattctgtagctgttggaagaaatattctttaaatatctattagatccgtttggtctatttctttgttgattctctgcctggaagatctgttcagtgctgaaagtgggatgttgaaatctccagctattattgtattggagtctttctctctttagctctaataatatttgctttatatatctgggtgctccactgttgggtgcatatatattaaagtacttttttatatcctcttgctgaactgacctctttattattatatagtgaccttctttgtctcttcttacagtttttgtcttgaaatctattttgtctgatacaaatatagcttctcctactctgttttggtttccattggcatggaatatcttttccatttctttattttcaatctgtgtgtgtctttataggtgaagtgtgtttcttgtaggcaacagattaatgggtcttctttttttaaatccattcagctatcccgagtcttgtgattggtgagtttagtccatttacactcagtgttattattgacaaacaaggacttattcctgccattttgtaatttgttttctggatgttttgtggtcttcccttacgtctttctttccttcctgtcttcctggatgttacagcctactacccacctggggtatatggtatagcctattgcttctaggctacaagcctgtacagcatgttactgtactgaatattgtaggcaattgtaacacagtagtaagtatttgtgtacctaaacgtagaaaaggtacagtaaaattatggtatttataatctttatttttgtagacagagtcttgctcggttgcccagggtggagtgcggtggcgcgatctcggcttactgcaacctgcgcctcctggttcaagcaattctcgtgcctcagcctcccaggtagtagctgggattacagatgtgcaccaccatgcccagctaagttttgtaattttagtagagacgaggtttcaccatattgtccaggcaggtcttgaactcctagcctcaagagatcccctgccttggcctcccaaagtgctggaattataggcataagccttcgtgcctggctgggtatttatgatcttatgggaccactcatatatgcagttcgttgttgattaaaaccatcattatgtggtgcatgactttactttgtatgacaagttactgaacgttctaaaggagatatgaaagtaacttaggtttgatttttgtttgaaattgtgatatttttgccggctgtggtggctcatgcctgtaatcccagcactttgggaggccgaggcgggtggatcatgaggtcaagagttcaacagcagcctggccaagatggtgaaaccccgtctctattaaaaatacaaaaattagccgggcatggtggcgggcgcctgtaatcctagctactcaggaggctgaggaagagaattgcttgaacctgtgaggcggaggttgcagtgagccgacatcacgccactgcactccagcctgggcgacagagtgagactctgtctcaaaaaaaaaaaaaaaaaagaaaaagaaattgtgatgtttctttcccattccaagaccatccttttcttagtactctttctttcctttagagctaggctagtggggagcagaatcatgagcttaaattagtggaatatgtggacattgggtagcatggggagaagtgtttcagcttctttctctaaactttaatttccattctttggtgcttaaagtggtgttttaatcacttgcatctggttcaagagggtgtctgattctttgcaaagctattctatcgacaaaaagcattcacagtgttttcctagtggattaatattgggttgacatctatttgcatgttaagtgctgtattgttatcatttggcatttattaactagccttgatatactgtgcattagttggcatttatacatgttttagtccctgctctagagaaaatatcctaaaagggagctaattgtgggaaatagagccttttctcacatatccagctgcctgggagctttcctctaaagacctttaagcattggaaagtcattcttcaagtagttaagataggaaatgacagtcgtgtaaaatagggccttaaaaacaactaccaggtagactcatgatagtgaccctacagggaattaacaacatagatatgattttctcaaggagttgggaatcttcttattaaaattagagcagtgaaattgttcccttctctgtagaatataaaaacaaaatcaaaaacaaaacaaaaaatcgatcaaacttctctccgtgtgttaacaaaacgaccatgagatctgtggaggaaggaaaaaggagaaaactttattttcagagtaacaatctgcagataagggaaagtaacctctggtggaactgtaagcacgtgcttcaccgaaggggagtgaacagtagtatttaagccttctagggtttgttttacatgcatatccatcatgtaatatgaattgtttgaggaatgtctatgaatatatatggggaagtctagtgcatgcacagtgagttaacatataagtaacatacatcccatcttcgcttcagggcacaattttagcattaaaatgaggtggaattcagctctttatgtcaacaggtgaactatagagcacaaagatattttgtatgcagtctctataagctggctaaaactggcttagggtctgtagcattttagcaggaaagaatgtttgtaggactggcctcctgtcctatcagtgctgttggtaggaccctcaaggcagggttgtcccagttgtctttatcaggcagtttaccaagatcggttgggcagtttctctagaacagatttctgcctaatagaagaggaaaacttcatggcagttaataagaaagaatgtttgtaagaatggcctcctgtcctatcagtgctgctggcaggaccctcaaggcagggttgtcccagttgtctttatcaggcagtctaccaagattggttgggcagtgtgtctctagaacagatttctgccgaatacaagaggaaaacttcatggcagttaacaaaccctttggtagttaacaatgtacgtatgtatgaccaaacccttgttcctgctatggccatttaattttctctcttgagggtcttatcttagctacagaaagtccatcttatctatcattgttgacctttggatcacagctagtagtggtttgaggacagaatgtatcaatgtatcaatagtttctgtcttgtcttcaccgctgagtaggtatacaaaacttagtcaagtcaaatcacttctttttttttttttaaatttatttttttatgatactttaagttttagggtacatgtgcacatagtgcaggttagttacatatgtatacatgtgccaagctggtgcgctgcacccactaactggtcatcaaatcacttctttacctcagttttctcctcttcaaaatggagataatgcctaccttacaaattgatggtgagaattaaatgaggaaatgtgtgtaaaaatgtgttgtatgcctggtacctctttggcatgcaactttgtgttttcctccttcctttgacattagtaatatttggatttcactctttgaattcagtggttacttggttgtggaatcaaattattttgtctttccaaacctcatttttctctaacataaaatcagtaatacacactttatgaagtagtggttgaaattcagttcctagtgtagtctaggaagattttcttgaatctgaatgtcaaattgctaaaaacttgtataaatttgtgagttttgctgtgtagatcttttggacatgaaaatacaatatctttttaagaattaaacagtaggagaaatatactaagggaaagtaagtctctagaatgttttttgggggactctacaatagcttactgcattacagttactgtaattcatcaagataatagggaaattatgcatccaaaggatttatttacttgaaatagcacctctagaagggatattcatagagcagtaatataagaagtgagacacttgaacatacctttttctttgctttttttttttaatcttaggtaacttcagattttaataagatttcactatataatgttttgtgggcagatattgtaaaatctactgaaaatttcccagtttagtaattaccaaagaaataataaaccaatattaaagttcagttacaaaattaaagtcaggactcacaaacaaatcatgttaaatgagttatgaattaaattagtgttattgttgagtttaactgtgtgtcaaatcaatataatttctttgacataatcacagaatagaaatcaatgtatgtgtggtacattgtattgaagggttacaaagtgatgaactagtgagtatgtatttttaaggatgttatagacctatgaatttcaattatatttgtttaaatgtgaatcacttttataagcagcagcaaaatatcattgcctttgtattttgtagcaggtgatttagcttttgtgtatattcagataaatataaattttaatttattttattttgactaaagtttaagagataatttagcatattgtttgctaatcacttttaagtaatctcagtttagctggttgtggtaatgtgtgcctgtagtcccaactactctggaggctgaggtgggaggatcccttgagcctaggaatttgaggatgttgtgtgctattgttgtgcttgtgaataaccacagcatggtactctagcctaggcaacatagcaagaccttgtctcttataaaaagaaaaggaaaaaaaaaagaaatttcagttaataattttatttgacatgttacagctccttatttgaccctgaaaatgttgcagtgagaatagcctttgcatgcatagtccttaaccctgaagaaaaggataaaagaaaataaaatcaaaacttagttgaaaatcaggaagtgcggacaagcttctgtcgagaaaatggaggtgaatttatgtgtaaatgttaaagacatatggatatgttgattatagccatctttaagtgtttgtgttataggcagacggtttgcagagttagagtaaatggattaaagatattgctaaaattaaaataactttatttttcaagtttttttggtattatgtttgttttttcaggaaaccagatacttaaatataaaactcggtaattatttttgtaactattttattaataatttaatgttaactactagaagtctataattttacattgaatatacaaaatattatttgggcaaatgattattaaaataatatcatagtaatatacatcccccctttttgttatggtaaaatgtacataacacaattcaccatttaatcatttttaagtatacagttcattgttatgcaaccatcatcactatctccagaacgctttcatcatcctgaaatgaaactgtgtgcccgttacataataattccccgttacttattatctcccctttaatcactattctactttctctctctctgattttgactattctaagtatctcgtatgagtggaaccacacaaaatatgtccttctaggactggctcattgtatttagcataatgtcttcaaggttcatccatattgtagcatgtatcagaatttcagttctatttcacgatgattaatattccgttatatgtgtataccacattttgcttatccatttatctatcagtggacatttacattgtttctacttttggctattgtgaataattctgccatgaactttggtatgcaagtatctgtttgagtgtgttaatatattttctatatattttaacagaaatttgttagtttacatatttttacttaaacgagctaaatatctgaattttcagtgttatcagtgaatatttattgaataccttgtatattgtaagtattgtgggggtataaagagttacaatatcatgaaactattgttttaaagaatttacagtctaataacagtaatagggtgtgtttataaagacacagaacctggtagcatatgctttttgaagctgaagagatatctgagctctgatgcaaaccagcatcgtttcttgccaaaatttttgtttgttatcctgagcagttaggaggcagatacatggccacagtcaacatatgcatattccattcaagcatagcatttaaccttcaaggatgaattttggggtgatcatatcaacatggaaattagatcatgacatatctttaaagtcttctccatggaccttatctttaggtgagttactttccttctaccaaactgccaccttaactctgacctcatctcctatcccctactcccaccttgcactgggtaattttttgttgtggatacatttcttatgtatgtaaactggcttaagtgtaaacaaggtaaaagtcataaggaggaactacatatatgtttcaaggttctttccagctttatgattctaatttaatccctgtggtacctgtgtgttgccagtgaaagaaaacagagttagcatgcttagaggtttcacagcagagctgctttgtggtgatttttaaaggctaaaactttgaaataaaaacagtttggtatgtttcagtggtctctttttcttctctttcagagtacttttcctggaaaagcagaataagtcttttatgaatttagtcataactttgcagtttaattggacttttagggtttttctatgtgtgcaagctggaccttttgaagtttaacactggaatactagcatgagagtgttcctactcttaatttccactgagttagaccaaaggaaaacatatattttagattcatattttctttgaatgatgttttggagctcaagatgaactttaaaaaacacagctaagcagagcttctaaaaggtaatactgtagtagtatttttttcctccatgttaatctacttggctccccatagtgagcttgaactgtgagtggtaaagactcattactttgtagggtgtcctggccctaaaaataaaacttctttctcatagcctacagcctatgaatgtgattattctgtaagcctctgtaagtcactgtaagaacagtgactgtggcttcatttttatttattttatttttcttatttatttatgagacagtctcactctgtcgcccaggctagagtgtagtggcttgatcttggctcactgcaatctctcctcctgggttcaagtgaatctcgtgcctccaccacccaaatagctgggattacaggtgtgcgccaccatgccaggctaatttttgtattttttttgtagagatggtgtttcgccatgggcctgtctcaaactcctcctctcaagtgattcacctgctttggcctcccaaagttctgggattataggcatgaactactgtgccaggcttgtggtttcatttttgtaaaacgtttagtagagttggtgccttgcacataataaaatgtatcttctgaggttatgattccacataaaaaatgaaaactttaggagataattacagaagtgaagaaagatgaatgaacaaggatggccatctattcattcaacacataatgaggtctactatgtatcagacacaccactaagtactggaaatacagcaatgataaattagataaattagggaatttaggttgtctagaacagtgaatggcatgtaataggcgcttaaaaatatttgaatacatgaaggtctgttttgtagaaaatgatttatggtatggaacattttagtgaggaagtggaacgtgtcccatcgtattagggacacgttcattcattaaaaaaatggaaacaaactgtttattaatatggagactacttaagtcggttatggtaatacatagaatgtagtacagaaaagcccttaaaaaatgagatatttattggctgacacagaaagatgttctaatttacctaatgttgaattaaacaaagtaagctgttgaataggatgtatggaatgattcctttaatgtaaggttatttatatttctataaaatgtcacaaggtatggtggagaaatgataacaatgaatgattctaacaggaggtaagtttttcgctgatctttgctgtattctttatgcacttctgtgattgttttaccatgatcatgtgctactgtttaaaaataataaagctgcttaaaaatgtttctggataaatttttttaaacttaatattctatctataaatagtgttactggttgatggtccgttgtcctgtaaatgtaaaagtgttattaaagaattctgcattttctttctaaagaaatatagttaaccagagttcactttgatactcaacatttacctttaatgtttattatttattattcattttttaatatatttttttgagacagggtcttcctctttcactgaggctggagtgcagtggcatgatcttggctcactccagcctccattttctgggctcaagtgatcctcccacttcagccttccaagtagctggggctacaggagcgtgccactacacctggctaatttttgtaatttttgtagaggccgggttttgccgtgttgcccaggctggtctcagactcctgggctcaagcagtctggctgccttggcctcctaaagtgctggaattacaggcatgagccaccatgcccagcctacctttaacatttaacaacatttacctgtaacactcatagagtgtagttttaaaatgaataatagcatttacaaatgtgtagtagcaggaatatatttaataataattttaattttgttttggaggtactttgagggaggtatgtctacataattaaatggcaaagaacggaagtttttaagtttttttgtatacttataaatttaatttggatttagttattaataaatattaggttgaactgcacttttaatctaaagatttattttggcactcatttttgcttattatgacttctcattttcttaattagaggagagaagacatgttctttgggcgtcctggttatgtctagtcaatagtcttagttttcacaggatagtacggaatgttaaattattactacctattttcttaatttatttcaataacttgctgtttttatcaggaaaaattaatgaactaatcaaaatgttccattctatacatagtttgctcataacaaactcatttttttagaaatgttatagcaaccttattttttttttatcctccacaagatcattttagtgtagttactggagtttcaaatcatacgtaattcagtttgaaaactatgtctatggttctgtttagtaacattttagatgatattatttaaaaaggttaacattgcttagttaaaagttatcattattcttttaaaacaagttttatttttcagaccacacagtcctttgaattctgatgcatcaagtttcaaacagttttttgtttttggggatacttacctatgagatctccagaaattgtatatttagctatgaaaatcttcagaaactgtgagcatattaagcacacatataagactgtaaaccttagaggatgattttagatttctttctcttttttactttttatttttgaaaaaaataagcccattccagtttaatgaatatgataatttgaaatccaggtagaataatgtatctcattttcgccctcatattttaaagtgagatagtttataaaatggagaataagtcatgttgttagatgttgactcttatagtataaaagtatgaatcttatatagtgatattctattttaaatgctttatatgtttaaataatttagaagaagggaattatagaaaaactgaaacaaaatgcttgaattaatactataaacatgatgttagcatttataattgatattttaaattgttacataaaaatgtatgagtatggataaaaacatatatattagtctaaatgaaattaatggcttcttttatacactcacaatatttatacttttctttaagtatatcagatgttgataagtgttctagagaaaagtaagtacattagggatggtaataaggaatgttggaattgggaagatgccatttttatatagaatggtcagggaagatttcactaagaaggtgatagttgagtgatgctctgaatttggtgagggacatagctgtggggatattcggataagtgtgtttcagacaagatcaaaagccctgtgttgagtgcaggctctgcatatttagaaacataagaaatttaactgtgcatggcacaaggtggtcttatatgttaaaaaaatacatttttttggtttcatttttgctttcctggtacattctaagatatgctgaaattgagatttacttgtcttgcttattgtatcttgggcacccactacagtgccaaacacatggcaggcaatttgttgtggatgatgagaaagaattttggaggaatcttcttctttttttttttttttaaattcatactaccaaattatttcaagctacagaggtctttagagatcatttagataactcttttggatgttatgcatgagaagacatgtcattaaatagaatgacttccaaaagtcaccattaattagtagcaatcttgagttggcaaagatttttggtctcttagtctaactttagtccattgatggggtgatccttttgtttcagttgtctcatctatgcatgggaagatacttgctatggaaaacctccttgctgtggaagaactccttgcatctagaatcagattgcttggttgaaattcctgtttgacagtactagctttgtgattttctccctctcccgacttttccttttggtgccctggttttcttgtctgttagacagatattgttattctcattccagtattctttacaccataaacattttctcattaatcttctaatttaccaactcagagtgttatttcctttttttttaaagggatttatgatgaagagaataggagtttgaaattaggtgttcttgggttctataaaaatttaattcttaaggttatttgttagtatgtatcaaactcttatttaatgaatgaggaaaacatcagcaagacaaaagaactgctttcaagagtatttgagcatcaggagttcatgtattcatttaggaaaggaatgtcaaaataaaattttttaaaaattatactttaagttccagggtacatgtgcgcgacgtgcaggtttgttacatatgtatacatgtgccatgttggtgtgctgcacccattaactcgtcatttatattaggtgtatctcctaatgctatccctcccccctccccccaccccgcaacaggccccggtgtgtgatgttccccctcctgtgtccaagtgttcgcattgttcggtttccaccaatgagtgagaacatgtggtatttggtttactgtccttgcgatagtttgctcagaatgatggtttccagcttcatccacatccctacaaaggacatgaactcatccttttttatggctgcatagtattccatggtgtatatgtgccacattttctcaatccagtctatcattgatggacgtttgggttggttccaagtctttgctattgttaatagtgtcgcaataaacgtaacgtgtgcatgtgtctttatagcagcatgatttataatcctttgggtatatacccagtaatgggatggctgggtcaaatggtatttctagttctagatccttgaggaatcaccacgctgtcttccacaatggttgaactagtttacagtcccaccaacagtgtaaaagtgttcctgtttctccacatcctctccagcacctgttgtttcctgactttttaatgaccgccattctaactggtgtgagatggtatctcattgtggttttgatttgcatttctctgatggccagtgatgatgagcattttttcatgtgtctgttggctgcataaatgtcttcttatgagaagtgtctattcatatccttcgcccattttttgatgaggttgtttgtttttttcttgtaaatttgtttaagttctttgtagattctggatattagccctttgtcagatgggtagattgcaaaaattttctcccattctgtaggttgcctgttcactctgatggtagtttcttttgctgtgcagaagctctttagcttaattagatcccatttgtcaattttggcttttgttgccattgcttttggtgtttcagaatgaagtatttgcccatgcctatatcctaaatggtatcgcctaggttttcttctggagtttttatggttttaggtctaacatttaggtctttaatccatcttgaattaatttttgtataaggtgtaaggaagggatccagtttcagctttctccatatggctagccagttttcccagcaccatttattaaatagggaatcctttccccattgcttgtttttgtcaggtttgtcaagatcagatggttgtagatgtgtggtattatttctgagggctctgtcctgttccattgatctatatctctgttttggtaccagtaccatgctgttttggttactgtagccttgtagtatagtttgatgtcaggtagtgtgatgcctccagctttgttcttttggcttaggattgacttggcaatgcgggctcttttttggttccatatgaactttaaagtagttttttccaattctgtgaagaaagtcattcgtagtttgatggggatggcattgaatctataaattcccttgggcagtatggccattttcacgatattgattcttcctatccgtgagcatggaatgttcttccatttgtttatgtcctcttttatttcattgagcagtggtttgtagttcttcttgaagaggtctttcacatcccttgtaagttggattcctaggtattttattctctttgtagcaattgtgaatgggagttcacccatgatttggctctctgtttgtctgttattggtgtgtaagaatgcttgtgatttttgcacattgattttgtatcctgagactttgctgaagttgcttatcaggttaaggagattttgggctgagacaatggggttttctaaatatacaatcatgtcatctgcaaacagggacaatttgacttcctcttttctcaattgaatgccctttatttctttcacctgcccgattgccctggccagaacttccaacactatgttaaataggagtggtgagcgagggcatccctgtcttgtgccagttttcaaagggaatgcttcccgtttttgcccattcagtatgatgttggttgtgggtttgtcataaatagctcttagtattttgagataagtcccatcaatatctaatttattgagagtttttagcatgcagagttgttgaattttgtcaaaggccttttctgcatctattgagataatcatgtggtttttgtctttggttctgtttatatgctggattatgtttattgatttatgtatgttgaacgagccttgcatcccagggatgaagcccacttgatcatggtggataagctttttgatgtgctgctggattcggtttgccagtattttattgaggagttttgcatctatgttcatcagggatattctctttttttgttgtgtctctgccaggctttggtatcaggatgatgctggcctcataaaatgagttagggaggatttcctctttttctattgatgggaatagtttcagaaggaatggtactagctcctccttgtacctgtggtagaattcggttgtgaatccgtctggtcctggactttttttggttggtaggctattaatcattgcctcaatttcagagcctgtgattggtctattcagagattcaacttcttcctggtttagtcttgggagggtgtatgtgtctaggaatttatccatttcttctagattttctagtttatttgcatagaggtgtttatagtattctctgatggtagtttgtatttctgtgggattggtgatgatatcccctttatcattttttattgcgtccatttgattcttctctctttacttctttattagtcttgctagtggtctatcaattttgttgatgttttcaaaaaaccagctcctggattcattgattttttgaagggttttttgtgtctctatctctcagttctgctctgatcttagttatttcttgccttctgctagcttttgaatgtgtttgctcttgcttctctagttcttttaattctgatgttagggtgtcaatgttagatctttcctgctttctcttgtgggcatttagtgctataaatttccctctacagactgctttaaatgtgtcccagagattctggtatgttgtgtctttgttattactggtttcaaagaacatctttatttctgccttcatttcgttacgtacccagtagtcattcaggagcaggttgttcagtttccatgtagttgagcagttttgagtgagcttcttaatcctgagttctagtttgattgcactgtggtctgagagacagtttgttataatttctgttcttttacatttcctgaggtgtgctttacttccaattatgtggtcaattttggaataagtgcgatgtggtgttgagaagaatgtatattctgttgatttggggtggggagttctgtagatgtctattaggtctgcttggtgcagagctgagttcaattcctggatatccttgttaactttctgtctcattgatctgtctgatgttgacagtggggtgttaaagtctcccattattattgtgtgagagtctaagtctctttgtaggtctctaaggacttgctttatgaatctgggtgctcctgtattaggtgcaaatatatttagtatagttagctcttcttgttgaattggtacctttaccattatgtaatggccgtctttgtgtcttttgatctttgttggtttaaagtctgttttatcagagagtaggattgcaacccctgcctttttttgttttccatttgcttggtagatcttcctccatccctttattttgagcctacgtgtgtctcttcatgtgagacaggtctcctgaatacagcacactgatgggtcttgactctttatccaatttaccagtctgtgtcttttaattggagcatttagcccatttacatttaaggttaatattgttatgtgtgaatttgatcctgtcattatgatgttagctggttattttgcttgttagttgatgcagtttcttcctggtatcgatggtctttacaatttggcatgtttttgcagtggctggtactggttattcctttccatgtttagtgcttccttcaggagctcttgtagggcaggcctggtggtgacagaatctctcagcatttgcttgtctgtaaaggattttatttctccttcacttatgaagcttagtttggctggatatgaaattctgggttgaaaattcttttctttaagaattttgaatattggcccccactctcttctggcttgtagagtttctgctgagagatccactgttagtctgatgggcttcactttgtgggtaacccgacctttctctctggctgcccttaacattttttccttcatttcaactttggtgaatctgacaattatgtgtcttggagttgctcttctcaaggagtatctttgtggcgttctctgtatttcctgaatttgaatgttggcctgccttgctaggttggggaagttctcctggataatatcctgcagagtgttttccaacttggttccattctccctgtcactttcaggtatgccaatcagacgtagatttggtcttttcacatagtcccatgtttcttggaggctttgtttgtttctttttactctttttttgtctaaacttctcttctcacttcatttcattcatttgatcttcaatcactgataccctttcttccagttgattgaatcagctactgaagcttgtgcatgtgtcatgtagttctcatgccatggttttcagctccatcaggtcatttaaggacttctctacactggttattctagttaatccttcgtctaatcttttttcaaggtttttagcttctttgtgatgggtttgaacttcctcctttagcttggagaagtttgatcgtctgaagcctcttatctcaactcatcaaagtcattctccgtccagctttgttctgttgctggcctttggagggggagaggcgctctgatttttagaattttcaacttttctgctctgttttttccccatctttgtggttttatctacctttggtctttgatgatggtgacatacagatggggttctggagtggaagtcatttctgtttgttagttttctaactaacagtcaggaccctcagctgcaggtctgttggagtttgctggaggtccactgcagaccttgtttgcctgggtattagcagcagaggctgcagaacaatgcatattgctgaacagcagatgttgctgcctgattgttcctctggaagcttcatctcagaggggtacacggccatgtgaggtgtcagtctgcccctactggggggtgcctcccagttaggctactcgggggtcagtgacctacttgaggaggcagtgtgtccgttctcagatctccagctctgtgctgggagaaccactactctcttcaaagctgtcagatggggacatttaaatctgcagaagtttctgctgccttttgttcggctatgccctgtccacagaggtggagtctgcagaggcaggcaggcctccttgagctgcggtggactccacccagtttgagcttccaggcctctttatttacctacgcaagcctcagcaatggcaggtacccctcccccagcttcgctgccaccttgcagttcgatctcagactgctgtgctagcaatgagcaaggctccgtggacatgggaccctccgagccaggcgcgggatataatctcccggtgtgccatttgcttaagaccattggaaaagtgcagtatcagggtgggagtgacccgattttccagtgtcatctgtcacagcttcccttggctaggaaaggggatttcctgaccccttgagcttcccaggtgaagcgatgcctcaccctacttcagctcacgcttggtgggctgcacccactgtcctgcatccactgtctgacaatccccagtgagatgaacctggtacctcagttggaaatgcagaaatcacctgtcttctgcgtcgctcaggctgggagctatagactggagctgctcctatttggccatcttggaaccattgaggatcaaaataaaattgataagatacacagaagactggttaactttctgtatgacaatgaagccatataacttaagggaaactgaagttatatggcttcattggaaacttggatgtaaatctttgaatttaatttagatatcatcaagatctttatcatcatcttgagtatcataagatactggattttatcatctctaggaccaagtatattggttttattgattttagcagattctagaaacttgccatatgcctttagacttctagcttcatgtgcatggtattttaaaataacatcagatttgttatcctaatagtctcacagaccaaccagtataatgtctgaggtatttattcacttcttttttctcaattttcctctcatatgacataacctctttacaccatcaaagcacattgattctaatcatctgttttccttcattttgattacctactcttgtctatcccctttatataccaactctcctttttggggttcttatttttactcctgcctctatttttctttttctttttctttttttttgacacagagtttcactcttgttgcccaggctggagtgcagtggcacaattttggttcaccgcaacctctacctcatgggttcaagcgattctcctgcctcaccctctggaagagctgggattacaggtgcatgccaccacaccctgctaatagtttttatttttagtagagacggggtttcaccatgttagtcaggcttgtttcgaactgccgacatcaggtgatccatccatcttggccttccaaagtgctgggattacaggcgtgagccaccacgcccggcctcctgcatctgtttttacctcccttaccttactcttgggcatggcagcaatggcagccttacggtgtcctggactcctctctggtggttgtgttggctgtggtggctgctattttgaggggtgtgcatgaatatgtagtcccaggaggcttggtcacttagcgggggatgttttgcaaccaaggtctttagaggcatgctcagtggcagcaaatctttaacttcttttttcatcttttgttttttgtgctaacatttttaaggttttctagggcagtctagagtaacatttactcttgtgcattcttaccctcatttctaagatggacctctattgagtgactctctgttggatgtcccaaggattcattgaggactctgtcttgcctgtgagaacttaaatgattcctggccctttgtgagctctggaaattactcagcactaactacatcataatttttctttcctggaaattggttttgctctgtatcattggtttttaccctatgcacatgtagattagtattgatattcaggtaatttaaggatatcctttttttaaagaaaataggtctttctgtaactctctcacttcaggaactttcccccaaaattcttgttgtgttggcctttctgtattatgacctcttgtgttttttaactcagcaatggcactagattctattagggtttcacctcctacatactacagtcccaaaagtgctttcagagagaaatctcaggcaattatagggctcacctttttgtttgtttgtttcccttattacagaaatcagttttgagctgattttcaatgtcagatcatcagttgtgcaatgtcatatacattgtttgtccagttttctagttgtttacatttggagggtaattctcgatcctattactgctgcatgggtgaaggtagaggtctcctaatacttttaaaattgagaaaatccttagcaagtgatatgtctcacccatttcaaagtgagttcaaatgctattatatgtaaaatttcatttttaaatgttatttaaattaattttagtaacaacatttgtgttattctttcatacatagctgttaagtaaagcctgctttggctgcttttcatctaatattagttaccagtcaactgatgcgttaaattaaagttgatataactctaatgatttataagagttgaatctttttagtactttaatgccctactgaagatcactgcctgttttatggtgctcttgcgtgtatgctcttacgttctctctctcgctctttctctctctctctctctccctccctccccctctcttcctctctccatctctccccagaatttgatgtaacaacaccaaaaacctcatgactttaccatattttactgtatctcaacagatagaatataagaccaatttttttattggtaaaaagtatgggaactttttaccaataaaaaaattggtcttatattctatctgttgagatatagtaaaatatggtgtttaagtttactacttcttactctttcaaattccttcaagtagcttaaaagcattggaaattgtaagcagaatgctaatgtaaattggtgggaagtaattgggaatgtctcattaaatatgacattaaaaaaaggacgtttaaaaatttttttcgaaaggatatgaggtactcacgaaagatttaaattaatggctcttatgcttatgattgagtcatttggtgacattagcttcattctttattatttagtgcttacaatatttgagttcctgtactaggtgtgaagtgtaccatatctgattattatatgtctatgctattcttagaagaggaacttgaaaatcttaggggagtgtttgaagatgagccagttaattagcattgtgatttaggtgttgtgtgcccagggcatcagaattgtacattgtgagtcttaaaaaaaaatgaggaaatgtagagccataatttggatacctctgaagagatgagggtcagggttgtaattttaggtgagaaaactacaaatgcattaattctgacaaatggccacaaaatttgatttcattaccttttactatttttgaactattagtttaggttcagaggtatctgtacaggtttgttatatacgtaaacttgtgttatggggggtttgacatacagattatttcatcacccaggtactaagcctagtacccaatagttatgttttctgttcctctccctgcttccactctccaccctctggtaggctccattgtctattgttcctttcgttgtgtttatgtgttctcatcatttagctcccacttataagtgagaacatgtggtatttggttttctgttcctgcattagtttgctaaggataatggcctctacttctatccatgttactgcaaagtacatgatctcatttttttttatgactgcatagtgttctgttgtgtatatgtaccacattttctttatccagtctacccttgataggcatttaggttgatttcatgtctttgctattgcaaatagtgcttctgtgaacgtaggcatgcatgtgtctttatgatagaatgatttatgttcttttggttatatacccagtaatgggattcctggatcgaatggtagttcaatttttagctctttgagaaatggccacactgctttccacagtggttgaactaattttacactcccaccaacagtgtgtaagcattctctttcctctgcaaccttgccagcatctgattttttttactttttaataatagccattctgactaatgtgagatggtatatcattgtggttttgatttgcatttctttaatgattagtgatgttgagtgttgatcaatgttgggctttttttcatatacttgttggctgtatatatgtcttctttggaaaagtgatcacatcctttacccactttttaatgtgtttatttttttcttgtgaatttgcttaagttccttatagatgttggaaattagacctttgtcagattcatagacctttacagttgcaaaattttctgtcattctgtaggttgtttgttttctctgtcgatagtttcttttgctgtagagaagctctttagtttaatgagatcccatttgtcagtttttgcttttgttgcagttgctttttgtgtctttgtcatgaaatctttcccaggtcctatgttcagaatggtattgcctacgttgtattccaggctttttcatagttttgggttttaagtctttaatccgtcttgagttgatttttgtatgtagtctaagaatgtgtccagtttcaatcttctgcatacggctagccggttatcccagcatcattttattgaataggaaatcctttctccattgcttgtttttgtaggctttgttgaagatcagatggttgtagatatgcagtcttatttctgggctctttgttctgttccattggtctgtgtgtctgtgttttttgttttgttttgtttgtttaccagtaccatgctgttttggttactatagtcgcatgatatagttggaagttgggtagcatgatgcctcctgcattgttctttttgcttaggattaccttggctatttgggctgttttttggtttcatatgaattttaaaatagtttctctaattctgtaaaatgtcgttcgtagtttgataggaatagcattgaatttgtaaattgctctgggcagtatggcaattttaattttaatgacattgatttttcctgtccacgatcatggagtgttttcccatttgtgtcatctcttgatttctttgagcagtgttttgtaattctcattgtaaagatctttcacctctgtggttagcagtattcctaggtattttattctttttgtggcagttgcgaatgggactgttttcctaatttggctcttggcttggctgttgttgctgtataggaatggtagtgatttttgtacatttaatttgtattgtgaaactttgcttaagttgttcattagcttatggtgcttttgggctgagacattggggttttgtaggtatagaatcatgtcatctccaaacagtgatagtttgacttatgccctttatttttttttctcttgcctgattgctcttgaaaggacttccaatactatgttgaatagtaattggtgagagagggcatctttgtcttgtgccagtgttcagcttttgcccattcagtgtgatgttggctgtgggtttgtcataaatggcttttattattttgatgtatgttccttcaatacctagttcattgagagtttttaacatgaagggatggtgacttttgccgaaagtcttttctgtatgtattgagatgatcatgtggtttttgtctgtagttatagttgtgtgatgaatcatacttattgatttgcataagttgaaccaaccttgcatcccagggataagccctacttgatcatggtgaattagcttttcaatatgcttccggatttgtttcgctagtattttgttgaagatttttgcatcagtgttcatcaaggatattgacttgaagttttcttctcttttttttccttgagaaacaaaggtactttttttttgtctttgttttttgagccagggtctcactttgtcacccagcctggagtacagtgtgcaaacatgactcactgcagccttaacctcccagactcaagtgatcttcccacttcaacctcctgaatagctgagactataggcatgtgctaccatgcctggctaatttttattttattttattttttattttattttatttttagagatggagtttcaccatgtcgcccaggctggagttctctttctttgttgtatgtcttccaagttttagtatcatcatgatgctggccttatagaatcatttagggaggattcccttaccctcaatttttttgtaatagttttagtaggtatggtactagctcttctttgtacatctggtagaattaggctgttaatctgtctggttcagggctgtttttcttttttttttttttttggttggtaggctatttattactgattaaattttggagctcattattggtctgttcagggattcagtttcttcctggttcagtcatgggagggtgtatgtgttcaggaatttatccatttttttctagactttctagtttttgtgcctaaaggtgttcataattgtctggttatttgtatttctgtccaatctgtaataatatccccctttgttgtttttgattgtgtttatttggatcttctctttttttctttattagtctagctagtggtctatgaatcttgttaattttttcaaaaaacaaactcctgacttcattgatcttttggatgattttttgtgtgtgtgtttcagtctccttcagttcagctctgattttggttattctgctagctttgggattgatttgctcttgcatctctagttcttttagttgtgatattaggttgttaaattgagatctaatatatatgtatatatgttatatatacatatgtatataaatgctattttttaattttattttttattttttattttattttattttttttgagacagtctcgctctgttgcccaggctggaatgctatggcacgatcttggcccattgcagcctctgcctcccaggttcaagcgattctcatgcctcagcgtcatgagtagctaggattactgacgtacaccaccaagcccagccaattttttatatttttagtagagacggggtttcacaatgttggccagtctgatctcgaactcctggcctcaagtgatctgcctgccttggcctcccaaagtgctgggattacaggtgtgaggcactgtgcccagctctttctaactttttgatgagagtgtttagtgctatacatttctcccataacactgccttagctgtgtcccagagatgctgggtatgttgtatctttgttctcactaatgttaaagaacttctttggtttctgccttactcagaagtcattcagcagcaggttgttttatttccatgtaattatatggttgtgagtgattttcttagtcccaacttctatttttattatgctgtgttccgagagagtagttggtatgatttccgctcttttgcatttgctgagaattgttttttgtctgactgtgtggtcagttttagagtatgtgccatgtgcagatgagaagaatgtatattcttttgttttggggtagagttctatagatgtccatttggatctatttggcccagtgttgagttcagttcctaaatatctttgttaattttttatctcaatgatctgtctaatactgttggtgaggtgttgaagactcccactgttattgtgtgggagtctaagtctctttgaaggttcctaggaacttgatttatgaatctggatactcctgtgttgggtgcatatatatttaggatagttaggtcttcttgttgaattaaaccttttaccattatgtcatgcccttttttgtctgttttgatctttgttggcttaaaatctgtttttttctgctttccatttgcttggtagatttttctccatctctttattttttagcctacgggtgtcattgcacgtgagatgtgtctcttgaagacagcataccattgagttgtgcttctttatttagcttgccattctgtgccttttaattgggggcatttagaccatttacattcaaggctagtatggatatgtgtggatttgatcttgttattgtgttgttagctttttattatacctacttgtttgtgtggttgctttatagtgtcacttggtctgtgtacttcagtgtgtttttgtagtggttgctaatggtctttcctttccatatttagtgcttctttaaggggctcttgtaaggcaagtctggtggtaatgaattccctcagcatttgcttgtctgaaaaggatcttatttctccttcacttatgaagtttagtttggccagttatgaagttcttggttggaatatcatttcttcaagatattgaatatagacccccaatctcttctgacttatgaggtttcttctgagaggtctgttgttagtctgttgggcttccttttgtaggtggcctgttctatctctctagctgcctttaacatgttttctttcatttcagcctcatagaatctgatgattatgtatcttgggcataatcttcttgtaaagtattttgcaggggttctctgcatttcctgtgaatgttggcctctctctataggttcagaaagttctcatgatggtatcctgaaaagtgttttccaggttgcttccagtctccccatttctttcaaggatgccgatgagttgtagatttggtctctttacataatcccatatttcctggaggttttgctattcccttttgttcttcatcttcttcttcttttttttttttttttgctgactgtcttatttcagaaagccagtcttcaagttctatgattttttttcctcagcttggtctgttttgctgttaatacttgagattcttatagaggttttttcagctctatcagatcaattatgttttttctgtactggctattttgtctttcagctcttgtatcattttattgtgcttcttagcttgcttagattggcttttagtgttctcctgaatcttgatgctcttttttcttatccatattctgaattttatttgttgtttcagccatgtcagcccagttaagaacccttgctggagaactagtgtagtcattgggaggaaagaagacactctggttttttgagttgttggagtttttattattattactattattactatgattattattattattacttacatattttttttgacggaatcttgctctgttgcccaggatggagtgcagtggcgtgatctcagctcactgtaagctccgcctcccaggttcacgcctttctcctgtctcagcctcctgagtagctgggactacaggcacctgccaccacgcccggctaattttttgtatttttagtagagactgggtttcaccatgttagccaggatggtctcgatctcctgaccttgtgatccacccaccttggcctcccaaactgctggaattacaggcatgagccactgcacctggccgagttgttggagttcttgtgctggttctttctcatctttgtgggctaatgtttcttcagtctttgaagttgctgtcataagaatgggtgttttttcttttattctgtttgacgaccttggggctttgattgtggtataacatgggttctgtgaactgttgtgctggagtggccgaggtgccctcggactgctagtcacaacactttgataggtggtgccagccaaagcacttcatagggtgatggcaacgggatctatccttgttcgcatgtgccagcggcagtggcaatgtggcggggtgcatgttcattggctgtagcagggtgttagtgggtgctggcctccctgcaggcattcggagcagtgagttcaggtctgactctttagtcccctagggccaaagtctcctatgggagcaagtcgagcctagtgggttaggtgtccctggctgtgctccactacagatgctcccacaccaaaccctctgggctctatccttaccacttctcgaagcagctttccctgccaactcaagtgtccatggtgtttgaggggtctcctcctgctgggattccagaggcctgtggccagagtgggtcgctccttgcctgttcaactcaccctctccgctggagttgttggggaccaataatgagccttagtgtgtggtagctcctgaagggtttccagcttcctctctcttcacatcagcccctgttctttcagtgccttccctctgaagatctgctagaagtgtatcagtctccctgatgtcctggtccctcagttagagaggttcctcctggctgcatctggtcgaccatctatggctcctggagctgaggacatgaagcagtgaatacaggaccccaagctctggctggagtgagacaaagaccccaccatatccctggaagtcgctactgatatctttaaaaattgctgcttctaggccgggaatggtggctcacgcctgtaatcccagtagtttgggtggccgaggtaggtggattgcctgaggtcaggagttcgagaccagcctggccaacatgatgaaaccctgtctctactaaaaatacaaaagttaagtgggtgtggtggcatgcgcctgtaatcccagctactcaggaggctgaggcaggagaattgcttgaaccctggaggtggaggttggcagtgagccaagatcgcgccattgcactccagcttgggtgacagagcaagactctgtctcaaaaaacaaaacaaaacaaaacaaacacaaaaaaaacgctgcttctagataaatccattgagtttggtgtagcaaaaaattgttcccctttaattttctgctggccgatataaaatgaagacatttaattattcaagatcttttagatattagttgttactcatttgtgagaaaactcacatcgatacatggtagtcactacatacacttgccaaaactgcttttgtttttgttctattatggctaaaagagatgggtctacctgtagtgttacctaggcaatatggatgtacactgtatttcatcgtcctaaattgcttaccattgaaattcatatattatgtttgttactttggtagtgtgttcccttgtaactctgcccgtgaagagtaataatcccttggtcagccataccgtgtttctttgattcatttgaagttgagagcaagggcttcatcattaaataaatctttgctcttcctggttttgtgatcttaggcaaattaattaaccttttgtgttttacctgatattagcatagttcagtagttgagtggactctagagctagcttgtagggatttgaatcctggctctactacttaaaagtatgtacgactctgggcaagttactaaattttttgcttcttctttcttatctgtaaattaaggataatatgggtacttatttatgtactaatagagataatagagaatgtttattgagtgtttactatgtgccagatttaaacctgggtaaaaataacataatagggttgttgtgaggcctgaatgaataaaataagtaaaacactttgtacaggttcctagtacattttcagccaattatgtataaaatggggttgtgataattataatgaagcatatatgtctgtggaataagtatggatccaatatttgtggcagaaaaagaccacactgtgtaactccattgattggctaattggtggagacacacagaatgagtcccaacattcttttaggtaacttgtataaaacatattaacttttctctcccagatcatgtgcaagatatggtagatccaagaatcctatccaatgatacttcaaaattgtaaccttagtatacctgttgtgttaaaagtattgtttagaattggccacactcgacagatggccagggaagtaaaagcacttattggggatagctttgacaccagctgtattatattaaagatatgatataaaacttttctcaacatcagtagtgattctgaagctgtcagaaatagatagggagtcatgatgcccctaaagttcatttcccctttcctctatagtaatagaaccctgatttttgtttgtttgttttaactgggtacatggatgactagaagaaaagactatttcccagccatgtgattaaattctggcaaaaaagagatgaaagcagaagtattatgtgtgtacttctaaaagacagtggctcagctgggaaggcatacctttttaccattcagttttcttccactttattgaaagtgtaataactggagcattaacaatcattttgtaccatgaggcagtcttgaagatggaagccaggcatctagagtggtggaagagaaagctagaagcttgggtccctgaggactttgtgcaaccatcatctctacttcacctatctccagacttcttttacaaaagaaaaaaccaaatctcaatattgcttaagctattgctatgttgagatactctgtaatgttcagaattgtatccctataccaagaggaagaagtgtaaataatgaaacactgttgagatggaatggtttatgtacacaggagcatgtgttgtgtatggagagctggagagtagcataaataactaacgaagtgagaagattgtagatctactttaatcatgctagtgaaactggaatattgtattaaaggaaaatgtgaaactttggaaaaaaggaaatatgtaataattcaatgacatttgtacaactagttatcaggtcacattttgatggatattggggatggttaagaaagctaggcggcacagatcactctggtctttggaatatagattaatggtttttcatatgattctttgttatgccattgttaaatgaagtgtttataaccttatttttttctggtaaatcatattttattaatgagacttcaagtgtcttatctcaaaatgttggattggtaaatttgaaaaaaatgttagaaaacattagctatttcctgagggagaggttgagcctttacaacaaatgttgatattcttttacttgttaatataaagatgcgtaattgtcagggttgtctagagaaacagtaccaatagggtataaataaatagatacataagaggagatttatcatgggattatagtcattcaagatgtcccaccatatgccatctgcaggctggagaacaggaaagccagtggtgtgaattagtccaagctcaaaggccagaaaaccaggggaacccaaggtctaagtctcagttcaaggtggaaggccttcggaggggattgctgctgctggataagtcttggagtctgaaggcccaacaattagtagctctggtatttgagagcaggaggtgaaagtaccagctcaagaagagagtgagaattcacccatcctcaacctttttgtttaattcaggtggtcctcaaaggactgaatgatgcctgctcacattggtgagggcacatgttctttattcagtctactaattcaaatgctaatctcttctgggaacaccctcactgacacacccagaaatgatgttttaccagtgatctgggtatcccttaacccagtcacgttgacataaaaaattaaccattataagatattttggttttcattcacaaatcataaaaaatatttgtggttttcactcacgaatataaaaataattgtggggttgcctgtccttgtgttaaaagtatacatagaggagattttctagttttctcttgcaattcttaaagccagcatgttcttaataatagaaaaaagctgccattgattctggttctgctacttactggctttatgaccttggggaagttatttaaattcagcgtaccttaattttcttcactgtaaaatggggataataatacctacctacgtcgtaagggtattgagaggattaaatattatgatatctgtgaagcaattagtaaagggccttgcattcaggaaacactatataaatgtaatcgttattattatacttaatgagagaccagcgtaataggaattatgacggtcattttaaagacaaagtaatgcaggttcggatatgtcctgcttgattctttactgtcccatttctatattagcggtgccaggatttagaccttgttctgtctaaccttagagcctgtactttccaagatcttataccatcatccaacattatcagatccctctgtgtcctaactgttcacctaacatattatgtgtatttgtctttagcatatcaaactgagccatagtatcccacaatggttgtaccataatttatttgtttcccttattttgtgagatatatactctatgccactaatctggcctatgtgttagtgaattgaataccagccagtgataccattatgatattcttcatacatgcagtagtaaagattagcctttaaagggctttcatgtctcttgtatgaagagtgcatgtttactgcacttttgaatccctactattctgtagaaacagttttgaatgtgtttgaatttgcacctttgaatctattgttctttagaaactgttccctggaaagattgttaatgtttattcattatttgtgttgtatatgactaggaattttttatttttttttgagacggagttttgctcttgttgcccaggctggagtgcaatggcgcgatattggctcactgcaacctccgcttcctgggttcaagcgattatccagcctcagcctcctgagtagctggggttacaggcatgcgccaccatgcctggctaattttgtatttttagtagagatggggtttcaccatgttggtcaggctggtctcaaacccctgacctcaggtgatctgcccgcctcgacctcccaaagtgctgggattacaggcgtgagccaccgcgcctggccatgactaggaattttttttgcaatccatttatctctccttataactattaaatgttgtgtttaaggaccctgcagcttatcaagagttgatttgaatgcaagttatttcttcgaaattacatttggacctatttctgaacatctgcttttgacattttatgcacgtaaatataaatgagtaaacatatgaaaatgactttgaatcttagttctaattcttataaggcctgatttaatttttattttgcttgggattttgaatataggtattaaataaatataaatttggataatatgtatgggcttattcaacaaatactaataaagagcttgctctgttttaggtgctatgtatacttttagctcttgctctactgatacataccttttagtataggaaatagataaataagccaatttgtgttataatagagaataatggaagagggtgagtgtttttttaaaaaaaacatagagtgttgtatgtagcattcttgtagggtattgtagtcattctttcgttctttcttgtttttagggtcccagttttgttttggagcctaccctcagggataaattctgattagtctaagctggtaatgggaatctattccatttgtcagtgattgagtttacaagggacagatgactcaatcttggctaggaagatgtgcaggtcttcaggggagatgactgtcagtggtttcctctctcttaaaattaagagacagattcccagttgttcttttgcacataattgcatatggctggaattgaggcagctaacttgctaccaggaagaaagttagctagaggacaaaaacagatatgctaaggtagaatagaaagatgaaaagggatttttcacagtttcattgaaccccattgaattagcttttttgctgttgagaaactaaaattttcttatttttaaagtcaccttgagttgcaatttctcttgtatcctaatgtgtcgtaattgatactagttgtcaggggctgttttttggaaaagaagtataatataagtagagatctgaattataagaatgagccaaaggtggaaggaatagcaagaacaaaggctgcatgttgggtaagaacttggcatattccagaaactggcagaaggctgatctacttggtttctaagcaagggaaagataataactaatatttatagattgttttactgtgtacaaatcacttttatgcatattatcataatcttcacaattatgtgagtttctacgattatgactcctactttatagcagggtaaactgtccatatgtgattgatttgaaatggttgctctttctaatattaacacatcatggtgccaatcaagtatatattatttatgtgcacacacacacacaattggagaaaatggtgatatatatacacatttcatttgaatttactagtattaccatttttcagcagtattaatttatttagggctgaaggtacagatggcaagtccagatttctagacccatttgagtagttaattgtatcagtaaacacagcctggtgtgttattgtgtgtaattgttaaggtgagtgagatattcttgataagaaccttataaatgtgattatgtgtttgtactttataactaggaagattaatttctaagatattggctgatttcagtgaattagtattttgtattcatgtatttatgatgctggcattttaaattcatatgtatatactatgacactactgataagaaatatgaagtatgatagatgagtataagtaatgaatgaaaatcaaattttataatcttggtaggatttatatgaaaattttcttttctctgtcctgctctgccctcttttcctccctgtcttaccctcttcttctctcttttcatcctctcctcttccttcccctcctctcctctttcttcccctccctttcccccacctctctttttcgttgtcttcatttcagtttagttggttttaccaaatgcttttacataaagtaaaagtttatttcagctagcattaaaggacccttttaatttataatactatttttacttgttcctttctacttctttcttacattaataaacacattatttgtaaattacccttttcccgtatagggagcaaagcaataaaaaagattttaataaattctgtaacaatatttagttaaaaaatgaattgcgatcaaaggagaagatatttaaaaaatagagtcttgggcacatattaatcctgaataggattggattatgtatgtactatatatggctcttaaaatgtttgtacattataattgataattagcttttctttaaaagttttatttataattctctttatcaacttgaaaaatttttgttttctagtagattgttaatgaagaaaatgagtgtgaaatatgtcatgctcaatctgttaccttgtaacagtcattcgttaaatttgctaaataaatgacttcacttttctgttaaatttttcagtttattctattatgttgaattacttcaagaaacactttgtaataatgattttggtttttactcttttcagttgttaaaaaagtaaattgataactcttataactgcagtgtatattttaatttaggaaatcactattatttgaataatttatgatgattccttttattctgagaaaaggttaggttagtaagaatgttcagtacaatttctctggtttgttaattatattactagttatttaagttgattcttattgtctgaaatttgtgaaaaatatagttttcactttaacatttggaaagtttattacatctatataataaatgctgttgaaatttttttcattaaaagtaagaatgtactaggtgatgatttgctgaaaaaatctgtctcattgaaacttaaatgcaaggacataatttaggcatttaatgaaataacaactttcaattattgacattttcaattatagtcacaaaataggggtaatttaaactttctcttaaaatttttgtcaaccttattggaacataatttacatcagtgaacccatattaagtatacagttagatgatatttcttaaatctatatcctcatgtaactgtcatttcctttcttaatcagtcatcttcgtacttgctggcaagtactagtctgatttccatcactatctgttagtttctttgttgtagaacttcataattttatgaatttaagtttttaagtcattaggctattcaagtaatctattctttattgagcttcagtagtttgtttcttttagggaatctgtccatttcaggtatgacttcatatttattggccgaaaatagagtcatacagtgtgtattttttttgtccctggcattttttgtcaggcatgtttttgagatttaaccatattgtgtatactggtagttgttgtttttttaaactgatgaacagttttccattgtatgaatgtgccataatttgtttatccattcacctgcttgaagatgcctggattgttccaaatctttggctgttgtaaataaataaagttactatgaatactcatgtactagtctttgtatggacatacatcttaagttcctttgtaaatacctgaatagaattgttgaggtatacggtaagtatatatttgcaagaaattgacaagctgtttatttttctttttccattttctagaactctttgtgtagaattgttgttatatctaccatgttatgtaaatggtagaattcgcacataaagcaatatgggcctagagttttcttcatgggaagatttacaaatacgcattcaacttccttaagctttaagtttttaagtcattaggctattcaagtaatctattctttattgagcttcagtagtttgtttcttttaggaaatctgtccatttcaggtatgacttcgtatttattgaccgaaaattatttgtaatattttcttattactcttttgtagtatctctagtaatactacagatagtgcctcttacattcctaatattagcagcttatgttcttttttttttcagcttgtgtccttatgcccttgattagtccaactggaagatttttaattttattgatcacttcagggaacccattttttgttttcattgatttttctttgttgtttatcggttttatattacattcatagagcttacactgtgaaccttttacgtatttcaccaaactttcaaatacttttatacctcttgaggtataatatagggactttaaaacagtgtccttccttttttctgcttgctatgttttgtgtaagtattgtcatatattttactattgtgtgtgttgtaaaccccataatactttgttattattttagctttgagtcaaatttattttgaaagaaattagaaatgaggagggggcagggtggaaaaaagagaaattagaaatgagaaaaaattttatttgtatttacccatatatttaacatgtctgtttaaatccatcatttacattcaagtttctatccacaatcatttctttcagcctgaaaagtatccttttaaatatatcttgtagtatgtatcagctggcaacaagttctttccatttttttgttttccaaaaatatacttattttgcatttattttttaaaagctttttgtttcagaataattttagaattatagaaaattagcaaagagagtacagtcactgtatactctttgcccatgttcccctaatgttaacatcttacgtagccatggtacattcatctaaactaataaattaacagtagtgaaatactctaaactacagactacatttggatttcagcagtttttccatggtgtccctgccctgttccaagattcaattcaggataccacagtatatttagtcattatgtctccttagacttctctaatctatggcaatttctcagttgtttgtttttatgactttaatagttcaatacttttgaagagtactggttaggtattttgttgaatgtccccagatgaggatttgtctgatattttcttttattattagactggattcatggttttagaggatgagtactacagaattgatgggtccttttttagtatcatttagaatagtttcatcatataagttactcttgaagggactttataatcatcccctccttgtactttcaactcttgggaaccactgaactatttttcaacctatagtttttccctttctgtaatgtcatgtaaatgaagcacacaatatgtagtctttggttttgtcttccttcacttagcaacatacatttaagattcattttgttgagtaaatcaatggcttatttctttttattactaactagtattcctttgttttctatgtatcatgtttgttaatctgttcacctgttgaaggccatcttgattttttttttgcagttttttgtctgttatgaataaagctgctgcaaacatttgagattaattttttgtggaaaaatatgctttcatttttcttgggtggattaactttgaaacctcaaactaaaacttcttaaagaacccataggagaaaatatatgggactttgggtttagcattgaatttatagacatagtaccaaaaccacagtctataaaagaaaagaagtcagtatattgtattatatttaaaaaatttaaaaattttgctgtgtgcaagatactgttaaaagaataaaaagataagccacagactgggagaaaatatttgaaaatcatatatttgataaaagacttatgttcagaatatataaagaactcaagtctcagcagtaagaaaacaagcaatctaaaaaatgggcgaaagatctcaaaagatactttaccagagaagatatacggatacaaaataagcacatgaaaagatggccagatgttcagtgtcatttgttactagaaaagtacacattgcaaccacactttgataccactacacagctaccagaattgcctttaaacaaactgacaataccaaatgctagggagattgtggatcaacaggagttcttattcattgcttctgacaactcagaatggtgcagccactttggaatagagtttggcattttcttgtaaacatacatttttcatgtgacccagcaatcctactcctagctatttgacccaagttagctgaaagttcacattcacagaaaccttttatttttgaatatatttttactgaataacaaagtgtagttttgtcattttttttttttagcattttaaaaagatgttgtcccattgtcttactagattgtatttttttctgattagaagccccctgcatttctttgttaccatgtatggtttaccccccaatcttgtggctgttttaccctctaaattatggttttatttgtatttaaaaatagattggaaattctatatatacccatggttaaacatattttcaatgtacattacttcaaatttgatgataaattttgttctgagaagtccttttctgaagccaaactcaaaaatggggaagtgcttacagatttccaactggccccaaaacggatattgtaaatggctttttgcctaactaatgatgatggatgagtttcatttgccttttatcatttgaacggttttttgttcacaataatagttactgtaaggtgatgcagctgtggtgaagctgtaaaacactgtagtatctgacaataagtcctatcaacagtggctacctgtattagtctgtttttcattgctctgaaggaattcctgagactgggtactttataaagaaaagaggtttacacagtgaaaacctgtctctactaaaaacacaaaaaatcagttgggcatggtggcgcgtgcctgtagtcccagctacttgggaggctgaggcaggagaatcgcttgaacccaggagttggaggttgcagtgagccgagatctcgccactgcactccagcctgggtgacagagcgagactctgtctaaaaacaaaacaaaacaaaacaaaaaagtttacttggttcccagctttgcagtctgtaggagaagcataatgccagcatctgcttctgggtgagagcctcaggaaacttcctctcatggtagaaggcaaagggggagccagcgtatcacatggtgagaaggggtgcaagagagagaagggaggagataccaggctctttttaacaagatcattgtgtgttctgatgaacccatcataagttgaaagtatcatgagtcgcaatatgtttaatacacctaatctgaacatcatagcttagcctaccttaaatgtgcccagaacacttatattagcctacagttggacaaaatcatttaacacaaaactattttgtaatgaagtgttgaatattttgtaatttattgaatactttactgaaagtgaagaacaaaatggttgtagggttactcagagtggtttctactgaatatatattgcttttataccatcataaagttgaaaaattgttaagttgagccattgttaatttgaggaccatctatatgatattttttgttctacaagttatacatttttattgtagttttcttttttcaacattttcattttttcttttaaatcctagcacatatttcgatacttgtttcagcgctcttgtctgctgtcatcattgtcatttctgttttctggatctgtttaaatggactaattttctcctggttatgggttacattttccttcttgttggcatcatagtataaaatacatatttttggcaaagtaattaatactttattcaactgtacttctgttgatgggcaattacgttgtttttccagtttagtgctgttgcagacaatgatgtaaagagtatgtgaatgcattttgtttacatattaaaatgcatcttagcataaatttttgcatgtggaatttcttgtcaaagggcatgtgtatgtaaatatttgatatataatgccgtattaccctttgcatagggtacacatatttttattatttaaataagtgctgaattatttttgagtttaaaaggcaaccctcctttgacatggctcatagcacaacaggccaggcttttatcttcagcagattgtcgcatactcatcttctggcctcagcatcaaagtcaagctgcttgaatatgattcttggaaacatccttttcacacagtcatatgccaaatgtggccattgttcattttcttgttagacttaagaagtgtcagtttgatcgtattataaatggtactgcattttttgttatgtctaatggaataattgagctatatctatctttaggaaatgtaggagggggaaatgaggaattattagtcaaagggtacagagttttggttataaagataagtctcagaaatcttttgtacagcgtggtgcctatagttaacaatactgtattgtatggttaaaaatttcctaagaggatagatcttacgtaaagtattcttactacaaacacacaaattagtgatagtaaataagagagtgggagaaaactgttgcagatgatgaataggtttatggcatagattgtggtgatgagttcacaggtgtctactttgcaaactcatcaagttgtatatattatgtatagctttttgtatgtaaaacatgtttaaaagaatgttgaattttaaaaaagaaaaagacaacacatcctagcctgcttatatttttggggagttatgatgatggtaatggtcacaacaatgacaacacagttatcgtaatcattgtaaatttaatagagacttcgttctacttctgaaaatttttttcagtatggttggatcttacaaaggtgctaaatgtttgtgataaaatagcttagtttcagctctgcggtaaaatcttgacataatgatcatctgtttatatatataattttaaacattgtgtaatacataaggattttgaagattgcaacaataaattaccatgttttattctgacactgtacatatattttgattttcaaattatagtattataactgtggtatgcaggtggcagtgttcaattttatgcttaaaaataaaatgatagcaaaaaatgcaattatttgtggaatagtttatattcagtttctgttgagtcactcagaatgttagttgctgtaagaagaggctttttttcttttttggttgtttgttttagtggcattacttcactttgcaattagaacccactgtaatattacctattgaaggcagggatttgtgtctgtcttgttcactgctgcatcctcaatgcctgggatatgtaatgtattttatgtaatagaaattgaatgattagtttttgaacatatgagtgaatggatcatagtgttgtatagatttaggtagatttcttccagttgctttccattataaatgttgataagaaccatgctgcatatttaaaaaataaaatttacataacatgaatgactgcactaaatgaagtatattatttaggaggtcagttacttactgctgacatagtagaggatgcttccgaagtgatcatcctgaagaatggagactgcagctcattgtcatttcttttattaatacttcaaatgtgctcccttctctactgcagctgtgaaactttttctggtcttctcaagaactttctcttctctgttttttctctaatgaattatactttcattttttaattccattttatcttcaccactggctttttctttgctatacctttttattttatttaataaaaactacttgttgctctgggggaatgccatctgatgttggaaatgctctgtatctacaccattcgtaatggtaaccactagacacaggtagctattgagcaatcaaaatgtggcctactgtgcctgaggaaatacgttctttttttcccccagacagggtcttgctctgtcacccatcctggagtagaatggtgtgatcacggctctctgcagcctcaacctccagggctcaagtgatcctcccacctcagcctcccaaggagctgggactataggcgtgcaccaccagttttaatttatttatagagacagggtctcactatgttgctcaggctggggaaataaatttttaattttaattctaatttaaatagttgcatgtagctattaaagcagtgtagctctggatctttatatatatgtatatgtatatataaaattattagtctactttcaaataatatagcagttcatgtgtagtgagacaacttgacttttgtgcacttccatttcctccgtctcatcttttaaatattctgtcatatgttttacatctacatatattataaacccagtgatacattattgccatttttgagtttaacagctttttatcttttaatgtggttaaattaagggaaaatagctctgattttttagatttcatcatttctggtgctatttttgtgtgtgcagatctgcatttttatctggtatcatactcctccttgaaaaatttcatttaacattttttatagtacaattttgccggcacagaatattttttaactttttttttctggaagagttttgattttgcctttatttgcctttgttttgccttcattttatccagtgaaaggtattatctagaatgctcagttgccgtttttccccccttggtattttaaagatgatgctccattgttttttgactggccttctttattacatgtagtgtgttctcatttttttttctctgtatgtaatatttcttttttcctagttacctgaaagatttttctctttcagtttgttttttagcagctttttgtctacattttaattttgccctactagcaattctctgcatttctttgacctgtggtgttttatcatttttttactttggaaaattcccagctaacatctctttaaatgtattttcttctctgttcttgttttcttcacattattaaactccagttacacctgcactagatcattggatattatactacagctttaaaattcctattctgttttttaaaaatttcaatctgtttcttctctttgcgtttcattttgaataatatctatttacctctcttcaagctcactgagtttttagctttgtctaatcttctgataattctgttgaagattttctgatatagtccatttagcatttcttctttgccgaatcccttatctgtttttgtattttgttcatatttaccatgagatcctttaatatatcaattacaattattctcttttctgtctgatagttcaaatatctgattcatttagaagtctggttttggtgtttgctttgtcttttgactatggtttgggttttttttttaactatatatctatatatatattatatatatatatttatatctatagatctatatctcatggtttttttgttgcatgccagacattttaggtaaaaggcaacaaagattgaggtgaatagtatttatgcccagaaacgggtacccttcttctttgatgatgttggtgtatatgtggattgggatggggcagagattgagtcagtccaacagtggtttgagttggatttgtttttttgttgtgattgtaatagttaaattcactgaatcagaaacttgaaattcctgcagtagtggactgcttgctgcttcttcattcttggtttggagcctcggtgctggagtctttcctctgtgttccagctccatccttagcttttagcaggtctttggatgcctgcatcacagcatgacctctgttcatattctttgtaacttttgataaaatgcaccttctagttttgattgtctgtattttcttatctttctttgaagattgttgagttttattttgacaggcagataatttacttttggattacactgatccttttgtagcttgtttttaagctttgttagggctcttgttggcatagcttttattctataactggagtcagtagactttggtttatgagccaaatctggtccacagcccatttttgtatagctcatgagctaagaatggatttttcatttttaaagggttataaagaaacaaaaataaaaattaagaagtatatgtgacagtgactatatatgcctcacatagcctaagatatttatcttgccctttacagaaaacattttctgatcctgcttgcttaattttaatttctaaggtgttttatttcttggatttttaccgaatgctgcaggttttctctgtggtatttttattgtacctggttggaactcacaggtctgtcaactttgcctaatctttgagatgtgttcagcttttagctacccagtatttaatttttctatttctgataattgtcctttgcaagcctcatgagttcttactataacttagtttcctgccaaagacttaaaggatctcctatgcaaattttggagctttctgagtatctacctcctctttagtataatgacctgcaaattccacctaccttaaattccctgaactttggtctttgtcttctcacctgaggaagatggctgtgttttgtttgggttcttcctttctgtgctggtgttcagcaaatgcttctaggcagaaggctaaagtgatcatagggcttacttttattgttaattttctctcagacattacagtcttctttgacctttgcccaatatctgaaaacagtttttctaaatatgttttttaaagttttctagtttatatgtgaggctaatctagtagttattctttcatggttggagatggaactctgtttagcagctattaataaatgtgcttttttacctctggtattagtataaaaccaataattgtaattgtatctgttaaatctcttatttgctgtaaattgagttttgttttatggtatgtataagaggtattagcagaatacataaggaaatgtgattaagactcagttctgtcctgcaacttgaatgcctattctgtgcccagggctttctataacttgctagagacagaaaataacacatgaagtgaagatcaggcttttaacctactagaggaggtagtcatatgtattaattatttattgctatgtaacacattacctttagactaagtggtttaaagcaacaatttattatctgttggtcagaatttagggatggtttagctggatcctctggctaagctccatctcctaggtgagggtctttaaaaagcctgcattcaagatgtggaccaaagctacagctgtcttgaggcttgactggtgatggtgcatttctaagcttgctcacgttcactggtcattggcgggattcaacaaccttgtgaggtgcttgtggtcttaggactgagcactttaaatcttcgttggctgttgtctgaaggctgccctcagctcctttccacatgggcctctcagcatgatggctgacagtatggtagcttgtatcatcagaataagcaagcagggacaatgtgagcaagacacagaagctccagtcttttgtaaccttatcttggaaatgaaattctgtcacttttactgtattctatttaagaaacaagtcactaggtgcagccaacactcaagaggaggagatgatacaagggcatgaatagtggacgcagagatagttggcaaccattttagaagctgcctacaacagcatgtggcatattaattatataaagaattgtaaatgggtctataaaataatgtaacaacgtcaatatataccacataataatttgctgcatggtatgctgaggtgcctcaccactgatgattattttatttaagccttttccagtattctctgggagaggtggtatttattatctccagtttacagattgatgttcagtgaggttacctagctatgatgtagcagaactgagactccagtctagacactgctgattctagcacccatacttttaatttctatgtcttgtcagcattaaaataaaattactttttttggagcacttcttctgtgccaagcattatgataagtggtttatatatgttaaccttatttaaggctcgtggcaactctattaagtctccttatcttactgatattacactcgagcttccagattcagaaaaagtactttgaaaaatcaaatatgtttattgttccagagacattaaacaaatattacccaaagaatctctgtaaatactgaaagaaatgaatcatttaaataccttagtaccttaaaaaggtgatatcaatctagcctaggcaacatgccgagattttgtctctctctccccttttttttttttttgagacagagccttgctctgtcgcccaggctggagtgtggtgttgtgatctcggctcactgcaacctccaccttccaggttcaaggaattctctgcctcagcctcctaagtagctgggattataggcacccaccaccatgcctggctcatttttgtatttttagtagaggcgggggtttcaccatcttggccaggctggtcttgaactcctgaccttgtgatccacccgcctcagcctcccaaagtgctgggattacaggtgtgagtcactgtgcccagccaattttgtctcttaaaaaaaaaaaaagtgatatcactaattaaataaatttgcagaaagaatcctggcacatttcagtacatttagtatatttagtattttgcagaagggtactttgtgagtcttaagtagtaataaatttataaattcttgaaagcccactctgagaagaaatctcaacaaacactgctatataaattttagtcagaaattagctgatatatgtaatttttaaatatttttacgaatttgaactatttttactaatactttcacaaataagttgagtggttgtcatatcaaaggctgaacatactttcttcagttatatcgttgtctttgcaaagtgaatcttctaaatgaagaaaataagatacattattttttcatggttaaaaggtaaaccataagactctcttggctgggtgtggtggctcacatctgtaatccctacactttgggaggctgaggcaggtggatcacttgaggtcaggagttcaagaccagcctggccaacatggtgaaatcccatctctactaaaaatataaaaaatgagccgggcgccacagcagacacctgtagtctcagctactcgggaggctgagacaagagaatctcttgaaccctggaggtggaagttgtagtgagccgagattgtgccactgcactccagcctgggcaacagagcgagactcaaaaaaaaaaaaaaaaagactctcttggtcttttaggccaattaaatttaatcaatcaaggaatgtctttataagatatatgttgacaataataaatatgaaagtttattaatgactttatttttgaaccatttccttataatagcattctctcactttctgcattaccatttgctgtcttaagtagggcataaatgcagtttaagctgtatttattagtgccaactaagtgccaaataccgttctgagtgcctgggatacatcagtgaacacaatgaacaaaaattatggcgtttgtattttagcaagcatggttcagacaataaacagtaaccataagtaagtaagcaagcattcattgtagttagtagatagggaaaaaattctgtacttgttcttttaaaccttgcagaggaaaattgcatagaaaactatttgtttttcagcttaacttggttttcttgaccccaaaactggggatttaaaaaatactggcaaagacaaaaaaaatcatgggaaacattctctccaaaaacatagttcaaatgatgctattaattagaaaatgaccatgttttgctcttataaaaatgtattgctttttaaaactcaagtattatcaatattgatatataatatagtaatttaatctcttagatatttttggtaatggtttataaaaaatggaaagtattttttgttgtacaaattttgttattcaaaatgtatgtttctgtaaacttttgttactattcaagttatgctggctttaaatattacgatttttatggtaatcccaaggaaaatgtttcagcatgtctttttattatttaaattactcttttaaagaaagctacctttgctttggttgtttatctcagttgtctgttttctgcgttacttttgcagtgaagggaaagaaaaaaattgtaatatctgatatatagtttaccctctgtagctgtagttttagtattcttgattcagccaactacagatcaaaatatttgccaaaaaatacccccaaaattgactatctacatagcatttacgttgtattaggtgttataagtaatctagagatgatttaaagtatttgggaggatgtgtgtaggttatatgtaaatactatgccattttatgtaagaaacccgaacatctgtggattttggtgtccgtggagggtactgagagacaactgtatatcttaatagcttagaattaactaggatatagtacagtttcagcatataagtatagtaacattttacagtgttgcatatgttgtctcaaaattactgttaattgaaatattaatacttatattttttggctgacgtaccgaattgaatcaatttcttatgccatcagaatgaattcacttcttatttggttttaaagtcacagagccctggatttctgtattttttttacataagatgaaaagtaggggatacctgagtttagaggagtggggattgagaaagagttttaagaaagggacaggataaacaatggagtcagtaaaaagagtgttcttgatagatttaagaatagttattaaaacaacagacaactttttacttggattattcctttttaatttggttttcaaacagttctcagcaagtacaattcttttcattctatgttttagccagtgtaaatcagtaacattaaggtaaatgttgtaggagtaaatgggaaggaagtagagtgtttctaggacagccctttgattttcttctctttgaatattggtgttttaaaaacaattgagatttaaggtgcaaacatagaaaaatagtggccctgtgctctgatttttgaagcctcttctccatcttttctgctcatctttttaccactgtttgatttgtggtcaagtgcccctcacattcagtctcgtatacagaaactatttcttgttttttctctcttctcttgtatatggaactctgtctagacatatgatttctcttctatagctttaaaattatcaaaacatttttaaaattaaagaaaaaaaaatttttatagagatggggtttcaccatcttgccagattggtctcaaactctgggttcaagcaattctcccgccttgtctccttctaaagtgcagggattacagatgtgagtcactgtggctggcctgtcaaaaggttttaaattatatttttgcctacaaattctctcctggggagaaaatagttttgtttccaagggaattctaagcctaatgatggagaaatgacaaatgatacttgtaaccaagcctggaaaagaatgtgcatttgtagtttaagatgcacagtaactaagatgtaactggtgctagacgtttgttgcaattgttggtatttttataaatttgaggaagcagtagtctagcctgatccatttgaacctttgcttctgatatttggaatgactgccagctggttaatggctatgataacctttacttggctaatatgcatgtcagttttagaatttatcctaaaagtgacaatttgcctgtcacctgcagagttaagtggtataatggcagctgaacaatgagggaggagagtggagttgagaactggtagaaatgaaatcactcatacagggaacatgttttttcttgagataatgaacatatagcccaaaatatgtggttgagtacattttgtttttgattgattgttcaaagatataatttttaagtcttcatatataagttaatgtataattatgcaagaaggaaaagaaagtgatgatggcactttgaggactttcaggcttagagctaattagtctgttatctggtagagcactaatgtacatggctgatttaatatacagattaacagatttaaagcttttaccctttacttgttattaggcagttaggttatcttccaacttgttggccagtcaacaccaatgtgtttcctccaagaatctcagtatatgctattttatataccttaaataatttaaatacatttcttactctttccacagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacaacagaatgaagacttgaggcgaatggccgaatctctccggtaggtcctaaaatactgaatgaagaatgatgaaatattgtactttgtttttaggtgtagggcttcattccgctaggaaaaatagttaattatttttataacctgctgtctttgccacaacttagcatgacagttttctatctctgtgtatttaatacagaacaagcttgtccaacccacagcccatgggccacaggtgacccagaacagctttgaatggggcccagcacaaatttgtaaactttcttaaaacattctgagatttttttatttttttttaagctcatcagctatcattagtgttagtgtactttatatgtgccccaagacaatttttcttccagtgtggcccagggaaaccctgatataatttctccatagtggcatcattattttgcatatgcattttaatgtagaaaaactatgccatttcatttatatacttacatttcatttacagttatgtatttaaaaaaattgatatattaaatccaaactatgttttaaactcatgtatattaaaaattttatatgaactgtaacaaagattataataactgggaggctgagttagtctaactagaacttattaaaatgcagaaacaaaagtttatcattaaacaactggatctggaatgcggagaatgattatcattgctatttctagtctgtaaaaaatgtgacatatatctattagaaggcatcaactgtttgaaaaccaaagtctcctatatattttcagggagcaagtaaacataatattacataggcgatctctgtatttttttccaaagttattgaggtaaaacattacctagtatcttatatgcgaagatgatcatgtagtactcactctctcaaactagagaagctagaaatgaagatttgagaatccttactccagaggtggtaattgaccctaagggaagtggtatagagaaagagctgaaagttcatttctctttgagaaacacataaattaaggagtagaaagtggaaacatccaattgtacagaaagcctttagaatagttggggaagaatagtgggacagagctgttacggaaactgaggaacattctgtgaaggaagaatgtagttggcagtgttaaattacccttgatgctatagagaggatgcccatggtgctctcattttctactctcactgcccttcactctttgtttagaactcggatttttccctttgtctagtttcataactttttcttcataatattatttgggtccttttatgtcctttgaaagacaatgctacgtgttaagacaaaaatgaatgaaacattattcttgtcatttgtaccattcaagaagatagcaagcagtcagggattagaaagtggacagaacttcttgaatttgtctattattttctttcctacttggggtactcagggaacatcatggaggaaggtgatctttcagtagagtcttattcattcattctaaagattgataatttaggggttagtaataatagctgtcatttattacatgccaggtactgtgccaaggactttgcatggatcatctcactgaatttcacactatctttatgagatgttagtaccatttttgtaaccattttacagattaacaattatagagatgttaagtaatttaatttgctgaaggtcacacttttcacaagtggtagagcctactttgaatcccagtagtatgactccacaacctaaactctgaataactgtattgccttcctgagcagaaaacagagaaatcagtgacctaaacatcttaggtatgagatcaccaagaatagctactattctagttgattttggagtttgctttgattgtaatcaaatctccttctatatcatgggaattttgctcctaaaaagatttttccccttaacaatttagacttataaataattgctcactttccttatggttccatcttcaatactgatatttcaatttgtttatttctgactgccaaatgtcttgtttttgttgcatgaagggaaagcttgctttagtatgggtttttctttctgcaaaataatctttaggtctattaagtcactttctttatattcttatatgttgaaattaatttctcaactacatttaaatgtagagactactttcaagagctgaatcacctaagtcatgtggtaataccatgtaattacagtctgaaaacagactaagcaaataggcccatgtttatataagggaatataatttcaggaaaatagtttatagttattttccctcaacctcattgggccctttcattgactttactgctggggccatttgtatttcttccaaagggatgtcgttttagagccctctggcatgaaaggaagagcaatggaggtgctactagcattgggatttttttccccttatagtaattaagttaatattttgtactcaatttgctatgtctttttcatataagaaaatgtgttcacaagtcagactacaaaagattaattcagatgtttataactaggtcgtttctttgagataaggcatatggattggagttggaaagcaacacaaaagcttgaaactacaattttttagattttctagattcaagtcaataatctgaaaagccattaacaaatctttcggctagaattttctgattttgttgatagttttagaaatttaggaaaataatttaaatatcgtatcttggagggatgcaaatgtagaagcacaatatataggaggttgcagtgtatttgtgtaaatctgatctattgatgagtaatgtctgtacataaaattcacttcctttatcgtagatgtctgtgagttttggcaaatacagtcacgtaaccatcacaaaaactatagatgaattctacctccctctagaattctgttgttccctcttatggtcaaattctgtcctgacctcctgtccctggcacttaactgatctgatttctgtcacacttttttcctgtttcagaatgtcatataaattgaattacatagtatgtagccttttgagtctgtcttttttcacttactataatgtttttgagtttcatcaatactattgtctgtattagtagttcattcttttttattgctgagtagtatttttattctttttaaatgttgagtagtattccgttatattgatgtgtcttagcccatttagcattgctatcacagaatacctgacactggatagtttatagagaaagaagttatttggctcatgattctggtggccagaaagtccaagattgaacagctgcatctggtgagggcctgaggctgcttcaattcatggtgggaagtggaaggagagtaagcgtgtataaagagatcacatgataagagaggaagcaagacagaaaccgaggaagccagacttttttaaacaacctgctcttttggtaactattccattcccatgagaaggagaactcagtcatctctgaaggaggagcattaatttattcatgagggatctagctccataacccaaatacctcccactaggtcccacctgccaatactgccatgttggggatcaaatttcaacgtgagttttgatgaggacaaaccacatccaaatcatagcaagatatatcacttttttttttttaatccattcaccaattgaagaatgtgaggttatttccattttggggcagttgtgaacaaagtcactattaacctttgtttcataaacttttgtatgaccatagtttttatttctcttgggcaaatacctaggagtggaactgctgggtcatatgttaactgcatatttaactttataagaagcaacccagttctttttctagagtacctgtaccgttttgaaattcctaccagaaattcttgagagttctacttgctctcctcctacccagcatttgctattgtcagttatctttattttagtcattgtaacagatatataatactatctcattgaggtttcaatttatatttctgtaatgaatgatattggccatttttttaatgtgttgatttgccattcatatgtcatctttggtgaagtgtttattcatttcaccaaagaatctgttgtctattttaaaaaatcaaactgttttcttttaataagttctttgaaaaaattatttttaaaaaacatataaacacaaaattatatttattagtaatataaaatatggtataatataataaaaaacaaaaacatggtggcataaaacaatcatttatttgctcttgatttttccaatttgggttaacttcagctaggctttttttctaattataaatagggtcactcatgtggctgcagtcatctggtggcttggttatggttgggcagtccaagatgacctcacttacatatttggcaattaggtcgaccattaactggctcacttccatatttcttttctggaaggatagcccagatttcttacatggtagtgttccaagaggaaaatagcaggaattgcatggcctcttgagactgagcatcagaagtaacacagtgtcaattctgccacattctgttcattgcaagtcaagaggcctacccatattcaaaaatggaagaaatagatactgcatcttggttgatggaactacaaagaatgtgtaaccgcatttaacctaccgttctcaccacagaagggaagttgaatagattggattaggtcaaatcatggtgggcttatatagccagagttatgtatagacccgattgatagataatagagaacaatagttggttttcagcagaggaatgacacagtgaaaatggttgaggaagatttagattttcaggtggatttggtgcatgtgccagattggagttaagatatttcttgggaaactcttaaagtattaatctagataagaggtaatgcaacttacactgaaattaatgattgaatcagttgactttgatgcttaggttttcaacatgcctgtatttagagtttcccagacatctctttctttcttgttcattggtatcatgttagaacacatgtagtgggcctttaaaaaatttagaaattatcactttctcagtccttttatgcttcatgttcgttttgtttcaagtttaataatgtgaaatagctatttgctcacagaatttttgctccttgggacttgaaccagccatgttgcttcctagagttgaaatttaccagaaaacacccagaaaattgttggtttgtgcagaaatccccttgagcagtgaacctcaacctggttggatgtcaatctcatggagttgtaaaatctaaaaagtgcttaattgacaactttccttttaacctaatccttgttattctagggacatttatttttgagaacagaacttaaaaaaattcaaatgtggcttttggccttttggccgattaatagtttttttgtttatttgtttggtctaggaaaggagaagagatttcttctagaatttagatgctagctgtaaaactgtaaatttaaaaaccacaaagaatgtatgattaatttccgattacctgtttttctgagctgtgtgtcatctgccaatacgggttacagacaaagcacaaatcttctggtggaaaaatttgtcccaggcaacagaagtatactgagttgggtagaaaggaaactgaagtggttcttcacaggtcatgttttactgttgtttgagaagattgtgttaaaaagtgggttgcctttgttctagttggttggttggaagattttgctctagaccgtcttctctataactcctagtctctcatataagaagtgtacatatattcttaaagccagtgagatagattggaatgtgtacagcacctgccatctaattataacctttcatgatatctgccttttgctttttcaatcttgtatccattattcctcatgttatcaagaatatcttatttttaagatataatgaaagatactccttccctgagaacattacagtgggaacaacattcctatcctgataggcctgattaagcagatattctctccctggaatttcttgtaactttttaacattttactggattaaatttgctaacattttgttttggattttttctatataaatgagctgtttatttatgatttttccttcttgtgatgtctttcaggttatcaaggtttatgcaggccaattctgttctctggaaaagtttatgtaaagttgatattcattttcttttaaatattataattctaccagtgaagttatctgggcctggagtctttttgtggggaagggtggtggcgaggaaggagaacatatgggaagattttagattctggatttcatctctttaatataaattggactgttcagctctttttttttctcatgtcaattttggtgagacgtgtttttcaaagcatgtgttcattttatcagcatgttcaaatgttctagcttaaaattgttcttagtgccattttattttcttctccatacttgtatatctatagtaatgtctcctttttcattcttaatattggttgtgttttctccttttatcttgctaacagtttatcaatttaatttgctttttcaaagaaccaacctctgtgctttttttttctttattgtatatctgttttctattttattttcttttatgtcctggaaagccttaaatttctctctaagcacagctttcagttgtattccataagttttgatattctatttttgtcattaatttaaaatactttaaaatttgtattgtgattttttttttctatgacccataggttatttagtagttgttacttaatttccaaattgggctattctgtttatctttcagattttgatttctagtttgttcttcaaccagatagaattatattctatatttcagttctttgaaatttatttaatggcttagcaaatgacttatgttgttgaatgcttaagaaatgtgtattctgttgctgagtctgatctagtatatatgtcatttaagttaggttggttaattaagttattcagatttattaatttttataaacactcatattcttttataattggccacatattttttctttctagtgttctttactccttcctgttattcagttctttcatgttgaatcatgttcttcagccttaataatatcctatagtatttatagtgcaggtttgatagcaataaattcagattctcttttttaaaaactttatctttcattttgttagatatttctattgagtgtagaatttactttagcagtaatttttaaaagcatttaaaacatgtcatttcattgattcctgcctttcatagtctctgagaagtctgcaattttaagaagcgtatctttctctttggctgagtttacttttttttttgtctttggtgttaagcacttgactatgagtgcctagatatggctttatttgtttttattcagcttgaagttcactgagctgcttaaatctgggagttgatgtattttatcaattttggaaaaccctcagctactatttcttcaaatactgcttctgaagccattattttttatttttttccttatggaattccaattatatgtattattaaacttatttttatggtatctcacatggctttatgtgtctttcatgatctaatttctctttgcactttattttgtattattttctattgaactggcttccaacttatttcacctgtcttctgttttgttcattgtgccgttaatcacacacagttagtaattttttatattttttgattctagaatactcacttgattctttttgataatttcaaatttctttggaaattctccatttttcatctgtcttgtccatgtttcttttaatttcttaaatagttattctaatataactattatattttctcctaatttctatttcatggatcaccttttggttgatttcttttgatatttattttgattgttagtcaaattttctgcctctttgcatgtctagtgattttaaatttaatatattgtgtataaaggcactgtggaggctacagaggcttttctctgttggagattgggcttaatatttcaatccagtacaatcagtgattgaacatggctgtgttttagttttagtaaaacctagcccactttgtttcttccttgttcctcaggtataattcttctaggctttttattgacaatttggtagatttctcttcagatttgaagtataggacatttcttctgcccttcagaggttttgagctttgctctttggtctcttgctccatgtagcatctaaatttgacatacattgaagagaagactagctgtgagtttaaggtagacctcaagcaggacttcatcctgtaaatttcgtaagactatgagaaatttcattctgtcttaaaattactgtctagccttggagccatagaatccagcaaatcaatcatggagaaaactggctatgtgtttactgctcttgcagtttccaaattttcacaccactcttctgtgtgatccctacccagaatcagcaaatgcttcccaagtaagaacatagctagttcagcctgctctggaattttagttaatttaatccctcacttccacagctctctaatgcctttaaaaggattatatttgcaagtttttttttttctgggagtggtggggagtgcttattgtcattattacagtgagaatgagaatagggtttgccatgttatactgtattctacttataactacatatactcctacatatactctacctgtattaaaagtggagttcatttatcccagtgttgctgacatacacgatttccattagttcctgtgcctagatctctggagacttcttggttcttgctcttttaatgacctggttcttcaggctttcctttgattcccttttaaccttctattgtataccttaattgtgtggtaaaggaaaggaagagtttaagtggattcaaagtttgtcgtgttaaagtgaattaaatatggtctgagaaggactttgtactctatatttgagtcctagtggacgaactgtaacctaacttaataggtagacaagatcgaaaacctgacttaggagtatgcgcctgtaacaatagctgagtcttgcccaatcccagcagccatatttcaaccattcacacactgctgagcattcagactgtgttcaaataaggcaaatgctgagctgtaaccaatctagttgtttctgtacctcacttctgatttctgtatatcactcccccttttttgtctataaatcttcttccaccatgtggctgcactggagtctttctgaatctgctgtgattctgggtgctgctggattcgtgaatcgttcattgctcaattaaactcctttaaatttaatttggctgaagtttttattttaacagtaactgtcagtaatctttttcaatgactgatataatgaacctgttaggagaaagaccaggatgggatttaggtaggttgaacttgatgtgcttgctgaacctatccaaaagaaagttggaaagtgagtctagaactcaggaaaaaagcccaggtgagagagaaatatgactttgggaatcatgcacatagcagtgattgccagaaaatgtgtggcacaaagtaaaaatttctccatgcacttcagatgatccatagtttccctaaacactgtggacttgcagagaaggaagtgtgggaacagcatcaacatactcttacatacagggcctgcaagaatctcacgtggtaggaaaattcatttttcaaccactacacctgttctatgaatacagcaattggttatgtgtagagaagcatagcatcatatgtatttttacatactattgccattactaggttttattagggacagaaccttggtagaataaaagcacatttagaatataatgctactttcatcatcatttgttatattgtcttaatattcttcacacccaagacttgaatatatatatatatttacatggaagtaaagtttacatggaacaatgccaaggaaggggttttcaggcaacaaaagtattatatcagttgttctatttagaacactgtgttatagcattgttacctgttttttcttgtgtactgaaaagtataaccccacttaaactcaatatatgaaaatctaggtttacacagaagataaaaggtaaaatagtctttataaaatagcagactcttagtgaatttggattcaagatttaacaatccactttgcccatagtcttacaagttttttgtaaatctaggcctaccagtgtataggcacagtgaatggcttataatcctattcataggagagttgcagctcataatcataattttatgacacttttctcaaggtctcatgtggcaccctatcaactagatgttggattgcagtgggaaacaatgcaagaagagctgttagcttgtgcttttactcttagcatctcgattgtcctaacagtaacattagcagcaagcaggaacagcaagacaacaaaaacaacagctgttaatatgtgttactatgtatcaggtcacattctaagctttgtgtatgtatgaactcatttaatccctatagcagccctgtgagtaagtactcacattatccccattttgtagatgtagacagagaagtacagttaaatagcttgctgaaatgtatacaactgtgagtgatgaatgtggagttcatcttgcttcatattccacattcttaatcacgttggtatggtggctctaaaagtcactgctttttccacagaaaatgtgcaacaatccttttttgcctaacaccctttgcgtgttttgtatatgggtccagtagactagaccatagactataatgtacattctctttctaccagattcctttcttccccatttatcattaagcagacttagcaaggaaaattatcagcgataaagatgggtcattctgtagtgataaaggagtaatgaggacataacagtccttaacatgtatgcacataacaacaaagtgtgaaatacctgaggcaaaatatgtgagacaggagaaatagataaattcactattatagctagagacttcagcacctctcttacagtaattgaaagattaagcaggcagaaaatcagtaaagatatagctgatgtgaatagcattttcttcaatcagcttgacctaattgacatttacagaatactgttttcaacaatagcagaatacacatttaccattgaaaacctgtctgtcctgatggactctgatatttggattggggagtttcttgtaaaaggctgtcttgtcataatgaatagggaagtctgtgtatttggagttggctcagtggggagggatagagctgtagaaatttattcttatttatagtatcagctagaagtctatcatgtagagaaacatttcttttcccgttcatttcaagctttgcctgctccccacccacaacaaagatggttcagatggttcagtagaaactggttatgtggaatgtaaggtaagatcatgctttctcattaggagtcataatcactttcctcattcatattaatatattcatatataataccaaaatcaccaccaagaaaagaaaattagagtaaggtaactttcaatatttggaaaataatacatgtgcaagacttctggtgatagctatatgattttgaagagaaagtaaaattttttataaatcaaaaagtataaaccattaatattacaaataggagggaaattgcaaagcttagcgaaaggcactggatagattgtggcatacaaaagggggtccacgttggatgcagtggcacaagcctgtagtcctagctgctaggaaagctgaggcaagaggatcacttgagtccaggagttccaggctattgtacccaatgatcgtgcctgtgaatagccactgtactccagcctgggcaacacagtgagacccccatgtctaaaaaaaaaaaaaaaatagggcgtcaggtttagtgattcattcatttattcttttaattatttattttaggttcattagaactattagagaataaaatgcatctgattgtttatatcttgtctgttaaatggtatttagttatcttttgctgttcaacaaattaccaacctagtgctgtaaaacaacacaaacttactatcacacagtttctgtggattaggagttcttgcacagtttaggtggtgtctctgctttggggtccctcacaaaggtacaaaaggtgttgactgggtctgcagtttatttcaaggctcaattaaagaaggatacagttctaaaatcatgtggttgttggcagaattcacttccttgatattgtttggactaagggcctcagtttcttgctgtctgccagaggctgccctcagttcctttccaagtggacctctccagagggcagctcacaccatagcttgcttcatcaaaaccagcaaggaagagaatctgctagcaagataaagtttcagtctttttaaacacagtcatggaagatacattccatcatctttgcaatattctattgattagagcaaatcacaggtcccatttacacttggggaggcgattttccaaggtcttgaccaccagaagataaaaatcagtgggggcatcctacagtcaaccaccacagcagggatcatgtgtttttaacatgttttattgtgctcgataataacatcaaagttttcattgtgtaccaacactttacataaattatcttattcagaagttaagtgatttgcctcacaccacatagtaagtgctaaaaccagcaagagctcaaagagtctgactctaggtattatagaataatatatttttaattaaacatgaaaagctttaaatggtgcttcttgtctgttttaaaatgttctagaattgaggtgggtagcatttttacagcaataagaatgctaatctggttattaattgttaccacatgatttcagactaaacatttcaatcacagtgaacttcattgtttgtggcgcaatgtcttgcttcccttggttcctagtacaaagattaaaggggcaaataatgagcagattctgtgaaacatatcctctgaggaggaaccataagcatggcttgaaggcagggttgctgaacagatacttcatttatttcgttgatgttgcaggattaatattgtatactctttttgtggatgatggctttggttactggattccaaaggccagtattcttttctatgaaatgttttctaattcgtataaagcgaattctttttcctcttcattcctgtattttattttattttattattttatttattaatttattttattttatttcttataatagtctaggagtgcctctggacggctgtgtccaagggtataaatttgcaagtagtaaagaaatttaccattacttaaaaatcatttaccttcgttgtgaagttcctttcctctctctccctcctttcttccttccttttctttctctcttcttccaatttagagtgattacatatggcaagactttaaattattgtactcagggattattttgaacttgcctttaatttcatttatgtgtgactttttcctgtaattatatgtatacagtacatatgtaatctttcatacatgggcattaatttcatagctgtgagtacagaaaatcccattttgataggatatccaaataggatactttttggatagtctgaccttttgctcatttaatgacaagttggttacctctgttcacttagaaccaacctcccttcctccctcccttctttccttccttccttcttccttccttccttccttccttccttccttccttccttcctctttttttttttcccccacactcttgctctgtcccccagactggagtgcagcggcacattctctgcttactgcaacctccacctcccgggttcaagcaaatctcccacctcggcctcccgagtagctggaattacaggtgcgcgttgctgtggcctggctaatttttgtatttttagtaaagacgggtttttgccatgttggccaggctgatctcgaactcctggcttcaattgatctgcccgccttggcctccccaagtgctaagattacaagtgtgagccagaagcagatatttttgatgaatactttataattcagttttcaaaatatagataaaaatacaaatggaattagtcaacagttggccgcaagtaagtatagcttttatataaataatcacaactattcaaatgtaaattaaatttgactttctcctcactacaaatccttataatagctcacttgctgtgaatagttgtctgctttttttggtttgcttagctttaacaggggttgacaaactatggccgtgggacaagtctacctttctctgttttttgtttgtttgtttgtttctttttcaatggcttccaggctaagaatggttttacatttttaaatggttggatcaaaaacaaattcaaagcagaacatgtaagaggccatttgtagccacaaaacctacatagtttactctctgaccctttatagaaaaagttgactaacaaggtttgtgtgaaccaggatggtttcattattttcattattaagtcttgtcttttgtagtctctgaattgttaggcatgttacatgttgatatagacatgctctgaaataaaggtccaaatagtaatattattcttaggctcttgttttactgtacatcttttgtacttgtttccgtttttgtttttttttcccaagacagggtcttgctctgtctccaaggctggagtgtagtggtgcaatcatggctcactgcagcttcgatctgctgggctcaagcgatcctcctacttcagcctcccaagtagctgggaacacaggtgtgtgccatgatgcccagcttgctttttttttttttttttttttttttttttttttttttttttgagacagagtctagcttttgtcgccaggatggagtgtaatggcgcgatctcagctcactgcaacctccacctcccaggttcaagcgattctccttcctctgcctcctgagtagctgggattataggcacgcgtcgccatgcccagctaatttttgtacttttcatagagatggggtttttaccgtgttatctcctgacctcgtgatctgcccacctaggcctcccaaagtgctgggattacaggcatgagccaccacgcctggcctatgcccagctaattaaattttttttttgtagagatggggtctccctatgttgcccagggtggtctcgaactcctgggctctagcagtcctcctgcctcagccttccaaagtgctgggattacagatatgagccattgcgcctggtcttactataaatctttataagcttacattttacctcttatttcttcttgcttttattatatgttcagttattctaatgtgtttgtgtctctgcctcctaagaggcaccttgtatttagtgctgaagtggctcttaggtggaggagatctgatcggttatgcttagaaaggaacaatctagtgaaatgaaaggcctgggcttctcagatttggatttggatcccaagtcgaccacttactaacttagtgatcttaaaaaagtcgtgtaagggggctttttgatcttcagtttcttcactttaaaaatggcaataatatctattttgcaataagtttaaaatgagattaaaaaaatagaagatttttgtgtattagtaggtcctcaataaacagatttttagctgctaatggtagctgataatccaaaatgcatgattttacatagttttatagaactcagaatatgttttcattttttctaatgtaaaataattaacacaatggatgagataatttggaaaacttgcacattcttcagaatgattgctcaccctgagataaatcacttaacctctttgggtctaggatctacaattgtaggaaaagtagattggggtaggtgatcacattcaataaatgtatttattgaaacagaatagttaaatatatactaggttaaatagaagcatagaatgggctttatttctcataattcttctctcataactggacaatatgatttttaaaactgatgcttctaaatatgggaattataattgcccaccctgagctttatttagaatatagaaattttaattattcattatcactacccagacctctagggaagaacacaccattcttggagaaaggtgtcacatgaaaaaacatcttaaataactaaattgtaaaaatttaaactttgtatttgaatttttttctcccgtatataaatgctacataggcaaagtaaattttcattaaatattttatttaatataatgtatgaatagttgagctgagggacttgattaaacattctttatattttattcttttacccgactatactgagctgatgatgacttcaataacttcttgataattgaagataaataatagcaggaaatacagtcattgtggcatattgatttcagtatcacttgatttatagatgacacatctgctacaaagtctttagaaaaaaataccctgggctatttcttacgtttctttcaggcaaatttgtatttcagtatgaagatttattttgtttttgaaattgttatattgacgtcttttaattcatttagctcaagcttgtccaactcgcatgtggcccaggacagctttgaatgcagcccaacacaaattcgtaaactttcttaaaacgttatgagattttgttgcgatttgttttttaagcttatcagctattgttagtgtattttatgtgtggcccaagacaattcttcttcttctaatgtggcccagggaagccaaaagattggacacccctgatttagataacataatgaaataaaatggttgtttagtttggagatcagtattctaggcaaagctgtctgaaggagaacaaatataaatagatttcaatatatgtattagagctagcctgtgaattacaatggctacaaggaaatataatgtaaaatagcacactatgcttttcttgttattgttgcttgttcaaatagaatgaatttgattttaacatagtctttctgttcttttttaaaaaaatgtatgcaaaagctgttgcttggcgggggtattttacatcagaaatgcttaagagattgtaataaggttggtgaaaaactgaggtacatttaatgaatatggaatgctatatctgcaaataaagacaaaagggactttcaaaagtgtaatttaatgttaattctcagttttacttaatagcacttcagaaatattatctattttaccatttgttatgtgcagaagctaagagacttatttttctgcaggtcagtggcagaagaagaaataaaaatcttccaaagaattatgaagttgtatctgattttcagtgtactgccaacactgtcctcttttatacttttaagtttcccttccttttagaattaattcaggacagtatggtttattagcctatagataatgacagaatatccaattttatattacagttacttttggcatttgttttgtgtgatcagagatccccatgtaacagtattgaaaatggccacttgaatcattacatctttgttatatggatatatctgtataagcatatagagaccttgtttaatatttattgagattaaccataatgataggttagtgtcttataaataagtagaaatggcacattaaacacaagtttgctagattaggtaattgctgtatttcatgtgggtcatgggtctctgggaagaaaccacatactgtaagttaaaattaagtccccagtttatttgatcagtaatacaaaagcttattggacatggtaatgccatatggagtagaaatagatatagtatatctaaaaatagcttcctgtggtcctttagagtccccagtggggtcataaactgcctgtgcagttgtccacacaaggtaacatcttgccagatctaagctgatttcttgctatgccgtaatccttttatacctggagctgatgtcacctttctacaagaatatgcacaatttatgcacttccatttaaaggaatgtgtacaagcttctaggatctattagttcttaaaccaaacctgtgtcagtaataccctattctgatccttgagaagaaagcaaaagtcatttcaaggtatctcaataataaatacacctttggcttccctgcactatgggaagtgcatctcttcaaaatactgatagtgctatattttatatatatatatatatatagtcatgcattgcttaagggcgggattacattctgagaaatacgtcattaggtgatttttgtggctgtatgaacatcatagagtatacttacatcatagagtgtagtaggctagtgtgtactacatacctagggtatatgatataggctattgctcctaggctacaaacttgtacagcatgttgctgtactgaatactgtaggcagttgtaacatgatggttaagtatttgtgtaaacatatctaaacatagaaaaggtacagtaaaaatataatcttgtgggcctactgttatatatgcggtccattgttatgtggtgcatgactaaatatatatatatgtgtatataatactgtatataatacatatatatgtattttctatcttgtagaaaatacatgttatgtgtgcgtgtatataacacactatgtatacacagacacgcacatacaaacacacatggaagtttgttgaaaaccagcaagttggttgatcactcattattatttgattgtttttgataggtattggtagcttccaataactagaggtcagtgaaaaatataggcttcctcccccataattctgctaacatttaatatgttacagtgaagacaagactcaaaatggggaagttcatactctgtctttttaggtgttcctgcaatatcttatatgaaagattatcttgagaaagttgtgaccttattccaacaacaggatttgatcatccttctgttcaggcatcagataataatctgaatcagcccctagacacagtgtggattggaatctaagcctagagcatcattccaaagagtattggctactggatttactaaatacttacatattgttctcaaagttggtagtgcttctgtaatatttctaggtatttcacataagttaattttacccagcaaaatactatttctagagtccatttagcttacaataaacttgctggtttttataggaaataaagcttactgaacagcttgatattgctgctgcctttgggatgtaggtgtttgatgatgtaatagttaattaatcctgaagtgttaattcccagacctactgagtcataaactctggtgatgaggctcagtagtctgtattttaacaagctctcaatgtgcatctgatgcacactaaaatttgagaaccactgtcctaaagtacaataacattttgatatttaaattaccgacagagaaaattcataacagaataagaagactaacaatgagtcatctttgggattttattataaccagttagtctcaggtacctggtatttacccgtgaagtaaacatttattatatcttgtgtcctgttaagtatagcacataatgcattatgatgggactgaggttcagttcaaaaactattcagcaccttctatttattcattttaggatactgctgcttttgtaagacttaactcatttatacagccagagcttttagtcacagcaagagccttgaaagaagaatgtaaatagaatattgctatgcatgtttgtgtcaaaggatataaactgacacatgtaaattttaaatataatttactttatccattccagtcgtgtccagttaaaacctactggaatctttttttttcatagtttatccatgtatgatacgtgagtttgtatattttattattaatggatgtcaaccatttttaccttttttgttctacccataattttcttcctcgaatgatgccactattgccaaattagcaagaagatatttatgacttttctgttttctaagaggacttttgcatattcacatataaattgtggtttaagaaagatacacattgacattttgacagattttaattttcttaggcttggcaggatacaactactttgtctgttacatctggatgagaccattagaatcttgttgctataactgtaagtcatggtgttgaatttgcctttgcggtatagaaaatagagcagtgtacttgaatatactctgcagcatagagacatagcgtgaaaggagcataagtgtcacatgatgagttgagctagcattttcttcttccatccaattaaaataatatataaggtcatgaatatccagttatggttgtatatccatattctatttgtgatgaacacatgatttcttccattttaaatttatatattttttttcctggaagtgttatactattctgaaatattttgatataagaatatatttacttcattatttttagacaaatttataatgttggcgtttcgtgatctctgttcacctcattaatgtttactcttaatactttctaatttgcatcctaaacttaagcctttatgctgaacaacccactatgcttcatgtctgtgcctttacacattttactattttactgattcagccccatccccagctgtcctaagtatttttagtaagtgttggtggttctttaaaattcaacctaagcgtgtcttcttctgagaatcctttcttgacctcattcatctgaattaggtgccctttctatatgttcacccagcagccatggcctgctcctgtcattgtactctccacagtttgataacttttagtgcatttgtcttttagctgaatcttaagtgagtattttgatggaatggattatatcttattcatccttgtatcatagtgtttagaatctggcgtctttaataaagtgaattaaatgctcattgaatgaatgaatgaatgaatgagcccagttgatttggggaacattgtacctgattaaaaaatcattctttgtattctcaggagataacggtcatcttagacatgctgatctatgcctgttatatctttgatcccacttattacttagtccagtacctctggcatagtgaatgctgcatgaatggattggaattaagggctgtattttatataaatcataaacattttcttctgtagatttaattattttataattaaaacttaacatctttagatgccatctttttttagaaaaagattttattgatctgccttttaccactttgatcaaagtacaccttttgggtttcatggttttatttctttttcttttgtttttttctttttagacaagatctcactctgttacccaggctgagtgcagtggtgtaatcactagcatgctcactgcagcctcaaccacctgggctcaagtgatcctcttggttcagcctcccaagccagctgagaccacaggcacatgccatcaggcctggcaaatttttgggtttcattacatttgactttttgttgttgttgtccagccatagaattcttgtcaatattatatagtagtttcctctgaaattttgcattttcatgtcattgtgaaaggtattagagataatattttttgtaggtcaggccacaatcacagttatcactgtgataaaataaaaaaatgtacactgccattcataaccaacaggaagatctggtaaaactctgataagtaccttatgggctctaggcaacataagcgacatttaatttatttagattgctgaaaataataagcaaaaaaaaaaaagaatgctgagtcaaatgcaattaatttagcatctatagtaacttggttttagtgattttaatgattaattagaaagtgcatagaagctgtgaagctgtttgctcttcccaaccctatattttgatattaaggatctcatctttgttgtgtagaataggcaaatatttaggaagacagcaatttatttccattaaaatatccgaattagccagctaagagtctttgtttactttttttgtgagatggagtctcgctcattcacccaggctgaagtgcatgggtataatctcagctcactgcgagctctgcctctccggttcacaccattctcctgcctcagcttcccgagtagctgggactacaggcgcgtgctaccacgcctggctaattttttgtatttttagtagagatggggtttcaacagctaggaaggtctcaatctcctgaccttgtgatccgcccgcctctacctccacctcccaaagtgctgagattacaggtgggagccaccacgcccagccttttttttttttttttgagacagagtttcactcttgtcgcccaagctggagtgcagtggtgcgatcttggctcactgcaaactccgcctcccagattcaagcgattctcctgcctcagacccctgagtagctgggattataggcggccaccaccacacctagctaattttttgtatttttagtagagacggggtttcgccatgttggccaggctggtctcgaactcctgacctcaggtcatctgcccgcctcggcctcccaaagggctgggattacaagcatgagcctccgcgcccagtctgtttacttcttaacatcaaactttgaaactccttatttaaaagattaaagaaagtgaattactgtctatcactgttgctgtttgcttattagggatataaaaaatgggataaagatagaaatataatagatcaggtggtaacagaaggaagtagagaaattcaagagattgaagacatgtagattcagagtcaagttctaatattttaatgcatcttctgtgttaggatctaagtactttcacatatattacttgtaatttaatatcaagtgaaaattagtttgttttgccttaggttcttctttgtcatctttcagtacttaactccttagtttgtgtatgtttgtatttggcatccagtttgtaagacttcatccattcacgtagtccttcattcaggctttgtagtcagacagatctaatttatattctatattggctgtgacaatttcttaaaataagacaatagtacgtattgcattttggaaatatatataacctataattattttaacagatattcctaattgtttatacatttcttgattaaactaatttatttaaacagatctgtttcatttgcctcccaactcaactgttaggatgtttgctcctgcacgctttcatgggtttgcatttgccccctccccattttataattctctaacctacagaatgattgatttctatattatttatttattttaatttttaaattaagttttctttaaaggcagggtttcactctgctgtccaggctggaatgcagtggcatggacatggctcactgcagcctcctgggctcaagtgctcctcccacctcagcctcccaagcagctggaggacaggcattgagccaccatggctggctaatttttaaattttttgtacaggcaggatcttgccatgttgctcaggctggtctcaaagtgctagtctcaagcagtcctcccaacgtggcctcccagagttttgggattacaggtgtgagtcactgcacccagctggaatgattgatttgaaatgatagccagtgtaaagttctgtctatataaataatatgaaatgacaggaagtaacataaacatgtacttctaaaagtatggatattttaagctgtttgttcttttgatgcaactatgattacttgtgttttaaaatatacttttagacaaggaataaaaaaagtaaatataaatgctttttcataaattgttaaacaacagtgaagattggaaattggtgggcatgtctaattagcgtagtttccttcggaaatattggcgtttgatttcctcaaagctgacacaactcagcatgtggaagtcaggctgccttgccccagaaggaaacttgctgcatggtgccttgtaacataattactgaaacagtaagcaaagtagtagaaatagcaagggatggaaacagttcctaaaaattaaatattgagactgaagaaagacttgacataatcagagagaatatggacaagcaagagattaaaacatagagaaggaaatagatatggataaccagtaaagatctagcattaaaataattgcatagagaatagaaaatatggaagagaaaaattattcaaaataataaagacactttccctgaaaaggagaaacacatcctcaggtcaaaatgatattttgggtcctgtgaattttgattgcttgacatatctaggttaaatgataaaaccgatatttctccaggtatccagaaagaagaatatatcatttcaaagagggggaaatcaggctcttgctaaatttcttcctaggaacagtcagtgctggagatgaatgtagcaatctttttacatttctgaaataaagaaaatgtgatctaggaatgcagttcttagctaagacaccagccaagtatagattcaataggcaggcattcccaaataccctcagtctctcttgaaaaatatatcatttaattagggtattgagccatttaaaagataaattgataaaattggcagtaacatcatttaatatgaaatgctagacatttatgtaagttatgattttggaatctaatgtatttgatataaagtttaaccgtgaagaatagcatgccaacaaaatttggagttggaagtattttcatgtttctgttaataacatctaaaatttaaaatataaagacattagtccagtatattaatgtttttgacagttttttaaccttagatctttttaaaaatatccatttgaaattgaggaactcatgcattttcactgaatttgtgcttctatcaaataaaagtaaaattaaatgtactatattttaaaaggacaaataatttcctctaattttgtaaaagctttttaacctattttgacatatttgaggggttttcccccctacacgttttcatctctgtaattcttttaaagagtatgtgctgggcgctgtggctcacgcctgtaatcccagcactttgggaggccgaggcgggtggatcacgaggtcaggagatcgagaccatcctggctaacacggtgaaaccccatctctattaaaaatacaaaaaagtcagccgggcatggtggcagatgcctgtagtcccagctactcgggatgctgaggcaggggaatggtgtgaacccgggaggcggagcttgcaatgagctgaaatcgtgccactgcactccagcctgggcgacagagcgagactctgtctcaaaaaaaaaaaaaacaaaaaaaactaatttttacaaaaataggaaatatttgtatatttaggaaaacgttattcactgcaaaagaatttttatgtattcaggaaatagttatgatcctcacagatgagaaaaagtgaagttcagaaatgatatgacttaagtcaaatatttagttaattttataagcaggccaatagtccaagtcttttgaatctttggtaactgatctgttactgcgttacacaagtgataatatttaggaattaatatatttctagagcagtgccatatgtagccacagtgtgtcacaaagagaacaaatagtatgtgtgtgtataggctgaaaaattttaccaagacaaacgtctgtatagtacctgtgctattaatattttatgaataaaattatattgtctaggtaacttttaggcataaagatggcaacacagtggatctgtgagattcaggacactgaatctaaaagtccacttggactattaaaatattgctaaatatgaatatttctggggcttagagttgcacaattactttgaatgtatgcatgcctgattttataaaggcaaatgcatccatgtattagttgtgtggttggtagtcagtctgaattaatgacaaatgtgaattctgtaacatttgatgataaatacagctttattgctttcaggttcatgtaaaccaaagtaaatctttactgtttccaagttgacagcccactgaatctgatataattaatagatgatggtaattggtaaatagtgccatccatttttactgataattaatgtattcacttgtgttctgaagaaatttgtttttaaaacactgccaccaacctttaccccagcaaatatttacagaatttacttttaaaacaaacattattttagagtttaagaaaactgacactacctactgttctagcttaattttccactactcctccttccaccttaacctcccttttcatcttcatttcctgttctcccctgtaccctatgctctagccatataaaataagttcatttttactgaatgtggcatgctctttcacacttcttttcctttgcacatgctcttccttctgtttgaaatgtcttttccttcatcccccaacagacttttccttgacatggttcactatggctatccttttaaagttcttaattataccaggcattatttatctcttcttgctatggtctaaactctcataccaaattatcgctgttattacatgtgctgcaatttgtaatttgtgtctgacttttccacaaattatgaatctgacatttccagattgtaaaatatttgaggatagtggctgtgtttgtttcatgtttgtgtgcttaagtacttggcatgtaacaagtacttggcaattttttaaaaatgagttgtgactcttagtcctgcagagatcatattactgtggtcccctttatccatggttttgctttctgcagtttcagtatacacagtcaactgtggtctgaaaataagatattttgagagagagagaatgcaagagaaagaccacattcacctaacatttattacattatcttgttataattgttctattttattattattcttgttaatctcttagctgtgcctaatttataaagtaaacgttataataagtatatatgtctaggagaaaacagtgtatataggatttagtactatctgcaattcaggcatccactaggggtcttggaacagtatccccacaaataagagggaactactatgtcacattttccttttctttctcagcccctttatttcgctcctttttcttgtcgctctcaatctcttttactttcctcctctttcccctactccctccttttcaactttgttcttttcttcagtgttacacaaaagacagacatttttagaagtgtttgccaggaaaagagtgttataaaatccaccaatgggtactgcttctttgtttttacatgtaatctaggtagatttatttatgatgaaatatttagaaaaggaatcctgatttcagtagaaacttctcttttaaatgtcaaaatctacaatagcattatttaatgaaactcacatagaagaaataaaggatcatgggcctatgtaaacttgaaaataagaacttggcatagagacttagaattctatagagaacaccatggcacttcccagacctttgctttgatattcaccctttgcttgtcaagggccttgccttaaatcttttttttttttttttttttgagatggaatctcgctctgtcgcccaggctggagtgcagtggcgcaatttcagctaactgcaagctctgcctcccgggttcacaccattctcctgcctcagcctcccgagtagctgggactacaggcgcccgccaccacgcctggctaacttttttgtatttttagtagagacggggtttcaccgtgttagccaggatggtctcgatctcctgacctcgtgatctgcccgcctcggcctcccaaagtgctgggattacaggcctgagccaccatgcccagcttgtcttaaatgttttgactcagactggttcaacttcactcactcagtttaaagacctctcttctcatttctttctcttcacagtaataaacttactttaattaaatttttgacacaacaagagattttcattttttaaaagatgatgcatagacatggtaaaccatccaaagagtacaaaaggggtatacattggcatgatatttctgccacaaacccaacccctcagtttctctttctagaggtaacatcttctattagtttcttctgcttcctttcaaagatatcctccctatcttaggggaaagaaacagaaagatacgacataccaatgggtaacaccatctgttggagtaatttcctagcattttttttgttgagagctctgattacttgattttgtccttataagttaacattttttttcttcataaccttgcacaaaataagaatcatttgatgaccatgagttcatggcagaaaattgagtattttaataaccgtttgaaacaggaaaagcattgattggttctcagtctttggaattagaaactttgcaatgagtatgttttcacccagcatatccagttcatttatcacatggtataaaaagaaactcacatggaaggggatgagtttatgctgaaatccaaacatcttgacttaacctgcagaattgtttttatgtctttgcatcatggagtcaaagaataggtaccattggaaaaatcccttaagatgtctctctgtttctcctcttgaccaaactgggggggaataataataatgaaaaaggtttaattgcctagatgggagcctggtagaacccaatgtgtcattcatctgttacctaaatgtggattagtatctggaatacattaggtaagaatcacaatatagggtaattctcacctccatagaaaataaagggttctaaaacactaccacataacttaagggttcagtaactcagagaaatcctgcataaacgattgtttttctagtctcctggtatttgttggaaataggtttcatacttcaaggtgatacatgtctaagggcaaaggatagtagtattctttcaccttctggcactccatctccctggataaaattctccatggggaaaataggtggtggtatttctgtactttgggaattttagacatttgtcatttcattgttggggaaaaacaacatttctggttttgacttggcaaaatgttatggccttcagtttgtgttcttttacctatagtttatttgaaaaatacacatacacacataaaacatacatttttctacagtaatggaagaaaacagaaactactttgtcgacattttggaaacaaagcctagaagtatttgtgcaaaaggttaattcctccttcacacaaagaatagtgtgaatacatttaagttatttaaatgaatgtgaagttagtttaaaatttttccattttaatatggagaaactcggatttacttttggagttggtattaatggtctatatgggtttctcttggcctatcacttgtcattgttttcaataaaaggcaaaaagcagttgttcaggtttagactgaagtatttaagaacatgaaaggggcatgagattctacttctgaaagcttatgatacattatatctttgaaattcaactcccttgttctgacaagtatgttacacatcagccaggcagcaagataatatacaagaaaaatccaagtctttctttgaaaggattaaccttcagttggtaacttacctccctggggttttgtgtagcttaattagcattggcaaagcagcttgatactgttggatgaaaggcaggtaagttattagaggtaagatagagttatgattgtgattttgcaaacagataatcatttttttcattggtgacatgaggggaagctgaggaggatctttatcttgggtcttaatctcaggtagtatagtttgaagctagaatgctttatgaaggagctccatgtttaatatctcagctgaaaattagttgttgcctttctcttaaagtattgtggcatgtaaaccaagagaaatgtgcactattgaagcattgaagcaggctttttttttttttttggtgtatgtcatatataatctagtaacagcatactttacttatgtgattaacaccacaggcaagtcacatactgtaacaatttgcatgagttggttgtaactaaaaaacatgtaaactctattgcaagatacttaaaaaaaactgggaataaacaaaaggacattgcttctagatctcacctagttcttcagaaagtttcttattaactgagggattaattatgaagatttttctgcgactttgcatatgcagctgtatatacaattgtttttttgtcagcttcatttttaaaacaggcactaaatccctttggatatatatgagagctttcactttggttttgtgttataattgttcctctggtgtaaagtagttcatgaaaaaatggttgagtgcgacttgaaataaagtatatttaaattctagacaaaagaatgactagatttgagtggtgggggagaactgacctattatctattttttttccttcattcaagcataagtggcttcctatagaggaattaattgtgttctctcagagaatacctaagtggtgaggtctgcttgctagctagctagctacctacgtacctacctaccttcctatctatctgtattagatagatagatatattaaaggagctgttcaaacttcagcctttggtggaaggcaaaagaagactctaccagaggacctgatactaagcttacatttaagggattttattcttttgagtaaatagcctagttctgtctaatgatactaaaagatatttcattctgagtaggacagtttatcttctagaacatccttagaagttttcatgcatattcaatctccttttcccctttaaataatccctattgatctgcagtctgttgagttattgaaactttatttgaacctgaatgtgttgtcagcattgggaacaatgcatctcatgtatttctgtcttttgtggaagatactcctctcttctacttgttgggaaactagtatcttgagtcattctttaatgcatctttcattcaatagacatttcttggacactcactatatgtcagcatctgggctggaccaaggcatgttctatacatggtattggtatggttttggtaatctggtaatttcttttgcattttcttcacatcctctgagatcatgtaatgtatccagtttaatttctttctataatactagtctttaggcaattggtcagtccttctaggctctaatgatgtttataatccccaacataattctataggatttccagtgtaatcctagattattgattttaccttattttctgaattatttccttgaatcactgtaaaacataatcacttgcacctcactccttttttgaatctttatgtgtcaatacttgtatgccttttacttaaagtgataaagagtagtttaatagttgtaataaagaataatataacttaaatgaatattaaagttaagaggggaatctactgcattcattttgaaataggaaaaattgcaatagcaatcaaaccagattttcttttgttcttgaaatgttcaaaatttgtcatgaacattatagattctgtgtttcatagtgtatagatacagattaatattgtctgtagaatacccatgtaagggaatgtgatattaatacagaaattaaaatagccgtaaaatgatgagcttctctaaggtgcgctcttcttttttcttttcttttctttttttttttgagacagagttttgttctttttgcccaggctggagtgcaatggcactatctcggctcaccacaacctctgcctcctgggttcaagagattctcctgcctcagccttcccgagtagctgggattacaggcatgcgcctccacacccagctaattttgtatttttaatagagatggggtttctccatgttggtcaagctggtcttgaactcccaacctcaggtgatccacctgccttggcctcccaaagtgctgggattacaggcatgcaccaccacacctggctaattttgtatttttagtagagatgggattttgccctgttggtcaggctggtctcaaactcctgacctcaggtgatctgcccaccttggcctcccaaagtgctgggattacaggcatgagccactgctcccggcctaagatgtgctttctaacaaatttcacagtgccagatttgacttttagtaaatctgcattaaaactagtcagaaaataattagtgaaaaactgatgcaggatattttcttgacccctttgtggggtgtatgacaggggtgcctcgtttactcagcctgccccgcttaaccccttgtgggagggagagagtgtgcaaacgagtacaggaacccaactgcaggaactggccaggggcccggcagtttacttgggtaaacttactatttactttggtctgcctggctccacccctcgcaggagggagcatgcaagtgagtgagtgcagggactgccagctgcttcagcgatgacaggagtaaactcccttcaggccctgtggcagcatccaggtaggggtttctacgaccccaaggccccagggggtatgttgcaatgctgtcttagctccattgtctgcagacatcagtgtgttatcagctcagtgtgtcctttgcctcattgcattgggtggctgccctctgccagtgagggcagagggccagtatgacagactttttgggtaccggcatgtggtacatcccaaattcttgtctggtgcccaagagaaatgaggtcatgcagatgaactgaaggatggtgaatatagagaattttattgagtcgtgaaagcagttctcagtggagaggggagcgagaaagggagcgggaagggcaggttgctctcccctgaagtcaagccacctctctgcctctctcttctgaagtcaagttgcctcatccagccggtgtctctgaagttaagtcctctctctttgatatccagccacttctctcctctgccggctgagtctggggtctttataggcacagaatgggggttgggacgggccataggtagttttggaaaaggcagcattcgattggtaaaaagatattattgagaaacaaccaattgggagagagcgggcacacagggatggaagttttcactttgggccaccgatttcagacttttccactcgaagttgggattttgccagtgacttgcccctgtctgcctagagtgtctctgcctcctctgcctcctgttgctgtcaaaaccactttcaaatgtgtattcttaaagtttcatcttatgcattagaatatttaatctttgataatggcatttatctggcaccttatatttactgtatttattaattattgattcctgagtctcctgaaagtgtctggatatggttaatatgagaggatgtaataatcagaatgccgttaactagcataatttcaaaaatattttcttgaaccctgttgtgtctatttgactattttaatatgaactaaaaatgttagcatttcttatttgaggtgaaattataaagaaaatttgtttccagggtttacttcatcctccttaaaagtaaagtattttgtttcctcactctcatgttatatacctcagtctggattagaactaaaaccacttacttgattttgagaagaaagttcacttcgaattaagtagaattgacatatattccttatattctttatcaaataacttgacgatttatcttctacaccattctcttttttttttttttttttttttttgagacggagtctctctctgtcacccaggctggagtgcagtggtgggatctcggctcactgcaagctccgcctcccgggttcatgctgttctcctgcctcagcctccagagtagctggtattacaggcacccgccaccacccctggctaatttttttgtatttttagtagagacggggtttcaccgtgttagccaggatggtctcaatctcctgaccttgtgatctgcccacctcagcttcccaaagtgctgggattacaggcgtgagccaccacgcgcggcccacaccatcctcttatattatttctagcctaaaacattctgctgtggctgataaacagttactatgactacctttgtttttgaaagtatcaggataaatagtatcacctgggctaggaaatataaatttatctaataacagtagaaatgaagtttgtagaatgacctgacaaactggtaatctggattctaaaacctttggcagtagaattgaagattaatttttgtcctcttcaggctctgtggggtttttttacccttttggaatgattattttaactgggttagagaaagtatacacagagatgaacacatgcacatacatatgcaaaatgaaaagttgtaattttgatgtgttttgattttaaatatagatttgctataataaaaactacatctttttatttggatgtgagtgtgtatagtttgaagattaaacatacttattaatcattgctttgacagcagcaatattcacttagaactcttgatattatcatataattttatagtattctttccaaaattgttaattcatttatagcagttatccaaaccattgttctgtaggaggactgtcttcctttcttacatgatcagctattttaatgttactgaagtttttaagagccatctttctttcattcttcaggtttttgaaggagatgatggtatggatttgcagaatagttaggggagttacttattttttagataattttcaaccaatacctttagggtagcataagaagaaaccaaatatacaaatatccaacctcaagaatatcaactacagaattctttgatgatataacacttttttttttaaatgaaatcatagtttaaaatgcatggttgttttctctcataggacttgctatattctagtcttttgagttttccaagcatggtctatctaaacacttactgtgatatgtagaattttcttaaattttctctagactgtagacatcctagttagctcagcagcataattcgtaagaggaagctgttatcatattccttataatccttttaaaatttgagggctataccataaaattgtttaccagtaatctgtgctgttccacaatagaacacaataaataattttgataggtaacatttattgagcccctactgttttggaacatttagtcctcaaaataagtctttatggtactattgttattttcatagtacagataaggaaacagagcttagaaaggttaaataacttgcccagagtcacacagctaggaaaagttaagagtcacacggtaagactcttactaaagtctgtcttcctgtaaaaactatagtttaaatctctatattatttttctggataatgcagctaaccagcattttaaaaggcgctgatttgaatgagcttttcagtgatggtggtggattaatctgatttatccacactatcaggccgggtgcgatggctcacgcctgtaatcccagcactttgggaggccgaggcgggtggatcacgaggtcaggagatcgagaccatcctggctagtgaaaccccgtctctactaaaaatacaaaaaattagccgggcatggtggtgggcacctgtagtcctagctactcgggaggctgaggcaggagaatggtgtgaacccgggaggcggagtttgcagtgagccgagatcgcaccactgcactccagcctgggcgatagagcgagactctgtctaaaaaaaaaaaaaacataaataaaagaagaagaatggtgcatatcacagaatggcttgtcttggagtaaagtccatgatagtgtaacagaatttttttttggaggcttggaaactctaaacatctgttatacaacattgaggacagtagctctagtagcactgactaatatggacaactaaatcagtttaacattgagccaggtatttgtgactcaggccatctcacagtgaatttgttcttaatatgttttaatttaagctgttggccaggcgtggtggctcatgcctgtaatcccagcactttgggaggctgaggcgagaggattgcttgagcgcaggagttggaaaccagtctgggctacatagtgagaccttgtctctacagaaaataaaaaatacaattagctgggcatggtggcgtacacatgtagttcccagctactctggaagctgaggtaagaggacagcttgagcccaggaagtcaaggctacacagtaagctgtatttgcaccagcgtgggcaacggaaagagaccctgtctcaaaaattttattattctattatgtaacagtcatacagtttggctgtatttactaaaaaaaaattttttttttccgagacgggagtcttgctctgttgcccgggctggagtgtagtggcgtgatctcagctcactgcaacctctgccacccaggttcaagtgattctcctgcctcagcctcccaagtagctgggattacagatgcacgccaccacccccagctaagttttgtgtttttaatagagacggggtttcgccatattggccaggctggtctcgaactcctgaccttgtgatccacccgcctcggcctcccaaagtgctaggattgcaggcgtgagccactgcgcctggccacagtttttttattctgttaaataatagtgatgtggtttggctctatttactatgtatacatctatttactaatttagctttgagtgttttttgatagagatctttttctcatttctccagttcaacttcattttaattactgaattatggaggaaaataatgtgttttcatagtagtataattactattccaaaggctgaaatattattggaagatatattttatttagaagttaagtaaaaatttacaaatactttgatggttcttggaacatattttttttcccctgaggtcgagtctctgtctgttgccaggctggagtgcagtggcacaatcttggctcagtgcaacctctgtctctggggttcaagcgattcccctgcctcaccctcctcagtagctgggactacaggcatgcaccaccacgcctggctaattttttgtattttagtaaagatggggtttcaccacgtcagccaggatggtctcgatctcctgacctcgtgatctgcccaccttggcctcccaaagtgctgggattacaggtgtgagtcaccacgcctggcccagaacattttttaataagtctctgaacataaaatttaatttctgcctgagccttgtttcctaccttataaatgagaaataagcaaacacagactcagtcatcagctttaaagtaaacaaaaaaaatattttcagaatatggtatcagtatcaggcatataaataagataatcatttttctgaaaagaaagaggagaaaactaaaactcattgagcattaccatgtttccccccatctccctatacttctaacagtggttcacctcttcttcatctttattgtaaagcatttcttaaaaattgaagaagtgcttgaaaggaggcaaaagttcctttttgaaaattgatttatttcttggtttggttatgagtatttttagaaatattttaaattcttactcatgctagggaatggctggtacaggatgataggcaagctgctttagtttggacctatgtcatataaaggccttacagctctgtttcaggaagcccatacttagattccaggatacattcctgggccagacatctagagatactctttggtatgcaaggtttacaagtccgttttcaacattttgtcctaagtgttctgcttcacttcataaactagtaattgcagtgttattatcatttaccctacctttgaaccttatatttaaaagacttacagtagtgtgaattggcacataaccaaggtctttccatttcttaataaagccattaactactttctttatttggaaaaagagatttacaataatcgttaattttattaggtctgcttaatacatatgctctaacaaaaattcagtaatctgctgtaaatccagtgccataagatattttcaccaaagattcttgctcttttgagtacatgaagaaaattaaatgttactgttgagagaaatgtcattgtagtctagaaaattttttcagaaaaccgatagattttaatagtagagtaacttgataaacaggattagtattgtacactttagccaagtaaacgtagaataatgtgtctaaattccccacaacaatccatttctttctttaaagatactcatctcttaatgcaaaacctgtttgtaaaagatgtgtcaattggattttccatttacttgtatttcagtttacaaatgctctattttcacttcactgattactttagctggttatatgacagagctttgttattttgtcctgcctttaccacttcatacttctttttcctcctagctctaagtagtcagtgatttgtttgtgttacttcatttatgcaaaaaatattaatgaagcaactactatgtgtcgtgagaatgtgtcatgtgctaggtatagaatagtgccctcacagatttgaatgtagcgggatagagtgacaaataagcgcttacattaaataagtggttatagaaacaacttacatttaaatatcagtaggggatgggttaagagatgatgatgtctccatgggatgaatattttgcagctgttaaaatatataaaacatttgtaaaaaatatgcataagacgatatttgtagtaacatgggtttcatggggactagacttgttattatgtataatcttgtaccttaaaaaatttattcacatattttcagctaaactctaataagatttaaagaaaatttgcagcatatggaatgagcaaataagtaagcaattacatttccatttaaaaaatctggagataaaacattgaattattaatcactcattgccctgatttgtacattttctccaaattgccttcttttaacacatttgaagtgagcacagacaactattcgttctacattgttctgttgttggctgctggatgatgcaacagtagtctagtatacacttgtcaaagtaaatatggacacggatttccttggagaattgagccagaaacctttttaatgttgatatcatagtatcttagagctgaatttagatacagattatcatatgtgattattctgttaaaactgagattgtcgcttgtcccttttaccccttcttggtttgtgtgtgagtctgaaagttatagtaaattttgaaaattataaataaataaattcacacttttgcacattaggtaaaatggatatgtatagtcattagaagctgtttatttgaataaagtgatattttctttcaatagtggaactggcttctccatgtatcgaatttgacaaactcttataaagcttgacatttgaataaatacaattatttgttgtgcttttgctgggaatatttcagtcctatgggtgaccacttaaaattccaaccaaaacaaacaaaactgcatatctataatttactgagtataactctacctttcagccatattagtttatatttagaagtggtccgaattatgttaatcttagtagtttgttgatataatgccactattacagattttctttatagattgtttaaaaaattttttcttattatcatgtgaaacaaaatgatgttattttagcagctgaactactatgtaaccatgactaaaaatttagtaggtgataggcaacggtgttggttaatttcttctgaataaaagacatgctatataatatttttacagtaatattctaatagtgtattactatatgatgccagaagatcagaatcaaatatcattaatgatgagcaactacttattttttatctaattttattaacgcgtttctgctgttaaagagtacttcaaatatatatgtaaagctcagaaaataatataaccccatgtatttcactcagattgaacaagtattgatattttgccatatttgcttcagattgctagaataaaatacagatgtaaccttttttttatcttttgaagttttgatggtttttaaaaaaattttttttatatccgtaagtttttggaggacaggtggtattccgttatataagttcttcagtggtgatttgtgagattttgatacactcatcacccgagcagtatacgctgaacccaatttgtagtgttttatccctcacctccttcccaccatttcccccgagtccccaaagtccgtcgtatccttcctatgcctttgtatcctcatagcttagctcccacttatgagtgagaacataggatgtttggttttccatttctgagttacttcacttaggataatagtctccagttccatctaggatgctgcaaatgccattaaattcattcattttcatggccgagtagcgttccatctctcacacacacacacacacacacacacacacacacacacacacacacacacacacacacacagtttctttatccactcattgattgatgggcatttggttccacatttttgcaattgcgaattgtgctgctataaacatgcatgtgcaagtatctttttcgtataatgacttcttttcctctgagtaaataaccagtagtgggattgctggatcaaatggtagttctatttttagttctttaaggaatctccacactgttttccatagtggctgtactagtttacattcccaccagcattgtagaagtgttccttgatcaccacatccacgccaacatctattattttttgagtttttgacaatggccattcttgtgggagtaaggtggtatcacattgtggttttgatttgcatatccctgattattagtgatgttgaccatttcttcatatgtcttttggacatttgtgtatcttcttttgagaattgtcttattcatgtccttagcccactttttgatgcgattgttttttccttgctgtggattctgtatattagtcctttgtcagattcatagtttgcagagatttttttcccactctgtgggttgtgtttattctgctgactgttccttttgctgtgcaaaagctctttagtttaattaagtcccacctgtttgtttttgttacgtttgcttttgaagtcttcgcctaagccaatgtctagaaggattttttccgatgttattttctagatttttttatagtttcaggtcttagatttaagtccttgatccatcttgagttgatttttgtgtaaggtgagagatgaggttttattctgctacatgtggcttgccagttatcctggcatcatttgttgcataggatgtcctttccccactttatgtttttgtttgctttgtcgaagatcagttggctgtaagtatttgggtttttttctgggttctctattctgttcagttggtctttgtggctatttttataccactaccacactgtttcggtgacttacggccgtatagtatggtttgaaatcaggtagtgtgatgcctccagatttgttctttttgctcagtcttggctttggctttgtgggctcttttttggttccatgtgaattttagaattgtttttttctaattctgtaaagaatgatggcggtattttgatggggattgcattgaatttgtagatttggcggtatggcaattttcacaatgaccataagctcattttctaattgagcttctttggatcttctctcttcttttcttggttaatcttgctaatgctctatcaattttatttatcttttcaaaagaacaaaaatacactaaaaaaaaatccaaggtatacaggcaacagataggacgatgaatggaatagtacctcacatcttaatgttaatattgaatgtaagtggtctaagtgctccacttaaaaggtacagaattgcagaatggattcgaattcacaaaccaagcatctgctgccttcacctaaaacataaggattgacataaacttaaggtacaggggtggaaaaagacatttcatgcaaatggacacccaaagcgagcaggagtagctattcttacatcagacaaaacaaaaaacaacagcaactaaaaaagacaaaaggccttgtccaacaaggccttttacaatcctaaacatatacaaggccttgtaacaatcctaaacatatacacacctaacactagcgctcccaaatttataaaacaattactaccaaacctaagtaatgagatagacagcaacaaaataagtaataataataactccactgacagcactagacaggtcatcaagacagaaagtcaacaaagaaacaatggatttaaactctaccctggaacaaatgaacttaacagatatttatagaacattctacccagcaaccacagagtatacattctattcatcagcgcatggaactttctccaaggtagaccatttgataggccacaaaacaagtctcaataaatttaagaaaactgaaattatatcaagtactctcttagaccacagtgggataaaactggaaatcaactccaaaggaacctttaaaaccatgcaaatatatggaaattaaataacctgctcctgaatgatcattgggtcaacaatgaaatcaaacggaaactaaaaaattcctcaaactgaacaataatagtgatacagcctatcaaaacctctgggatacagcaaaggcagtgcaaagaggaaagttcttagccttaaatgcctacatcaaaaagtctgaaagagcacaagtagacaatctaaggtcacacctcaaggaactagagaaacaagaacaagaacaaaccagacccaaacccaacagaagaaaggaaatgaccaagattagagcagaactaaatgaaattgaaacaaaaacaatacaaaagataaatgaagtatatataacttcttaatcccactttccttcctcactttccagaggaatttttattctgagtgttgtgcatacctcctgtccacatttttattcttatattatgtaaataagtgtgcatgaaagcatgtttttatatctttttaaaatttgtaagaatgtatcatcctacatatatgtatgttttgcaacttttttcactcaacattgtgaaattcatgtaagattattcatgattgatacttgtaggtatactttgttcattttaactgtagattaaattaccatatatgaataaccacaatttactatttattctctattaatggacatctagtgtctccttgtggacatgtgctaaaatttctttagggtaatcttagaaggatacattctcagtcttattatatgtgcattttcaactttggagcaattcagcaatattttctaaacaaattattctaatattacgttcctacctttaatgtatatgggctacctttaatgtatgttacgggcttaattgcttcccccacccatccagattcatatgttgaagccctaaaccccagtccctcagatgtgattgtatttggagatagtccctttaaagagatgattaagttaaaaccaggtcattaaggtggaccctaatccaatgtgatggtgtccttataagaaggggtaatttgggcaaacaaaagaggggaggcttgcagacagaggaaagacatgttgaggatacagttgagaagaggcagacttctgcaacccaatgagtgagtcctcagaagaaaccaaacctgctgatgccttaatcatggacttctagcctccagaactgtgataaaataaatttctgttgtttaagccacccattttatggtattctgttatggcagcccttaaaaacaaattaatatgtgagatttccagtttctctgcatccttatctcactcagtatcacactttttaattgtcgccattttaatagaggagagagtatctctgtttcaatttaaatatcctggttaccaaaaatgctgatcatttctcaggattactgatgaatgaagtcctcttctatgaactgctagttcatatactttgtacatttttctattacattgccttgcctttttcttacagatttgaaggagttctttataaaatctatataataatcctacattaattatatattttccattctcttctctccacctgtgacttgtctattaattttattgcacaaaaattgttagtttttttttttttttttgagatggagtctcgctctgtcgcccaggctggagtgcagtggtgcgatctcagcttactgcaacctccgcctcccaggttcaagtgattctcctgcctcagcctcccgagtagttgggactacaggcgcctgccaccaaccctggctaatttttttttttgtatttttagtagagacggggtttcactgtgttagccaagatggtctcgatctcttgacctcatgatccacctgcctcagcctcccgaagtgctgggattacaggcataagccactgtgccctgcccaaaaatttttaagttttaaggcagtcagatttattagtctttctttttatggtttgggcttttaaaaaaaaatcttatttaagaaattcttttctctcccaagatcatgaagaatgcaaaatttcttctaaaatttttaagttttgtttgtaagattgtttgaattttctgtgaaaccatctcttattgaattatttttcctttccatattaatttagaatgatacctgtgtcatatgctaagatctctttctaggtgctttattctgttccattagtcttatctggctttgtgccaatactacactgtttccattagtaaaactttgttttgttttctgatggggggaaatcctattttttttcttattttgcaaaatgaactagcttattttggagattttgctttttcataagtattttaggatcactttgctaaatttaattaaaaaatccttttggaatttttattagaattgtatttaatttatagatcaatttgggaaacaactacttcttcagaaaatttataattttttaatgtatgaggtatgttgctgtttgttagatttattccttgaaagattatgattctgctgttactgttgtaaatgtgatattttaaaaaacacatttagtaatttgtggttgttgttgtatagagactttaatttctgtacattgatattgtatatagtgatgtccctgaactttattagtacgatttgtagattatcttggattttctgtattaaagtttatattatctgaataacatttgtttcttcattttctacacttgtaagtcttacttctttatcttattacctcagctaaggccttcagtacagtgatgaatagaagcatagatggcaggcctgtcttctattgttcttagatttaaaaggaatgctactgatgagttgatccatagaatgtgatatttattatgaatttctaatattccttactgaattaaagagtttaccttccattcattctttcttgttaaggtgtttataatgaataagtattaaattttatctaatgattttttgtttccattgagattgtaattttattttgttttaatttgttaatgtaatcaatttaaattaatagtttttctaatcgtaaaccaatgtagtattcttaggataaagttgagatagtcatgtatttttaaatatattgctgtatttactaatggatcatttgggagtttgaaaataagcttatatttgaattagtctttaatttctttgttatccttgtctacttctatatcaatcttatactaatctcaggaatggaattttagaatttcctctctttttatatttcctagattttgattcgatgttttatgaatatttgtaaaactcatataaaaatgctagaacctggccaggcacggtagctcatgcctgtaatcccagcactttgggaggctgaagtgggcagatcatgaggtcaggagatcgagaccattactggccaacatggtgaaaccccgtctctacgaaaaatacaaaaaaattagctgggtgtggcggcgcatgcctgtaatcccagctacttgggaagctgaggcaggagaatcacttgaacccgggaggcagaggttgcagtgagccgagattgtgccactgcactccagcctggcaacaaagctagactccgtctcaaaaaaaaaaaaaaaaaaatgcttgaatctaaagtttcaaaaaattcaatagatttttgaccactgaaaatttttatatattattgagttcattttgtagtttaattcctctagaaagtatgttttttatgtttttaaagcaagtgcctgaaaatatagtaatttttgatatgttttaaaattccttatctgtttgtgattctcttttctttcctaatattgcttatttgtgcctacgttctttttcttaattaagatctttattctttccaatgttcatggcataattgttgaaagtatttaagaaaggcaacctgttttacatgaattattaagtgcatttttgatgggaaaagtttaatttctcagagagccgtgtaatcatttcatttaggctacaactcactagtttttcatattctgattgcaaagcagtaatttactggttttcatattatgttttaatgcattgaattcctttagagtggggctaatgtttgggtattagaatggtacctttttgtttgaataaagattttcatcaagtttttatttgggagaataatttttgaaatacatatcaaatctcagaaaaacttaacatgtaggcatccttaaaggcttttaaaataggaatgaggatcatctacaggaaaccctagtgattagctgtttcatgttttgtgatgtcagatgtaagcagtgaaccaggccagcctatatagctattgctgcagctgcacagtccagctttcttggatttacctaataactaatgatgtctaacgtcttttagtgtgcttaattcgcctttttgtcttttttgttcaaacatttatttaaatctttttgcttatgaggttttttcttttttttcctgatgatttgatactttatgtagtctggatacaagtcctttaacagatgtaggatttaaaaatattttcttggccaggcgcagtggctcatgtctgtaatctcagcactttgggaagccaaggcgggtggatcacctgaggtcaggagttgaagaccagcctggccaacatggcaaaaccccgtctctactaaaaatataaaaattagccgggtgtggtggcgcgctcctgtagtcccagctacttgggaggctgaagcggaagaatcacttgaacccgagaggtggaggttgcagtgagccaggatcgcgccactgcactccagcctgggtgacagagtgagactctgtctcaaaaaaaaaaaaaaaatttttcctctagtctgtgggttatcttttcattctcttaactgtgtctttctaaaagaagagcttttaattttagtgaaatccagtttatcaattttttcttttgtggatcacacctttctgtcatagctaagataactttgctgaactgagggtcagaaaggtatatttcttgttttcctcttgttgtgaaaactgtctgctaaattatctttgtgactttatttaaaaaataaattgagtgtccatttatgtgtgggcctattcccggactcttttctgtttcattatgctctttgtcatctgtctttatactagtacctcactgtcttgattattgtatgtagttttataataggtctttaaaaactttttttaaattttttaaatttttgttcattcattcattcattcattcaatcagtcattcaaacaccaactcaagccagatacaataggtcttaatatcagatggtgtttgccttttagttttatctttttctgatttgtattgagtattctagatgtttgtgtttccatatgaattttattactggcctgacaatttctaaacaaattcagtgttgttttataattttaaatttataagtcgtgcccatcttttgccagattgatacttaatttttttcatttttttttgctattgtaactaataatgtggtttaaaatattaatttccagttgttttttgctagaatatagaaatgtagaatatagaaatatagaattgaattttgtatgttgatgttatattctgcaaccttgttaaacaacatcagattttcaacatagattatcatgttatgtgaaccgaggatagctttgcttctttcattccaatttgaatgcctttgtttctttttcttgccttggtctactggctagaatttccaatatcgtggtgagtagaagtggtgagagaggacatcttgttttgtttctgatattaggggcaatatatttatgctttcaccattaacctatggtgttagcagtaagtttttaatagataattgttatcaggttgaggaaatttccttaatttcctagtttctgacacctttttttttttttttgaaacaaagtttcgctcttgttgccctggctggagtgcaatggcacaatctcggctcaccacagcctctgtctcccaggttcaagcaattctcctgcctcagcctcccgagtagctgggattacaggcatgcaccaccatgcctggctaattttatatttttagtagagacggggtttctccatgttggtcaggttggtctcgaactcccaacctcaggtgatccgcctgcctcggcctcccaaagtgctgggattacaggcgtgagccactgcacccagccatttctgacactttttatcaggaatttacattagacttttgttaagtcctttttctgagtgtattcagataatgtgttttgtaaaattttgtttaaaaaaaattttgtctataggaagaattacattgatttattttttaatgctaagccaatcttggatttctaggataaaccttggttaaccatgatttactatctacattacatatggttgggtttggtttgctaaatttttttataatttttatattggtgttcatgagagatactgttctgtaattttttttcttactatatctttctctggtttgatatccagataatactaactttatagaaagaagtagtccctctaggtttttttgcccagtgtggctacaataggggttggcaaactatggctcatgggtcacatcctaccaaccacctctttttttcatggccagcaagctaagaatgattttccatttttaagttgttacattttaagtgtcatacacacacacacacgcgcgcgcgcgcgcgcgcgcgcgcgcacacacacacacacacacacacacacacacacacacacacacacacacacacacacacacacacacacacacacacaccccccaagtaatagccttgattttgcttgttggcctataaaaccgaaaatatttattaggaaaaagtctgccagtttaattgattttctttcttttttttttaaagaaccagattttagttttcattggtttttatctatttttctttttctccatttcattgatcgtctctctgatctttattacttcgtttcttccacttaattggagtttcatttgctctttttttcttagtttcttagggtagacgctacaatatataatctgcagtaaatctcattctttatatttttcatttcagacattatagttttcatctgtagtagttcaacttgggtatctattaaaattttttctttctttctttcttttttctgagatggagtctcactctgccaccccggctggagttcaaaggcgtgatctcgactcactgcaacctctgcctcttgggttcaagcagttctcctgcctcagcctcctgagtagctgggattacagacgtctgccaccatgcctggctaatttttgtatttttcatagagacagtatttcaccatgttggccaggctggtcttgaactcctgacctcaggtgatctgcctgcctcagcctcccaaagtgctgggattacaggcgtgagccaccgcacctggcctattaaaattttaacatcttttttatatcttccctgtctctaacttttgaacatatgaaatacagtcataataactgttatttctatggtgattctaacatctgtgtcagttttgagttggttttgatagattgatttcactcttctttatgggttgtcttttcttgtttttttgcaagcctggtaacttttgtggattccagacatgaattttaccttgtttgttactagaaggtcttgtataatttacaaatattcttaaattttgttctgggatgtagttatgttattttaaaataatttgatcctattttgtcttttaataattgttaagtgggacctaagcaatgtttggtctggggcacattttcctgctattgaggccaaatccttctgagcattttacccagcatcccatgaattacggttttctagtctggctgataggatcaggaactgtttctacctaatctgtatgaatgccaggtactacttcctctaatccttttagagagttctttccccagcctgagtagttccttatgtgtgtgtgctgatgagtactctgctaattccaaaatggtacctttgcagatttctggaattctctgtcctctacagttctctcttattcaaactctgtcttggtctttttagactcttagctccatttcttcaactcagtgaatgtactggctccatctgcatttcccctccatacactgtggtctggaaactctctgaatgcagtaagctgggacagtcacagggctatcatcatttgttttccttctctggtgatcactgccctttgttgcctgattgcaattttattagatcattgtttaatacatctaacctggattttgagttgtttcaggcaggatggtaaatgtcttggctagaagtggaagtcttatatatctgtatctttggcatggtgaatgtaagaaagcattctgttccctaagtattcagaaaagagactgttcgtgcatattgactcttttctggatggagtttggaaagaatagttctcctgtattttttttttagagtgatttttccagtaattttcttttccagttttttttttcacagttggattagattattaggcaatatggattactaattccattatgttttattagaattagattggaactctttgtggaaagctactgaaaagatcacatgctatttttttcatggctgttttgcctctgatgtttattccaccaatatttgaagaaagagataaaaaggagaacctagacataatctttctattgtcaatttttctatcactaacatatgttctgaaaaaggacattcctgtcctatagtatattgctgccaaaataaatcccaagagattgaagttttattctattttcaaattgtttcctagaaaccagccacctaattcacaaagagattaagagccaagtcttagaaacataactttaaaaaactatataccaggacatgcctcatttgtgaatgtatgcgtgctcataaattgggtaattgtgcacctaactactgtattcattttttattattcgctttgtgcttatacaaatgaaggctttttcattcatattctgtagccttggacactcatgattggaggatagttactttttatgctcctgttcaatgttaatgcgtacaattttacaggaaattataaaatgtctccaattactttggtatagctgtaacaatagctactttattaaacgtgttctgaagtagtgtaggtaattgacagttaatttggctttatcaggttatatagaaaatgttagagaagctataaaaaacctttcgtatcagagtgtttgcctcaaaaggctatgttggctgggcgccgtggctcatacctgtaattcagcactttgggaggttgaggtgggcggatcacttgaggccaggagttttagaccagcctggccaacccaatgaaaccccgtctctactaaaaatgtaaaaaaattagccagggatggtggtgcattcccgtaatcccatctgctcaggaggccgaggcacgagaatcatttgaatctgggaggcagtggttgtggcaagccaagatcccatcactgtactccagcctgggtgacaaatcgagactgtgtcaaaaaaaaaaaaaaaagactgtgttgacatctgaatttaagttctgccaactataatttaaaacttaagttcccttaaactggtcatgatggtaagaatagatagcccagactttttgagattacagctcatctctaaaatgacaaagctcagatataatagtagccttcataaaatttattgccagacactgctaagtacttttacagacatttcctcatttaaatagactttgaaagaaaaatcagctatttaatctttaggacaattttgtaaaaggatcaatatatgtacgtattaatttcctattgctgctttgacaaataccacaaactttatggcttaaaacaacataaatttattctcttaagagttttggaggccagagatctgaattgagtttcactgcactgaaaccaagatgtcaggagggctggattccctagagaagctctaggagagcatctggggtatttttgtttgttcgttcgtttgccttttccagtttctaaaaatgtcttccttgctcatggttgcttcttccatcttcaaagctaacagccacataaccttttcctcttctgtagtaaaatcttcttctaccttcctcttatgaagacacttgttattacaaaatggctcacctagataatccaatctcaaaatccttaattatatattcagagtttcttttgccataaagagtaatattcacagatttcatgattaggttatggatatctttgggagacctttgtttagcctaccacgaaattgtattatgtacatcaaagtggagtacagtatactgccataagtcacataaaaacaaaacaggaacaagcacagtttggaattaagttgaacagagaggttgataatataagtaagagatcttggattgctgttctgtgttccagcttttatattattgactgattgtttttgttgctgatagaaatgaatagaacaatgatcttcaattttttatttttattttttcgagacagggtttcactctgctgcctacactagaatgcagtgacatgatcatagttcattgtaatcttgaactatggttcaaggatggttcaagccatcctccttccttagcttcctgagtagctgggactgcaggcacacaccaccatgtgcccagctaatgttttcatttttgtaatgatgggggattgctgtgttgcccaggctggccatgaactcctgggctcaagtaatcctcctacctgggcctcccaaagtgctgggattataggcatgagtggctacacctggcccaatttttttctaatatgttttatcttctactcttgtctttcttttttctatataagaccaatgcttagtagtctaatgtcatgaattgaaagacagatttacatagtctgatattataattaatttagaaatacattatatttgatgtttgagcatgtccttagacacatgttcagatatgcttcgttattccctttaagccttttctttactttttccttcacttttgttactctcaatgctaatgaataattgacctctttgccactgatcatggtactctggggatgaaagatttttaggaaacagctctagaggtttgttaactcctagaagatcatagatttctgaagtagattaatattttctatttttcgttattatcatttcattgtccatttcactggttaatcctatacctttgaagagaaaattccatttggtactacttttgtgctatatggttcaacaacttatggagtttacagtataaatgttttagaaagtgagcttgtattttgttgcacagtttgaaagctaaatgtttacattatcttccctaaactacaggataccagaaggccctattgatcaggggccagctataggaagagtacgcgttttagaagagcagcttgttaaggccaaagaacagattgaaaattacaagaaacagaccagaaatggtaggtgattatacagtgttttcccctcctcagtatatgggctttagcacagataattgaaagtttccttttatcaaaatgttggaaatgctacaactctctattctttgactacaggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtactattctcctttcacattttatttgggctttagaaaagattataatctaagaatgagaaacagacttgttaatccatctgttgagtggtaaatattaatagcacctacaatatttaagaggcgaagagtacctgaggtcccaaaggatggtaattgccaagtgcagttcatcaaccaaaatataccaccagaaagtattaattaaaatgtatttctagaaatctttacattctaaataaattctgaaggtagtggtgccagccaacaatacattaaaatatctttctataaatgttctttatatataatcagtatttgaagtggagtgtgcagttttgcattgcggtacattggaactcatagtgagtccgatggttacatttctaattcaaacattaaaaactttaaaatagcatttttttaaggatttctaatgaaaggttaacaggattttttttttctttaagtaaaaaggagcattctgttcattgttctttcattagttgctggaaagaggtacctgagatctgcctggttaaatttgtttctcctatgcacacgttgctaaataatatgaagtttatcttccacagaaaagaaaacattttggtgctgttgtattcatgcagaacaaaatgtatctgaaaatcattataaatacagtgaaacctgtctttaggcctgttatatttaaaagtctatgtttccagtaggattctgatggcaattactgtctcattagtgaacaataaaagaaaaattgttgtattagcacaacctactactgtgaagaggaaaagaattaccccatacaagtaagagatttcatatttattaacatcagcagcaatattataatgattttgaaaaattgcttggttgttttaggtgaaattataaataaaaatctgtctattggaatcattttagcattaatgaatctacagaaatatgatagcatggatttcaaggggcagtgaattattaggccacacattggacagactttttgatatatttagcccaacttgcagtcaggccatacttagaccactaaaccaaatgctgactaattctgtcattaatatttctctaccctaaagctgattctaggcacgaagcatctcttaaatggaattttgtgcttgtgttctttgcttatcacagttttttaggccaattcacatctgaagaggatttgacttgggtagactatgctgtatgtaaaggagaattttggccactgacttctgatggaatgtttaattttaagatttgagtaattgggctgggcgtggtggctcatgcctgtaatcccagcactttgggaggctgagataagagatctcttgaagctaggagtttgagaccagcctggccaacatggtgaaaccccgtctctaccaaaaatacaaaaatcagccatgcatggtggcacatgcctgtgatcccagctacttgggaggctgaggcccaaggatcacttgaacctgggaggcagaggttgtggtgagcagagatcatgccactgtactccagcctgggcaacagagcaagactctgtctcaaaaaaaagatttgagtaatcaaataacttgagaatttaattttccagtgtttttaaaaattaattcatatatatatatatatatatatatatatatatatatatatatatgtatgtatatatttatttatttattttttagatgtggaggtctttctatgttacccaggccagtcttgaactcctggtctccagtgatcctccctcgtcagcctcctgtgtagctgggattataggcctgggctaccatgtccagctgaattgaaataattctttaaggaattattttgtaaataataatataatttgtttatataactcgcatatgttttgtgaccatatgtacaaatgaaaagtgaatataagaaatgggcccctgagaaactgatataaatcagttttccattttgttgttgttgttgttgaattatgattccttacagtgccatttagtatgttaaataatggtagttcattgaaaacaaaaatggtaagtaaaggtacccaagtcagtttattttcctgtcttaaacagaaatgacaatgaatctgggacataacttcatagggtagtaatttaactccaggaagccagattagaatgcagtaatacaaataatgagcaaaacacaatcaaacattagagaaataacccttaaactgacggacgtacaaatagaaaggacttttattatgtagaatatacccttttactgaccattttcaagatccttaagtataagaattaaaatcaaaacaaacttttaggtttgcctctggtaatttttatatgatacaaaagtccattttatttttacattggctcaaatgatagtgtataggtttctaggtctgtagctgggaccatggtcagtgaggctgccacctgggtatgggcctgccttcttaaaagagccctcctgagtcttgggctctattagggttttgcagccttctacctgggttagaagattattagcagattattgaacttgagtagttcattgtgggagcccctgatttgacagagtgtgggtaccctggccactttgtacttgcgatggcatgtgaagtggggtgtagtattatggaactgagaggtctgggctaattctgggtagtttgtgtcactacctagttggtgtccacagagatttggagaattatctgatgtggaaaatgcacatatttggtgtcagaagtgttctgtggtgaaaaacagatcataatagtagtagtaatactaagggcagctaaagttgctggtttttgagaactacaactacagactccctgtttctctttgtgagttcaccacgatgcctgtgttgtttcctggtagaaatcgcatttctctgtaggttagtgaccccatcagtgagctgtgggggtaagactcctcctttgttgcccacttgaagctgtttcctagtagtcagggcaccatgtttcctctcctggaatctggctcctgttgttcatcacttgcattaccaggcattaaaatgcagcctgggggccaaatatcataagtttgatctaagattcaactcacctgagatttttagcaaaatactatttatttacctgattggccttgatagctaataactagtagagcctaatctctgcctgcaaccacagttgggtaatcaactggtagtaattagtaatattcttgggcttttagaagcttttacaggctgttttaagaatttagaggtgttgatggtataataaatttagagtagcatattaattattatctgctatattgatatcaagttttagcatcactagatttctaaatgatgatttcattctagtgattgcatatgaccattcttcccagtaatacagttaaatatacttgtagcttttgatatcattgatcatgaattgaccctagcctacctctttgcagtagagagaattaagcggtttagagttagtatttttgccattgtggttttaccatttatcttgtattgtaggttcagtgcttcgatttatggcagtttagatgtgtacctcaacctctaagcatatcatggagtctgtcttatcaacctttcaggctgatgcagagacatgtttaacttaatcactgttgctctgattctttttatcatcttcatattgccaaataccagtttatgaaaagggtaccaaagctgcttctttctgcttttaaaattaccatattttttttaaatttattcatttattttattattttttttaccaagttctgtttatggtaatttataacaattataaaactaaagtacaggagatgagccatttttcaactgtgttgactgaaactattgaaaaacaatctgttaaagtagcaatctcatctcccttacctagtttgcatttctcattatcagtaatatatagggcagctgtgcttagactaaattgtgttctccaaatagtgaatgatacttatgttaattatgctgatttgctaatgtacaaaaagacattgtgggggattatgtaacaaaagaaatgactgtgactcaaggggtacactgggaaagattgatagaatagcttacagattttttttaagtttatgatcatagttgttgttgcccaatagcttgtattttcattctgtttggaaggtccaagaattgatattcccactcttgaaaagttaagtttggtgaaccttcaaaccttctattctttgtgttttatttcatatacacaaaaacagagagagagacagagagaggaagggaggaaggaagatcttactaagttctctgagatgtgatttgattgagacttatattaagctgggatgtggatattctttcttgaatttcggatttgtttcaacaaaatgtttttgtatgattgtcttctaaggaatccaagcttattttcaagtggtgctagaacattcatcttaatattcatgtgcaaagggatacatttctttatgaagtcatccttattctgctcatcacttagtctctatcagccagataatgattcttcatcgcctgtaatggaacagtgtctcctaaaataaagtttgcattagaagaagaatctccaggtggaaaagggtgtttttcatctagtagttctaattctgttttgcttcctacgaccacacatcttttgggtgtgatttccaaacttaagaatgattttagattaaaaataatcacttactaaggatttcttacatgccagtcactatgataaaggttctgcattcattatgttactttatcagcacagtagtcctacaaggtatgcattatttgttcctgtttttttttttgttttgttttctgagacagagtctcgctctgttgccaggctggagtgcagtggtgtgatctcggctcactgcaagctctgcctcccggattcaagcgattctcctgcctcagcctcctgagtatctggaactacaggcacacgccaccatgcccagctgatttttgtatttttagtagagacagggtttcaccatgttggccagaatagtttcgatctcttgaccttgtgatctgcccgccttggcccgtttgtgctaggatgctaggatgacaggcgtgagccaccacgcctggcctatttgttcctctttttttttatttaagatggagtttcgctcttgttgcccaggctggagtgcaatggcacgatctcagctcgctgcaacctctgcctcccgagttcaagcgattatcctgtctcagcctcctgagtagctgggattacagtcgcctgccactacacccagctaattttgtatttttagtagagacagggtttctccatgttggccaggctggtcttgaactcctgatctcaggtgatccgcccaccttggcctcccaaagttgttcctttttgtttttgagatggagtctcgctgtgtcatccaggcagaagtgcagtggcacgatcttggctcactgcaacctccgcctcccaggttcaagcaattctcgtgccccagcctccgggtagctgggactacaggcacacgccaccatgcctggctaattttcatatttttagtagagacgggatttcaccatgttggccaggctggtctcaaacttctgacttcaggtgatccatctactccagcctctcaaagtgctgggattacaggcgtcagccactgcgcctagcttagttccatttttataactgaagttatattcagttctagagaaattaggtggcttaacacaggctaagttaacagaacggttttactccaaaatccgttctcttaattgctaaatacttagcttttctgagctttttctcttctacgtacggggatataattcctatagcacagcattgtgatgattacatgaaggaaaatatataaaatactttacctagtgcgtgacacattatagattctagtaggctctggtcagacctattaatacattaggaaaacttaactcttagaccctgcagagctggcacagataaaggcagattattgaaagactcaataggaaaaatgttaaggcctggaaactaaatgtaagcctagtgaacatcactcaccaaagtaacataattgttgtcttatatatgatagtataagctatttttgttgtcatccttctggagttttccccacctgtgtcagttgtcaagatggtggcatcctaaagttcctccttgagataagggaggcaataaggagctttgttttcttgcctgtctcctggtcacatttttatccttagcattgcttatttttgctgcaggagcaaaccgaagtaaaagcagctttggacaaaactcaagtaatttttcttgcccatgatgcagatttgcccatggatttgactttgagagtaaatcttagtcacatttacccccgtaagtgttaattccttcaccttcttgcctggattccatctctgtgctggcccttagggggagcttctctgtttttttttttttttttgaggcagtgtctctctctgtcacccaggctggagcacagtggtgcaaaaacgacctgggctaaagtgatcctcctgcctcagcctcccgagtagctgggactataggcgtgtgtccctgcagccagctagattttttattttttgtagagagggggacttgccatggtgcccaactcggtcttgaactcctgtgctcaagtgatccttctgccttagcttcccaaaatgctgggattataggcgtgagccaccacgcccgaccaaacttctctcttcaacattttgaatcaggcgtaaacaaaaagccctctttgtgtttggttcctcagtggcatagaggcagactagaagtcttttttttttaatagttttatgactattgaaatagaaaactagagaaattagcagaaaatataaggaacataaaacataaccaatttttgaaatagaggttttaatacctgtcataggtggcttgctttcagagtcataaattctgttctacttggcggggcgcggtggctcatgcctgtaatcctagcactttggggagaccgaggagggtggatcacatgaggctgggagtttgagaccaacctggccaacatggtgaaatcccatctctacaaatacaaaaaaagctcgtcaggcatgtagctcatgcctgtaatcccagctacttgggaaactaacacaggagaattgcttcaacccaggaggcggaggttgcagtgagctgagatcgtgccactgcactctagcttgggcgacagagagagactctgtctcaaaaaacaataacaacaacaacaagttatattctactcggtgtcttcaggcaactttattgtatcctcaaatggccagcactattttgctggtaccttgcctagctttgttatttcccaaaccttgacctggtctcatactaggtctttagtatgcccacttattagatttcttgatatgttcgtagtcaaaaccacaacagccagattccctgctttctgggactcttctaggagatctggtttcagggtagagttactgaaaacccagggcttctgcagaatggttttgagtcactatggttcccttgctgatttgattatcttcttgtctttgaccaaaaaataaatactgcaggatgataactttcaaatataattgaatcagtaaagaactagtttgaatttaaggttgtatcctggacttaattgtcttgcttacatggtctccaacagagaggccgagaaacaaaagattttaaaaacaagcttaattttagtggatcatgaagttacagtaacttatattgataccctaactgcattatcacaaaacattagtgtactctttttttttttttttatttgatgtttggtcttctagttgcttggttattctgctttctaggtagagacagatgaatgtgaataattaattgccaagacttagtactgatgtaaacttggtaaaaacattgacataaactaatttattaaaaaaagtagagatcagctttcattcacaatggtaaaggaatgtcttgattcctatgacaagaaagcataaaccatgctaatgcttatatttcaaggcactcttctctctaaattagacctaatgcagtttttacctccttgaggctatatgatgattgtcaatgaaatgtaatgctttttgtttctgtatctgttcctgtgcattcgtgcacccatgtgcatgtgtgtagtgacacatttgacgtaaaactgagagcatattgaatttccttttttccttcaacagacatttgctgataaactggttattccattgtatgacatctccagcacgatactgttatttaaaactgagacttgcgcctgcgcagtggctcacacctgtaatcctagcactttgggaggccagtcacctgaggtcaggagttcaagacaagcctgaccaacatggtgaaaccctgtcaatactataaacagaaaaaattagccgggtgtggtggtgcatgcctgtaatcccagctatttgggaggctgaggcaggagaatcacttgaacctgggaggcggaggttgcagtgagctgagattgtgtgactgcacttcagcctgggcaacaagagtgaaactctgtcataaataaataaataaataaataaataaataaatgtaaagttgagacttgcaacaagttttgtgattactcctatttgataggtaggaaaaaacaaatgaccacattctattatgatgaaacctatgaaatataaagaataatgagtgtgatgagggtgatgggaaagaggcttatgaaactgagaatatgttttaaatgaagttttagccgagccctatagccctattatagttaaagacttttgtgtttccatgagcaactcacaatttcatacagatagtgactttccccctcagtaactataaaaaaatactgtagtctacataatagtccatagaggactcagttttataatctgaaaaaactttgaagttgaaactttgcctagtctaaagacttcaggttaatttctgcattgtaggtttggtttttgcagccaaagtctctttcatgaaaagaaaatgttttgaatcctagctgagaataacaaataagaaaatggacaaggcatcacatattggcctcttgcctgttttaaaagggtgaaaatggaagtagataagctgcaaagtgtcctgtgtgtgatgaatgttgacacatgaaacaaatgtctaaagtgcttcacaaatggaactgttgttccaaagcatcgttcaaagttgttccactattaatttaggatgaatagtctaaatggtggctaagatttttaatttttaattgaattaatagtttcactttattcaaaaggggctattatcacgtattctctgttaatcatgtgtacttctaatggctttctgtgatagtaaataagactttcctgtgggctgccattgcatttttgctaaataatttagcatctagttaagaatcaggaataaaagagtactaagactgtgtcacaagcaaatcacagttgttgagggcatatttcaccatctcttaagtgattccttctcattgatcaatcccccttcttcagggtgttatatggaactcaatattggatcatttttataattgattatcaataccacgtgttactgttacccacatctaatggctccttcctcttggtagtagaattattagtaggtactcttcagacacagtgtaaaagctcagaaacaactctctgaggacctctagcattaaaaaaaaaaaatagcggctaccacatgtattactattttgtgtgtattttttaaagagctttagagaaggtcttttgatactttgtctcagagatgtcaaaataattttcctaggacacaaaattagtaggagatagaaccaaaattgagaaattggtatgtctggctcccaaagctctctcctctgattcagactttctgatttttggatatttacattgaggagaggacacattattgtgctctggacctcctactttgatatttgttagtgtagtaattagaagcctggactttaaaattcattgcttgggtttgatttcctactctgacatttctgaggtttgtgactttgagcaaattatttaacctctcagtgcctgccatttcttacctagtttgtaagattattgtgagattaaatgaaataatgtaaagcacttagaataggtgtacctatttattgttgttcttttttatttattgtaatacatcagttttctctaagtactcttggaatctccagctaatgctttatgtttttagttaatacagtcattgtaagtgatttctagatgtgtaatttttctgacaatataaatacatttctgactttataattttcataagcaaataatccataatcttaagcatgccagaggagttaatacaaagtgttgagaagggatgaagctggagctacacctgggtaaggattattccccaaacctgtctaccatcaaactggatttgtaaaagataaaaattatcaccgttatctcattatataaactcttgaaggtttttcttttgctactttttcattcatctaaagatatttatcgaatattttgtctgtgacatgcactgttccacatgctgattttaaataacaaaaaacaaaaaaataaaagaagcaaccaaaaaaaagttcattcttttggagcttaaattctagtagggcagaaagataagaagtaagtaatattgtatattggaaaatgataactgcttagaaaaaaaaaataagcagggaaggagtgttagcagcagtgaatccatacgggcctgcagcagctcgattcttgcttccttggaggaaataatttggccaggggaacataaggcagagtgagagatcaaggcaagttttagaacaggcatgagagtttattaaaatgttttagagcaggaatgaaaggaagtaaagtacacttgtaagaggccaagcgggcgacttgagagggtcaagtgtgctgtctgaccattgacttgggcctgtatatattgctatggttccggggtttgcatttcttcttacctgatttttccttggggcaggctgtctgcatgagcaatggcctgccagcacttgggagggatcgcatatgcagtgtgtttactgaagttgtgcacatgctcatttgaggctttttttccttaccagttgagtgttcctagaggaaggtcatataacagttaaagtctgccattttgcctcttagtacgcgtttgagccaactcacacaactcttgaaaacttatcaggaagctgctgatgaccagcttcagttgttttctatctatttaggagactgccgttccctggcaccagctgtgactagttaaattattttagagagatactttaacaactgcctgaccatcacctgatggtcgcctgacattgcttggaggttaagggggtgccttcttctgccctcttaagtctgcctagctacctactcaaacaggaggagagggaaaaccaagggttgagggtgataggcgggagtgttggatttttaagtgggataatctgggaaaaccttatgaagatggtgacattagagcaaagatttcaaggtcatttagatgagccatgtgaatagatatctgagaaaagagcattccagggcagggaggatcaaatagaaaagctctggagtaggaatatacctggcagtgtcaggggttagcaacaagaccagtgtgactgaaatagagaaatcaagaaggatggtagtgggagatgagatcaaagtgagccatattgggtggggtcttttaggtcaaagtagtaattttggctttgactctgagctgaggagccaattcatgttaagaacaaagtagtaacattatttgttgatgttgtaacaggatctagctgatatattgagaacagactttagatgtaggcaatggtggaagcagggagaccttgttaggaggttgttgtaatccaggtgagagaagatggtgtctcagttggtaaaagtgctggtggtgatatgtgaaaaattagaaattagctataaatttgctgacagatttgtaggggatgttagacaaacagagactcttgctttttacttttctttcttgctaaatgcaagtcataatttttatttaatgcaatataaataaaaccatttgtagcagccctaaagtttctctttttagtttactggagattttactttactctgcaggtaatccagcatgttgtaattgaaattactgatgctacacagaatgggaattactgatgctaaataatcattttattagtttagaccaggactcagcaaattatggcccagagaccaaatctggctcattgcctgtttttataaataaagttttattcaaacacagccacacctattcatttgcatattatctatggcagctttctgctacaaaggcaaaggatcttagagatctgtagagactaaaatatttactgtctggcccgttaatgaaaaaatttgctgacccttggtttatactgttaagagttgtgtaaaaattttcctctgatctttttccagtcactcagagtgtttaaatatgaagagaaaaattaaaagggggcatgaaatgatagtagagagaaccaagaggtactaatactaacgtcaacttctttctctatgttaatttactcatttgtttgctttgcgtattcactttcctccacatctttgtagtgctttgtctgtgttgagaaacaagtgcagctgactagcttgaacaaaaaaagtatattttctcaacagtgaaaatttactataggaatgactattggattttaagagactaatttttgaattgcacaaccttgatagaaaataaaagatgagtaccagtgtcaatgcgagcatcaatctttatgaggaatctggcattcttcttaagactttgtgtaatccagtgaagcagtacagacaagttcgatctccattgttgtttgttttaacaggtctataatgacggatctatactacctcagtcagacagatggagcaggtgattggcgggaaaaagaggccaaagatctgacagaactggttcagcggagaataacatatcttcaggtaagaaggttgggttaagaataaatttgagtgaaaaaaagaaggatcataatataactaagagtaataatttcagttgtttttagtcttcctggcccttgaaaatcagtactcacacattttacatatttattcagaaagacactgtgttatgccttgagtggaatacaaagatggctaaaacaaagaccctgtcctaaagggagctacttcttacacacgtacacacacacacacacacacacacacacaatacaatacaaatataacatcttacattttataggagagaaatagatgaaatgcttattggagttttgagtaaggagacatcagggatagtcttgtagagaatgtattgtttgaagtaaactgtaaaagatagttaaataggatttggacacacagaaatgaaggaaaagaatgtaccagctggaggttatcagctaagcagtggctcgtaactgggaaagaacagtacaggaacccatatgataagtgtggcagttcagtttgtctggaattttaggttgtgtgaaaggagggatggagaataagttggaaaggtaggcttggaaacagattacagaggttaaggtttatggtacataggcagtaaggggtcactgaaagattttacttatttgttttataaatgttattataacaaatagaaagtattggtaaacatcaagtctcagaccctttaaaattaatttcactttgttttttgtgttcttttctagttcttattaatatgtacacaccgtcttacatatatgtaagaaaataatttatttttgattttgtttttctgcttaatatgccataagcatttttctattttggagtcacaacctgcttttgaaatgttttacatacaaaagtggtatgagagtggtacttaagtgatattaatctgaaactagtattttagttgaacttgattatttgaagagactagaagcagggagaccatttaagataagaggaccatagtgcaggtaagaagtattaaggtatgtggcagtttgctttggaagtgaagagacaaatttgagagagattgggaagataaaattgataggcctttccaagtagatgaaagaactgaaatggctgggataatggggacatcattatctgataaggtgctgagggacagaatagttttcaggggaaaacaatgagtcagtagaatcttcaaatctcaaaatgtttgaagttgaaatgaccttggaacatcctccaccctcatccttttctaatgctgtggatggcatactgtgtacgctctactttccctgtaaaattaaagtattgtataaaagcaaaatgacagccagtgatatggttctgtatattttaaggtgcacatttttctacacttaaataggaaaaaatagaaaatcaagtgtttaaagagatcattaaaaaccaaactgatcttggcatgctatcttggtctcatacccacatggccattcatcagaggtgtctgcagaatgagaaacacttcacctcctgtagggaagaggtaattatctcctatcaactagaacctcactcagtgaactataaacagctggtggtgcagaaccatcatccttatttaaaatggaaataactgtggtttctgagcttcctccatttcctcttattcgttaaattttcaccaactatatctggtgatagttctaaactatgatctagtgatagttcagctacctaaactgtaacaagtacctgccacctgttttagtttccttttttttttcctcttggtttgtgggtggccaagtgctttcacctgtagtactaatttgatcctctatatgctgatttttgtggttccgtattagagaatttcatttgcaaatcatgctaataatttaaagctacattggctttttaaatcttttaaactatagcaaaacctagcactttacttggaccttaccttcagtttcagatattgctatttaactttactttcatgcttttcctttttccccccattggaaggaaaaggtgatttttttttttaattttcaaggagatagggacaatctcagtagaaaaaaagtgctttggaaaaatatttttctttttttcataggttgttggagtacaggtggtatttgattacatgttctttagtggtgcttggtgagatttctgtgtgcccatcacctgagcagtatacactgcaccctatttgtagtctttcatcgctcgctcccctcccacccgtccctccaagtccccaaagttcattgtatcattcttatgcctttgtgtcctcattagcttagctcccacatatcagtgagaacatatggtatttggttttctattcctgagttacttcactcagaataatagtctccaatctcatggaagtcgctgcaaatgtcgttaattcattcctttttatggccaaatagtattccactctgcatatacatatacatatacacatacatatacatatgccacaatttctttattcactcgttgattgacgggcatttgggttggttccacaattttgcatttgcgaactgtgctgctataaacatgcatgtgcaagtatctttttcatgtaacgactccttttactgggtagatacccagtagtgggattgctggatcaaatggtagctctacttttagttctttaagaatctccacactgttttccctagtggctgtgctagttacattcccaccagcagtgtagaagtgttctctgatcaccgcatccaggccaaacatctactgttttttgattttttgataatagccattcttgcaggagtaaggtggtattgcactgtggttttgatttacgtttccctgatcattagtgatgttgagcattttttcatgtttgttggccatttgtatatcgtcttttgagaattgtctattcatagccttagcccactttttggtgggattttttttttcttactggtttgagttctttgtagattctgtgtattagtcctttgtcagatgcagactttgcaaagattttctcctgctctgtgggttgtgtgtttactctgctgactgttccttttgctgtgcaaaaactctttagtttaattacctctgagctatttatctttgtttttattgcatttgcttttgggttcttgattatgaaatccttggctatgccagtgtctagaagggttcttccaatgttatcttctagaatttatatagtttcaggtctcagatttaagtccttattccatcttgagttgatttttgtataaggtgagagatgaggattcagtttcattctcctacatgtggctagccaattatcccggcaccatttgttgaaaagggtgtcctttgctctcccctctcccctctcccctccccccccccgtctccccagggtctccctctccctctctttccacggtctccctctgatgctgagccgaagctggactgtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcctgaggtgcctggattgcagacggagtctcgttcactcagtgctcagtggtgcccaggctggagtgcagtggcgtgatctcggctcgctacaacctccacctcccagccgcctgccttggcctcccaaagtgccgagattgcagcctctgcctggccgccaccccgtctgggatgtgaggagcccctctgcctggctgcccagtctggaaagtgaggagcgtctctgcccagccgccatcccatctaggaagtgaggagcgcctcttcccggccaccatcccatctaggaagtgaggagcgtctctgcccggccgcccatcgtctgagatgtggggagcgcctctgccccgccgccccgtctgggatgtgaggagcgcctctgcccggccacgaccccgtctgggaggtgaggagcgtctctgcccggctgccccatctgagaagtgaggagaccctctgccaggcagccgccccgtctgagaagtgaggagcccctccgcccggcagccaccccgtctgagaagtgaggagcgtctccgcccggcagccaccctgtccgggagggaggtggggggtcagcccccactcggccagctgccctgtccaggagggaggtgggggtcagcccccgcccggccagctgccccgtccgggagggaggtggggggtcagcccctgcccggctagccgccccatccgggaggtgaggggcgcctctgcccggccaccgctactgggaagtgaggagcccctctgcccggccaccacccggtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagcgttaaatggattaagggcggtgcaagatgtgctttgttaaacagatgcttgaaggcaacatgctcgttaagagtcatcaccactccctaatctcaagtatccagggacacaaacactgcggaaggctgcagggtcctctgcctaggaaaaccagagacctttgttcacttgtttatctgtggaccttccctccactattgtcctatgaccctgccaaatccccctctgcgagaaacacccaagaatgatcaattaaaaaaaaaaaaaaaaaaaagaaaagggtgtcctttccccacttgtttgctttgttgaagatcagttggctgtaagtttttggctgtaaataaatttctgagttctctattctgttgcattggtctatgtgcctatttttataccagtaccatgccattttggtgactatggctttatagtataatttgaaatcaggtagtgtgatgcctccagatttattctttttgcttagtcttgctttgactatgcggactcttttttggttccatatgaattttagaattgttttttctaattctgtgaagaatgatggcggtattttgatggggattgcattgaatttgtagattgcatttggcagtatggtcattttcacaatgttgattctgcccatccatgaacatgggatgcgtttccatttgtttgtgtcatctatgatttctttcagcactattttgtagttctccttgtagaggtcttttgcctcctcggttaggtatattcctaagtattttattttatttttattttttgcggcttttataaaaggggttgagttcttgaattgagtctctgcttggtcgctgttggtgtatagagaagagctactgatttgtgtatgttaatgttgtttccgtaaactctactgaattcttcctcagttctagcagctttttgaaagaatctttagggtttttgaggtaaatgatcatatcgtcagcaaacagtgacggtttgacttcctctttaccgatttggatgccctttctttctcttgtctgattgctctggctaggacttccagtactgtgccaaagaggagtggtgagagcgggcatccttgtcttattctaattctcacagggaatgctttcaacttttccccatttagtattatgttggctgtgggtttgtcatagcttttattacactgaggtatgtcccttgtatgccaattttgctgagaattttagtcataaagcgatgctggattttgttgagtgctttttctgcatctattgaaatggtcatgcaatttttgttttcaattctttttatgtggtgtatgacatttattgacttgcgtatattaaaccatccctgcatccctggtatgaaacccacttgaacatggtggattatctttttgatatgttgttggatttggctagctagtattttgttaaggattttagtgtctattttcatcagagatactggtctgtagttttctttttcagttaatgtcctttcctggttttggtattagggtgatgctggcttcatagaatgaattagggagggttccctctttctctgtcttgtggactagtatcgaaaggattggtaccaattcttcctttaaatgtctggtagaattcagctgtgaatccatttggtcctggactttttttttttgttggtaactttttaattaccatttcaatcttgttgcttgttattgttctgttcagggtatctaattcttcctgatttaagctaggagggttgtatttttccaggaatttatccatctcctctaggttttctagtttatgtgcataaaggtgctcatagtagccttgaatgatcttttgtatttctgtggtgtcagttgtagtatctcctgttttgtttcttattgaggttatttggattttttctcttcttttcttggctaatcttgccaatgatctatcaattttatttatctgttcaaagaacctgctttttgtttcatttatcttttgtattttttttttgtttgtttccatttcatttagttttgctctgattttggttatttcctttcttctgctgggtttgggtttggtttgttcttgtttctctagttccttgaggtgtgacctcagaatgtcagtttgtactctttcagtctttgtgatgtaggcatttagggctatgaactttcctcttagcaccacctttgccatatcccagaggttatggtaggatttgtcgttactgtcattcagttcaaagaatttttaaatttccatgttgattttgtttttgacccagtgatcattcaggagcaggtaatttaatttccatgtgtttgcatggttttaaaggttccagttggagttgatttctagtttacagtcatatatagctcagttgtgagaagaagtttggtctcaattttattaacctgtatattggttttacttgagaggagcaatttcacaggacataatggaaaattgaaaaggcactttgggcaactagagtttagtgggacaaagttcatagttgtcaaaatcattttctctttagagttgaaggcagtatggcatggtttacaaagattaaactgattaaaagattataatactcggattgaagacaaccctaatagacaagtatgctatcaggctcaaatagaatggatcaagcaaatcttgtaagggctttagtcttttactgtatatgtttatctaaaaagttttttcccgcaaagtgaacatataatattgggttgtattaaatgccattttgtcctggtcttactcttgtgttatataatcataacattgagaaaatgctattgtttctatttctgtagtttctgatgaagtccatttttaaaactgcacgttgctgatatatattcattatgagtccacattttaccataatataagtcattttcctagacttttgggtgattttatgtggaagagattatctttagaaaatttatgttgcgatttctgatgagctcatgttaaacaggcacgatgagtgagatctgtatacttcaagccttagttttttaacttgtttggagcagttggaagttggcagttctcatgtaaagtgctgctagttagagcaaatagcctctgcagaaggatatctccgagtttaacttgaaattatctgtctctgatatacgaaaatggattttgttttctgcatagccccaaagttgatattttaagcaaaattaagcccatttcaggtgaataaagtatgtaaaaagaaataacagtaaagatttatttatatttatttatttattttgtggagatgggatctccctattgttgcagtctgcttagtccctagctcagctaggtctgagttcttgttccacaaccaagaagaataaggcgtgtggacaccagagagtgagtagagtaggatttcttaagcaaaaggaaaggtctcagcaaacagaggggccctgaaagcaggttgccagaaacgggacttacttctggtcttttgtgtggcagaagccaggaagtcgtcgtggattttgcccaaataggagaggtaaagctccctcctaggggtgttgcatctgcccacgcttggagttggccagagtgacttcatcttggtattactcatgagtgcctaagccaaacccacaggtgctaaaaccacaaagttaatgtcatgttaatgacataatgagcttggtcaagttaacaacatttaggttgatttattgcacctgcgcctaagttgggtcagtcgtttctgagcaacaccctggcacaaggtgaagttcgtaaccacatttcttctggttagctgcagaagcagtgtaggtgctgtcctacagttgttcctgtgaacattgtccttctcccaagaccctccgtctctatctgcctaaccagcccctaactgcctcctctctcactgtgttgcccaggctggtctcaaacttctgagctcaagcagtcctcctgcctcagcttcccaaagtgttgcaatcacaggcgtgagccactgtgtccggccagaaagattttttggtttgcccccgtgttttgcttgctttggtttatgttttgaataggacttttactggaaattggtagattatttttcttttttttttgagagaaagagaggaaaaaaggtgtgaaaatggaaaacaactatttcactttttaaatgaggatagggattttttttcattcaaaaataagttttattggagaaatagaaaacttctccagtgacagtatatgatcctttggaataaggggaatgttaatgctggggatacattattgaggctattaaacatacatttcagcttatggaacccctcactccaacacaggatttgcctgatctcatttttctttgacaggactaattcgttaagatagatttaaagccagaatataactatatacgttatttatgtgcttgtatactgactctgagatcaaattaatcatcacatattcttagagttgtgaattgtgttctaccaagtaattcagattgcatttgtatttccgcctaaccaaaataaagccagaagtggtaatatctgtaactcattagaaaaagttgtcagcctaactacattaaaatatttgctaaatatttaatacaactgggatgggcagaaaccttcagagcttttccctatttgaaagaaatttttagtttaagaggaaaccatctaggaaaaagcaggcagtttctcagaagtaaaacctaagagtatactgagaaagaaaataccttttccaagataaaaaaaaaaatgaacaacttgactaaggacagaacaagaagtggtagtggatatagtggcatgggtagatttcatgaagtagcagaggggattgctatactggaagttgactaaggacataggctggtgataggaagtaaagaagaaaatttattgaaggaagttttctaagcattattaaaaacaactttatcttgaattcttacagattttacagagctcttgcttgtgggagcgtaggtccaattgaatagttcattggtgcattcattccttaagtatttggatatactgggcattaggtacattgctggtgatatagtcataaatcaaatagacatagtgtctgcccttaggaagtttaaagtctagtagcttaaacttcctgtgagtattgtcttcaaatccagacacacacacacacacacacacacacacacttttgaaacttccctacaattctttgttttgatagttatatttctgatactttttttggatctttctactatttcccatatctctggtacactaagttttcctatgggctccttcgtcattcctttttagaaaacttttattatggaaaactttaacatgtataaaaataagagctggtggacccttttgtcctcatcacccagctttatgatcagttttgtttcatctgtactaccagtgctacttaccatctctaggttcattttgaagcaaatcccagacattttataatttcatttgtatttatttcagtatgaatttctaaaagatagtttttcaaaacgtaactacattctattttacacctaagtaaattaagaatcattgtttaaaatcatcaaataaccagttgttgatcaagtttccccaactgccaaatacattttaatgtgccatttaaaaaatgattatgaatcatcacaggagcaatttgattgtaagctctgcatatactttttcttcctggaatggaaaaatgagagaagtgaatggtcagaagaaaaattagtgtggcctgacttgaaataaagaaataaagcaataaagaaataaatacaagcaaatgatgatagaataacttagaagaatgcaaaaactaaaagcaaaattaagatgaagaaaaataaaaggaccaaaccaatggatctaagaagaaaagaaaaaaaaaatgctacagtcatctcaagtgaaaaagcagatggtaaatactagagccagttttataaaattatagttatgatattgattttttaaattattacttagttgaatttctccagctaacagcttctatttctcttaagcgtttaacattcttggtcaaaatacataatatttttggaacatatttttaatgtaattgttatttaatgccttcctaaataatgataatgtgaacttaaactctttattgactttcatacaaaagtagaaatctgtcaacagtatttactcatattattttatttaatttgaagataagaacttggaagaataacatcatatttgtgttctctaacataatacttcatttagctttaaagaatttcccccaaaacaaagtgctacattagagagtattaacatagaatggatataaataaatgagttaatgagtaaatgaattatcaatgtaacactaagagaactgatatattatggtacctttgattctgtgctatactccagagcctggaacagtgcctagcataattataaatactccataaatatttttgtatgaataaattaaaaacctaacttgaattgactatagaaaggcatttaaaacaaaagaaaaatagaaccagatgtttaacacaaatatgaaggcttactgatgacttaaactcaagggtaatctctttatcatttggcagtagtttctttttctttttttcttctacagccttattgagatatagttgacacaaaataaacggcacatatttagagtatacaatttgttaagttttgacgtatacagacacccatgaaaccatcaccacaatcaagatagtgaacttatttaacactctgaagtgtgctcatgtccgtttgtgtttcctccaccacttcccaccttcatccacaggtttaactcagatctgctttctatcattatagatgagtttgtgtttcgtagaattgtatataaatggagacctacagtacatactattttgtctggcttcttttactcagcgtaattattttgacgttcatctatgttgtatgtattaataatttgttattcttaattactgactggtattctattatatggttatgccaaaatttacttatttgcctgttgatgaacacttggttgtttccactttggggctgttataaataaactgttgtgaatatttatgtacaagcctttctgtgggcatatacttccatttttcttggctaaatacctaggagtggaatggctgggtcgtataacagtgtaggtttaactttttaagaaactgtttgaactgtttacaaaagtgattgtgccattttatattttcatccagcagtgtctgagacttttagttctcatataccctaactaacactttgtatggttatcttttaaattttagctattttagtgtatgtgtaggggtatgtcatggtttttttttgtgtgtatgtggttttttttttttcattttcctgtaagtattgttgaatatcttttcatatgcatattttcatctgcatatcatctttggtgaaatgtctgcttaaatcttctgcctattttttaattgggatgtttgctttcttcttattgagttaaggttctttatatatattctagatatgagtcctttgtctgatgtgtgttttggaaatttttgtttggaaattctagtttgcagcttgccttctaattttcttaacagtgtcttttgaaaggcaaaagtttttaattttgacaaagttcagtttattaagtttttaaatttatgcttttgtatttcgtatttatgaaatttttgtgaagcctaaggtgactagaattttttctggtttcttctaggaattgtataattttagctcttacatttaggtctaagatccattttgaggaatcacgtaaactaagaattgaggttcatttttttgcatatagctattcaattggtctagaatcattttttcaaagattatgtctttcctattagttgctttagaacttttatcaaaaatcaattgactgctgggcgcagtggctcatgcctgtaatctcagcattttgggagtctgaggtgggtggatcacttgaggccaagagtttgagaccagcctggccaacatggtaaaactccgtctctactaaaaatacaaaaattagccaggcgtggtggcgcacacctacaatcccagctacttgggaggctgaggcaggagaatctcttgaacccaggaggcggaggctgcagtgagccaagatggtgtcactgcactccagcctgggtgacagagtgagactccgtctcaaaaaaaaaaaaaaaaaaaaaatcaattgaccatacatgtgtgtcatgtgtgtctgtctttctgttagtaccacactgtcttggttactagctttgtagtaagtgttacaactgggtagtgtgatttatcgttctttttttgaaattttgttcattatatgttctttgcattttcatttaaattttagaatcaacttgtctgtgtgttgctagcacatagaaatacaattgattttttatatattgatcttgcatcttgccagtttgtcaaactcacctggtgcttttttgtagatttcatcagagtttctacataaagtatcatgtcatctacatatagatacacttacttcttcatttccaatatggattctagttggcagtagtctctttgagtcattaatcttaattaaatagtacagtttactattaggataacttacagtaagccacaaattaattcctccttcatttaaaactaaaatccttaccaaagtccaaatttcagcttttaggttttcttagcaagagttttaaaatattttgagattcctaatggtaatgaaggaatttttttaattcctgagagtacactcactaagctgacagcattttgacatttttcagtttacatatttttatatattcaaattctcttaattatcaataataaaaggctttcacaacatcattccttattgagggtataaaagggaatacatatttaggtcattaacatctgtgacctggaaataaaattgacagattctggcccagcgtggtggctcacgcctgtaatcccagcactttgggaggccgaggcaggcgggtcacgaggtcaggagatcgagaccatcctggctaacatggtgaaaccctgtctctactaaaaatacaaaagattagccgggcgtggtggcgggcacctgtagtctcagctactcaggaggctgaggcaggagaatggcgtgaacctgggaggcggagcttgcagtgagcagagatcatgccactgcactgcagcctgggcgacagagcgagactccgtctttaaaaaaaaaatacacacacacacacacacacacacacacacacacacacacacacacacaccagattccattctagatgctattccttaactcatttaatccttgagagtagcaacacccagtagaggttttatccttttaactttcttgaatatacgttgaacttaaattcaaatttctttaatttaggtatatcagcccaatatgtacttgttttaaagttatttcgaaagtaattttctctttctagaaatatgcctcatttttttcaagaaatggcaggtttcgctatagttcgactctgatctaagtcacaatacagttctagaaacaattttccaaatcttaaagcaggtctggtttccacatagaaatagagtaataatggaagttctgattgtaactaccaagactcaagatggaatttcttcttccataatagtggtatgagttccagcgaagcaagaattagggagtagcaagacgcctatgaagggaatacgtaggctcttgagcagaggcagattcaggtttgggggagtcacctgaaacctattcaacttctggtgctgtctttatgaaaaggaatacaaaatattaaatgtttacaattggctgtcattattcatgttatatatatatatttttttttttgagacggagtctcactctgtcacccaggctggagtgtagtggtgtgatctccgctcactgcaagctccacctcccaggttcatgccattatcctgcctcagcctcccgactagctgggactacaggcgcccaccaccgcctcccgggttcacgccattctcctgcctcagcctcccgagtggctggttctgcaggcgcccatcaccatgcccagctaatttttttgtattttttagtagagacggggtttcaccgtgttagccaggatggtctcgatctcctgacctcgtgatccgcctgcctcggcctcccaaagtgctgggattacaggtgtgagccaccgcgcccggccaattatattctttaatactgaattagcaatagtgaaccactattcctaggggaaatacagagttaggttcctgtgagatcaacattttcatcaactgattaacatatataaccttgttttatgtgtgtttctatttcaagaaaccttatttaatgtatattgttgatttattaacatggataactcatatgtgaacaaagcttatctgacatacatactttctctgtaaagcacacacagctttcttgcccttagggacactggacagcacttcactactatgtttgggggccattttcaacagtgaaatcactggaaaaaaagcacaaaaatgagaaaaacagctaaatatactgcagaaaggacatttgtttatagtaagagatttgaaacaagaaggcaaaaagccaccttggctgaaattacgtgccttggagtactcaaaattttcattgcacgtgtgcatgaatgaccgtgaaagcaccacaagtattgatttgggtgttacaaataaattctagttggtaaattcacatggaatctgtgaatagtgaggattgactccaggatgaaaaaagaactcctaacaagttacaattgtataaagctgacaaatgccacaaatactaaaccccagaaaaataatttttaattaactgcttgatgctctctataatactgttttcccttacatttcttagctgcataccctttgattgtatgacagtgatttgtaatgttttctgtaaagagaattgagaatgactttgtaatattaatattgtctataaagagaatggaaaatctgaaaagatttttttctctagcatggttgatttaaaatgttgtttttaaattattgatatttgtggtacataacatttgaaacttcacatacatacatacttcatatttgtagtactgctgtaagcttgtgccgtttagacaggatttcagataattttattttatgtgattctcatcagaaaaggaaaaaatggttcatataattgcttgtgctacatttttaattgtctacactacattttcaagactattagtgacagaagagaacttctattttgactaggcatcattgagaaatgcctccttcatttctgttattaccttgtacttaccatgctaggaaccatgggacacattcatatcacagtgcaatctctcaccctgtatctatttatgtgacaaaaatatctctgcacaaaagcaactgtgaactacataaatatatctctaaatccaaactaaatagttctcagcttaatttctccatcacaggatcccagaaatgcagatggccactttatttgctacccaacactaataccgacgctggaaaactgagatggcaccgaatcctgagagacagatatcttaacttatttaacttaactcatttaactcatgatggtgaaattttacaaaaacacatccaggtaacatagcacaagcctctcccagggcctttgaagggaaccgtgcaagcaagggtcccttaagcttacatttcagcaaatctcctaaggaagctcttcccattgaactaggagggcacctcaagttcctaaggggttctcagtcctgctcccaagataggagattacttgagaaaaccaacattaagaaacctgaaatagagaaagctatattgcaaaattagatgaaaggtaatagatgctgaccctttaagattgagttctgtctctaatacaaagatataacagagaatgtccagattgcctctagttaaaattttgttttaatttaatactagaacagcagctttccattaaaaagtgctaacctctgactaggactcactttccatctctccttagagcctgcagcactttctcagattgaccagcctacaattgtgtatcaactgcttgtttactaactgccaagaacctttgtgtaagtcagccataccctaggtgtgagtgttggttatggcagaccataactgagcagcctttccaatgacttttttttttttggtctctgttcagtaaccttcactgcctcctcttcctctatccctcccctctaattgcctagctaagggtagattaccaaatgagaatctaacatcaagtaagttgtagatatggctcattgataagtcataaatgcatacaaatacatctctgtgcaattgattaaaacatatggataagctctgaccctgaaaaatgaacatgataattctcacacattaaatattgttctgtggtaggttgtctaaaaaagtatttggatgtttgtgtacttggattatgcaaattcatgtatcataaatttgacctatctaaacctaaaataccaattgtgataagtaatttaacaggagtgatgtatgtgatttgcatagcttgtatcacttgaaaaacttctctgtgaaaggttcgcactgatttcttttctatagaaaattgtgacattctagtcattacagtgatgttatactaggctcaaggcttaggtcagttgtatttgatagatgataaaatacccagatcactcaaggtcttattaaagtcctttggttgtgatagggagcaggtgtttcttcttgttcctctagtatgttaaagtacattaaaggaagctgtgaggttgaagaacatttgtaagctgccatttctgagcactttctgtatgcttagtattatgcaaagtaactcttatgatgcaggtgttgtaatgttcaatatgcaggagagtaaattgagacttagagaggtttgtacttatctttgtctttaatgatagtatgagaggtgatttttctttctctgggttataaaaacttgaacttaatagtgatagaatgtagaattatgtgctaagtagattaaaactgataatcagaggtatgggtagaaagcctgacattttacagttgaagtattaaacacatcctaacctgtccattacacctatgggacatcttctttccagcttataggaaatgagtaatagttgctcttaaattttgttccatatatagtagaggtatcctggaagattcaaaatatatttatgatctaagtaaatgttgtcaggaaaatttcagttttagcagatcagacattaggaaaatattgctactagtgtgaatagaaagtaatgtggacattggagaatttccttaggtttactgaggacctaaatgtatgtgtctcattaaaggttaaaaaaaaaaaagaagtctcagaagttatattaaagcaaaatacaaaatggaacaagaccttggggttttgcttagggagcatatatttctgcccactttgttggaggttgctcttcctttttgccaccatgtttttacagattttattggcctagaccagaggtcagcaaactaccacccttaggccaaatccaacccaactgtttttgtaaataaagttttgttggagcataactatgttcatttgtttgtatatcatctactttcaggctacagttgcaaagttgaataattttgacagaaaatgtacagcctgcaaagccaaagatatttactgtctcctcctttacagaacaactttactgaccctggcctagacagtgatgaaaataattcttaaatgtttttcctcctattttccttttcttcctcttcctgttccttctattcctttagctatatatgaactcttgttggtattccaggtgtcagctttctgagcatatgcctttgtctgcctcctgttgaggttcccacctccaaacagttatttttttccatttttgaggctaaggatttttactcgttagagcaacaggactagacatcaggagttatgtaagtactcaggaatataccccttgctatcttacagactgaccaccatttgtttgccttttgaagagcacagtgatcttcttaaaatgtagtcatgttaccgatgataaagctgtcaaatgtacaatgatgtctttttaaatattgggaccaaatcccaatttattctgactaatatcgggttccacaagagggaatttgaagcatctctgctaatgaaatcagttttcattttaatttatctttgattttttgcatgttggaggtgaggagggaatgagggtaacacttttcatttagttcttaattttcttctgttctactctacaataaagttctgatggtatattggagctattatggtcatgctatcacaagagggtctaggatctaacagccagaaagattaagatgcaaatgcaaaaggaaccatacagatttcaatttggagaagtagggagtctctgacgatatttgaatggaaagagacatgtcattatttttaccattgcttcttattttctctcaactattccatgtattttccgtagttcttacaccttttattcctttcttttcattggtataaacattgttcattgttaaacaaaatatatcacctataaacatctgacacttttgtatgcccatagactaccatttctttgataaagatgaagcatatcagaaactgtctaggattgttagaattctagttaacattctgccaataaaacagccctaagctttggacatttctctttctcagatctacctgaggttggtgattttttgtttgtttggttggggatgttttggtgggaagggattgttttattttatttttaatctgaatcttcttcccttggagtgatagccgaacttgctgagtttgtgagtatcagggatagaagatatcctgaagccacaagtcacatctgaaatagaaaagttgctattgtgtcccatgtgagatggttgattatgtttaaagggctaaggacaagatagatactgtgtgtttggctttgcaaccaaaggacctagtgccctgccttttgtacttaaataatggatgaaaatggaaataaagctgaactctaaggaaaagcttttaaatctaaaagagaccattcagtattcaaagcctacacactacagaggctttgaataatctccttaagttttcactatgagagttcatttcaaataaatgttatattttccttttaaataaaaagatataatgatattgttctcaagattgagagattgttgaaaaaagttggtttaccatttttaaaagaaacatattagcaaatgcctctgaaaatacacttattagtttgccaataaatgagtaatgttgcagttgtgagttaaatgtgcattaaatgtttgagaatatattgggcttaaaatacagttttaggcttctatttctggataagatatagtaaacacatcatacactatatatattagtctattctcacactgctataaagaaatacctggctgggtgcggtggctcacgcctgtaatgccagcactttgggaggccaaggcgggcggatcacgaggtcaggagatcaagaccatcctcgctaacacagtgaaaccccgtctctactaaaaatacaaaaaaaaattagccgggcgtggtggcacgcgcctgtaatcccagctactcgggaggctgaggcgggagaatggcgtgaacctgggaggcggagcttgcagtgagccgagatcgtgccactgcactccagcctgggtgacagagtgagactctgtctcaaaaaaaaaaaaaaaaaaaaaaaaaaaaacctgagactgggtaatttataaagaaaggaggcctaattggttcactgttctataggctgtgcaggaagcatagtggcttctggggaggcctcaggaaacttacaatcatggcagaaggggatgtgagatgtcttacatggtggagcaggagcaagagagagagcagggaggtgccacacacctttaaacagtcagatctcctgaggactctatcgtgagaaaaatactagcagggtgttaagccatttgtgaaaaacggccctcatgatccagtcacctttcaccaggccccacctccagcactggggattgcatttcaacttgagatttgggtggggacacagatccaaaccagatcactgtaattcctgctaattacaaaaaaaaaaaaaaaaaaaaaacaaaaaaaaccacaaacttgtaatttcctattttttgtgtgtttacttatttattttacttcctatatatcccagccaagggtactagaggcctgcagctagaaaccttagtggacagagaggggggaaaaaaaagccccattttaatgatatctatccagttgcagtcccttccccaggtgctgtagctatggagattgtgcatgtagccctgtccctcattcctgtcctgcaataatgagggtgcccctcccactcccactgaacactgttcctaccactcccactgggcactgctgccatggaaactgtggatggagctgcaataacaagtttgcagccctccccaatggatgctacagccacagagactgtgggcaaagccctgaccgccgtttccatcccctaaccctcccaactagagtgtggagggaggattaaaaagaggagggagttagagaaagagacttaaaaaaatctgtgtttgaaatcctgggcagatttcttagcatccctttcatgaaactgattagaatcaatacagaaaaaggttttagaattgggctctgctgtgttataccacccaggtttcagactggcctctgggtagcccagtggggcagaacagaacaacactaaaaagaccctaacaattaaattgacatttgattcacagcccataaaagttggctaagacatgcattgtgaatctaaacaacttgattgcctatcaaagtagaaaatttaaacaacagagtctcctaacataatattcatcatatcaagaaccaagaaaatcttaattcgaatgatgaaagttaatcagctgacactacactaagttgacacagatgttggaattgtctgacaaggattttaaagaagctataataataaatatactccaattacaattacagtcttgaaacaaatgaaaaaatagaaagtgtcaccaaagtaatagatgatataagggagaaacaaatggaaattttagaactgataaatataataaactaaattaaaaattagctcagtagtaaaatagagatgacagaggaaagaaatggtgcactcaaatttagatcaatataaattatgcagtctgaacaacagagagaataaagattttaaaaaggtgaagagagtcttatggggacctctgagaaaattacagaaacatcttcatatttgtatcattgaaatcccagaagaagaaaagtaggagtgagagattgaagaacatatttgaagaacagagagacacagggaaaaagccagtgaagtcaggtagtgattggagagatgtgtctacaagccaaggaatgacaaggatggctggcaaccaccagaagccgggagagagacatggaacaacttcttccttagagcctccagaagaagccaaccctgccaacaccttgattttggacttctggcttccagatctgccaagaaaccaaaagacaggatgagaatcaacactttgtaagagccttcagtggaccagaagctggaaaggccagatactcgctttcctagcaccctccctgttttgtatgccctctgctaggatggctgtgcgatttgctcctggttgattcaatataagaggaagttggctggtgggaacgtcagagaaatgtttttctttctgataaaaatggagagcacataagaaaaaaacttttagtgtacttcttcttctggcctttggatatgatgtgagaagcttgagaggacatgatgctttggagctgttacaaccatcttgtgaccatgaggcattcagataaaaagctaacattctgaggctggtgaagaagagactggctggaaacaggaaaacattcctgggactgtcttctgattttcttattaggtaaacaacgtgttcttagtgcttaagcactttttttttttttaaatacaaccaaaagcagtcttaactgatgcacaagccaggtgcctgacacaatgggggtcaatatgtatttattggataaaggaataagagaaagaatgaatgaaacttctactaaacctacctatactccagctgtccctgttaacaggacctcatgtggaatacttgaaggctgggctggaatcatctgagagcacattctcttggctgatgctggaaagagccaaacatttggagcatgcgatagcaggggatcattggccatctctctctgtattggtcttttcagtattgcaacttcaaggtagtaggattttttacaaggtagctgagggctccaaaggtagtcacttcaagaggcagagatagatggagaacaagccaggaggaatgtgtgtccttgatataacctagcctcagaagtcacatagcatcacttctgccctactgtattggttagagcagtcatgagccccactaggtagaagaggagaggtagagatctcctctcttggtggagaggggatggttgtagaaaagcatgtggaactggaaatattgccagggctatttatttatttattagtttatttttgaaaatccagtctgctacagtgccttatatacacctctattatcagattgaccatctcgatgtcattcatgtctttcatgtctatccttctgactgaaggatgcaagcacctggaagttttagtctgtgatttattaactttagtatctctgatacctttataaagatatgtttaataaatgccttattttgaagaaaagaaaagaaattgaagaagtgacagaaaacttcttaaatttggcaaacctaaatattcaagaagctgggcaaactcctaacaggaaaaactcagatccattcccagatactttttaagtaatttgctgaaaactgaaaacaatgaaaaaaatcttgagagcagccagagagaagcagcgcattaattgtagaggaacaatttgaatgactctgggtttcttatcagaaaacatggaagccaagagaagtaggaaaactgtatcgtttgttttgagccaacatcttgctattttgcccattctggtctcaaactcctgacctcaaacaatcctcctgccttggcctccgaaagtgctgggattataggctttgaaccagatttaaaaccttgtgctgaaaggaaagaattaccatccagaatttttcacctagggaaaatacaacgaagtgagaaaaagacattttcggatgaaagaaaactcggagacttcattgccagcagacttgcgtaaaaaaggaagttcttcagacaaaaaatgatgacagaagggaattctgctggaacatcagaatgaagaaagtacaaattaataggtatagggaattgcctaatcttctcctgttgagtttttaaaatgttgggtaagaagcaaaattttttacaatggccgatgtggttcttaatgtttatgaaggtgatttttaaaacaatgtcataaaagtggggagagtaaaggaacctaaaaagtaggaaggtttctgcattccatttcaaatggcaaaatgttgagtagactgtaataattgttgtatatagatataattatccctagattaactactaaaaatgctctataggccaggcacggtggagcacgcctgtaatccctgcactctggaaggccaaggcaggcggatcacctgaggtcaggagttggagaccagcctgaccaacatggagaaacctcgtctctaccaaaatacaaaaattagccgggcatggtggcatgtgcctgtaatcccagctactcgggagactgatgcaggagaagtgttgcttgaacctgggaggcggaggttgcagtgagctgagttcgtgccactacactccagcctgggcgacagagcaagattctgtctccaaaaaaaaaaaagctctataaaaagatattttaaaacactatagaagaccatactttacaggaaccatttctgtagttccttaaaacactatagataaatcaaaattaaatactaaaaaaggttcagagtatgcatagacaaggagaaatgggaacaacaaaaggagcaaataaaaaacaataaagtggcgtacttaaatcccaacatgtcaataattgcatgaaatataaatacaaatgatctaaacataccagttaagaaagagagaaaaaaaaatacaggacaaagactggcagaatggtgtttttttgtttttgtttttgtttttgatacagagttttgcagagacagggtttctccatgttggtcaggctgatctcgaactctgacctcaggtgatccgcccacctcggcctcccaaagtgctgggattataggcgtgagccactgtgcctggcctattttttattttaatgatccaactatatgctgtccccccaagaaactaacttcacatataacgatataggtagattaaaagtgaaatgatgggcagatacaccatgcaaacaataatcaaaagaaagatagaatgactgggctgggcacggttgctcacgcctgtaatcccagcactttgggaggctgaggcgggcagatcatgaagtcaggagatcgagaccattctggctaacacggtgaaaccccgtctctactaaaaatacaaaaacaaaattagctggcatggtggtgggcacctgtagtcccagctactcgggaggctgtggcaggagaatggcatgaacctgggaggcggaacttgcagtgagccgagatcacgccgctgcactttagcctgggcgacagagcaagactccgtctcaaaaaaaaaaaaaaaaaaagtacagtgactgtattaatctcagacagaatagacttcagagcaaagaaaactagcagagacaaaggaagatataacgataataaaatgatcaatttaccaaaaaaatgtaattttaaacatgtgcacttaacaggttttcaaaatatatgaagcagaaactggcagaactgaaaggagaacagacaaatatagttggagactttaatatccctctttcaataattgatggaagcattagaccgaaaacaaacaaggtcattcatcatgaccaagtgggatttatccctgggacacaagaattgttcaacatacacaaatcaatcattgtgatacatcattatcaacagaatgaatgacaaaaaccgtatgatcatttcaattgatgctgaaaagcatttaataaaatttaacttcccttcatgataaaaaccctcaaaaaactcggcataaagggaatatacctcaacataataaaagccatatacaacagacccataactagtaccataatgggggagaaactgaaagacttttctctaagatctggagcatggcaaggaggcccactttcaccactgttattcaacatagtgctgattactctaggtagagtaatcagacaagagaaagaaatgaccaacatccaaattagaaaggaagaaatcaatttattcttgtttgcagactatatggttcaatatttgaaaaaatctaaagactcttccaaaaaaaaaactactagaactgataaattcagtgaggttgcaggtacaaagtcaacacacaaatatcagtattgtttcaaagtcaacacacaaatatcagtattgtttctatatgccaacagtgagcaatctgaaaaagaaatttaaaaaagtaatctcatttgcaatagctacaaataaaattaagtaacaagaaattaaccaaagaagtaaaggatctctacaatgcaaactataaaacattgatgaaggaaattgaagagaacataaaaaatggaaagatattctatgttcatggattggaagaataaatattgttaaaatgtttatactatccagagtaatctatagattcagtgtaatccctatcaaaataaccagtgacactcttcacagaaatagaaaaaagaatctaaaacttacatggaatcacaaaaaaaccagaatagtcaaagctatcctgagcaaaaacctcaaaagtagaggaatcacactgcctgaggaaactggaggaatcacactgcctgacttcaaattatatactacagagctatagtaaccaaaacagcatggtaccggcatatagaccatagaccaatggaacaggtggagaacccagaaacaaatctgttatctacagtaaactcattttcaacgaaagtcacaaacttacactggggaaaggaaagtctcttcaataaatggtgctgggaaaactggatatccatatgctcaggaattatattagaccccagcctctcaccatatacgcaaatcaaaatgaactaaagacttaaatctgagacctcatactatgaaactactaaaaggaaacattggggaaactctccaggacactggtttgagtgggtaaagatttcttaagtaatacccgataagcacaggcaaccaaagcaaaaatggacaaatgggatcttatcaagttaaaaaccttctgcctgcacagcaaagggagcagtcaacaaagtgaagaggcaacacacagaatgtaaattagtacaaccactatgaagaacagtttgggcgttcctcataaaagtaaaaattgaactaccatatgatccagcaacccagctgctgggtatataatgaaaggaaatcagtatattgaagaaatatttgcacttccatgtttactgcagcactttccacaatagccaggatttgaaagcaacctaagcgcccatcagcagatgaatgaacaaagaaaatatgtgatacctatacacaatggagtactatccagccataaaaaagaatgagatcctgtcattagcaacaacatggatggaactggagatcattatcttaagtgaaataaaccaggcaaagaaagacacacttggcatgttcttacttatttgtgggagctaaaaattaaaacaaattgaactcatggagatagagactagaatgatggttaccaaaggctgggaagggtagttgtgggggcgggtaaggggacgtggttaatgggtacaaaaaatagttagaaagaaagaataagaaagaaagaatatctcacagcacagcagggtgatagtcaataatacatttaaaaataactaaaagagtataattggattgtttgtaacacaaaggatggctaccccatttaccctgatgtgatttttcatgcatggtatgcctatgtaaaaataccttatgtaccccataaatatatatacctactatgtactcaaaaaaattaaaaattaaagaaaaacaatgctagaaaaatagaaactttttacttaccagcaaccccgttaaagaggatgaaagagaagccatagactgagagaaatctttgcaaatcacatgtccaacgaaggcatgtatagacaatgtattaagaactctccaatctcaatagtaagaaacaatctaattagaaaataggcaaaagtcttgtacagacggctatgcaaaagacatatacagatgacaaataagcacatgaaaaatgttaaaaaatcattagttattagggaaatgcaaaagacatgatgagatacaattagtcacctgtcagaatgactaaaataaaaaatgccaagaatgtggaacaaccagctctttcatgcattgcttatgagaatgtaaaatggtacagccattctaggaaacagtttggtagttctccataaacataccattaccaatatgatccagcaatcacattcctgtatatcctagagaaaacccatgtccacacagaaacttgtacactcatgtgcatagcatcttagtttgtaataaccaaaaagtggaaacaacccaaatgtccttcagtgggtaaataaactgtgatataatccacataatagaatactacctagtaataagaaatgagctattacacacaagttggatggatctcaagagcattgtgctgagtaataaggcaatctcaaaagattaactactatctaattccatttataatgctcttaaagtgactaaattatagtgatggagagcagttcagcgggttccagagattaagatttggggaagagtgtacctctaaattggaagtataaggggtttctttgctttgatggtacagcttgtatcctaattttggtggtggttgcatgagtgtatacgtattataaaatctgagtgcacgtgaaaactggtaaaatctaaaaaagtctgtagttaatagtattgtataatgtcaatttcctgattttgataaggtactattgttaagtaatatgttctccttggggaaagctttttggaaggtacgctgtaagtatagtaactctctgtactattttggcagtttattatggatcttaagttatttcaaaataaaagtaaaaaaatacagtgttaaaaatatttgaggagtaaagaataaaatgaactggttacagtactgttcattgaggtggtttgagaaaggtgatcttgaggtgttttttgttttttgttttgtttttttttcattaaaaaaacaataatagctggggattccagagaaattcatgctcagctaacagtgtatttttcatgtatggctggctgcatggagaaatgagacaaagactccgtcttcgagaagaggtatccagatttgaaatctagtctaattgttgttgatggtttggttttaaagccagtgaatagacaagtgctgtaagtaccagtactacccagaagaatggtactttgcagaatggaaaaaccagcaaaactgtgtaacttaaaactctgacttttatttaaaacgaaacatttggagcagcttttgcacaggaacagtttcaaccattgttttccttttgcaagtacttcatcttttacacttgatcttagccaaaaggccgagaactgatactttatctttttactcctgtgtagtaagacagggctaactattcataggcatgctttttactccttttccctttccaccctcttcctcttcccctttctgtcctcttctctcgtccgcctttcttcccctctgttctcctcccaactccccttttttctatcttatttcctcctctcctcttttctcttctcactccctttttgaaaagagtacctgtcatatttttgaggaaagagaccgtaatgaattctgtcaactaaaatgatgacggaggacctttctaaaattcaatcttaattttgtaagcatgctctttataacctcaacagttaaattgattctgagacctgggaattagggtataaacttacagagaaaagttgaggtgcttgagaagatacattttctgtgcatttatataggattgtcagattctggctcctcatgtaactcaacttctgtatccttggaggtagttttatttacattatattcttgaatgagaatatgcatcattaattatctgcctttcctttgtggcccttctgatggcagaaaaatattaccaaggttattctagcatgcaagtctcttgaaactaagttgagggttttctagagaccacctggaactcccagaggtaacagaatactgtcttgaaagcctcagtggaagaaatgccccacatttgcttgttgctttctattggatttatggaatttccatcttttaaaaatgactttaaagcatttaatagagactttcaggtaaagagcaaaagtttttaaaatgtattatttaaagtaagctaaatgtggctttacttaccaagataagctttcctcttctatgaccatatagtaactatctgcctttgctgcagtctttcagtctataaactctgtatcttggtatctttcctccctttagtttctactcttagattttacagaatacccatagggaaattgatttcctgaagcacttggtaaactacttgggcctgagctattgtgttgtccttactacttggtacagattagattgttctttgctagaggggtggaaaggatgccttagtacagtcttaactttgctatggaaatattcttgtttaatatgttaagggacaataatttctggtcttggcttttaaaagtgagcatgctttttaattgcctctttcatggttattaactgagtcttcattttaattaccacaatggagtacttcagttctcttatttgcttcattaccttttctccttggttttgaaaataatgttagagaaataaaatcagattgtttctaatataatgaaatgctttcactacactattaatgaattcgttcttcattaccagcacaaagctagatattgcaaatctttttaaacaaataaaaactgtttagtcttctgattagagcagacaaagagcacagtaaaatttaactcacctggcctgatccctttttttggtttttactgagctgtcttcactggaaataggagctatctttgacttaactccttccaatagaaggaatttcttagggaggagctggaaggatctcctggggttctgattcttaattttcagtttacagaaatagccagataggtgttttgagcctggacttcttgctgcatcttgtattgaagacatcatggtgaaatcgataagggcagtggacagtggatcaagagccctgaacaggtctcttgaacctgaacagatttgccacctgttaatttatttttatgactatggacttgacatcacctttgtctctgtagatgtaattcagttgaactaatggttattgagcatttactgtttgcaaaaggcagctggagatattatgtccagtttatatttactaaatgttttctttgttgttaatttagcctttttctgcaatgtttttggtcagtagtaactctgggcaggtgagggcaattacattgtggctggaaaatttgtactctgaagttgcttttattggtgtgtaggaaaaatctttattaaaagtcatagaaaaaaatcatttaatttataagccacaaaatcagtactattttgtaatatgttgtaattcacattgctactaatttactaagtggagtcagtggaaacccataaatcctagtagtagtgcctaagtagtagaagaacgcctatggtttactagttgattgaaaattgttctttttttgcaaagtggaaattaacctggtgtgctaatttgaaatatgtctaacagtgactatttttatattttaacctaagtaaaatatctcagcgttatgatggtgtgtttactgaattagtaatcatttatttctaaggactgctgctttccttcaaataccattttggttagaggcttattgattcaagtattgttcctaattgttgatttacagggcagagagagcaaatacagctttcagctctgttgaagcagggtcattcttggaaactaatagtgtcagatgaaatgcctcagatagtgtaaaagaaaataattgggccaggagtggtggctcatgcctgtaatcccagcactttgggagcctgacgtgggagaatggcttaagctcacaggttcggatcagcctgggcaacatgggaaaacccatctctacaaaaaactaaaaaagttagctgggctacttggggggatgaggtgggaggatggcttgagcccaggaggttgaggttgtggtgaactgtgattgcaccactgcactccggcctgagcaatagagccagaccttgtctcaaaaataataataataattgaagaaaataaaaagggacctgaattcagaagaatcctgttatatcttaaatccttatttcttgatttatatgtactatgatgacagctttgctgatgaattataattacaaaaatgttacataatgttgttagcatataaagactcgtgattgagctaccttgcaacactaatactcaaaaagaacacacacatacaaaaaactggatttattcagtgtgaaataatgtctcttgaaattatgagaataaataagtatgttcaaattaattttgtgcatacaccagctcatttatttagcctcatagtagctctgagaaagaagggcgagtgaacagggagaggttgtgtagggaggtaatttttgtgtctattttaaactaaccaattgaaaccaaatcacacaactgagttcataacagaaccttcactggaccaaaatcatatctttaacctctctatccaagctctttcattagagaatgttgtcttaagtaattttcacagatttaccttgtatttctaaaacttgaattatcattattgcaaggagctagaatatatctgcctattagtgagtctgacttttaagtagatcccatatataaaaatctcatattataaaatataatttattatgtttatagtttagagtaaagcttcttttagtaatgagacccttctatatatcttgctcatggatatgacacattttctagtcttttgcaggcatcaactggatagtataaaactaggatcagtggtaactgacaagagctatttggtaagaaatttgaaaattacaaaactatggctctgtatcccttttatagagtcccataaatctctttatatttgttgctattctggaactatgctgaataacaaaggcttagctcagaagaggggttttctatgaagttcttttcatcagaataaattcctgttcatttcagagttgttgctttattttttttttctagatacgtactctgataaacctaatcttgtgttaggaacataaataccttttctgttctttagtgtcctctgcctttttctggaacttttatgagcaagttattttgaattttccagacttttaagtattatttggacaaaaaaattgggctatggctctgagctttttcagtgtttaatttactgttatcagtacagtcattcattttctcgtatcacccttcaagtcttccattgattaccttatatgtatagacctttctcatttcagaatcaagcataatggattttccctctttctttatgtcctctatgacataaacagaaaagaattaatatagtctatcttcagcttgatttgagatatactaagcatcattcattaagccgcttgtacagattgcccttttaggtctcagctcttgtgctcaaagctttaggttctagtcaaactctgttctcaacacagtgaatatactttcttaaatgcagatgtgagtcttcttttaaatagaaaatctatagtttccaaactaaaggtcagatgtttcaattattatgttccttcactctttttttccttaaaaaagaagaagaagactaacataagatgtaatagtaggggaaattgggtgttaggtatatggggattctctgtactatctttgcagtaattcagtacatctaaaaactgttctaaaagaaaaggtttattgaagaagatatgagggacattttctttttcattcatatgaattttagtgatattcaggtactctatttctcatgaaaatctgacaaatgtcactgttgtttgtccgtacttttgatcaactgagtcaataataaacctttgaatcagttcgagaatattatttattcccaggatccttatataatattgtacagaaattaaatgatacagatctcccattcccacatgataccacactcctctgtttctctcagatcttttgtggctatagcaacaagtgtgagaatgcttattgctttaggagtctgccatgagttcacattttcaaagaatcagcaactctactacttgattgtggaaacaatattgaccaaatcttgctgaattttatcagggttctctcagattcaaaaaggctcttaactcttcctaaggtacttgatggtatgggttctgctttgatctaaaaaaagaccagcttgctgtgacacatttgaatatgaaaggtacttcttctggaggtaacttgtagtttcccttctcagtctttcctttggaatcattttatagactgcagcttttgtttctagggctctgcttgacaggacagataatatccctggaaaatagttttagagttgatgtttggtgactgcattattcaaggctcatataaattgagaactggttacattgcctcttgctatgtaggataaaagcttctgttcttggaattacccgtcctctctcttgtagacaaaatagctaggaaaactgctcagactgattttgttatatgaagaactaagatgcctaggaataatttagcaatagctcatccaaattaaagcagagttgaactttagaatggaaaaaaaaaagaaattatcatgttagctaaacatttgctgtctggatctcccagttaaaaagtggcataatacttctcaagttagccagtatagaacatgttccacattcagttgtgaaaatggctggtagctattatcaagtatgattttttaaatgttccatgcctgatattttgtaattgttgaattcagatatccctctactcagtggcttttacttcataatgaaaaagtagatttggttgtaatatataaaattgtgaagatagatggaattaatagagaaattagagtttttcttttaagataatttgagtttcatcatagaaggtaagctcagaatgctgaaatgctgctggaataaatgaactgttttacttttttcataaagatattgatgtatgcaactttgaattcagagatgattccatttgcatgttctgagtgatgaataagtgaaagaaataaaagactgaggaataaagaagtgaaagaaagaacttatacactgctggtgggagtgtaaattagttcagccattgtagaaagcagtgtggaaattactcgaagaacttttactaccatttgacccagcagtcccattactggatatatacacaaaggaatataaatcattctaccgtaaagatacatgtatgcatatgttcattgcagcactattcacggtagcaaagacatggaatcaacctaaatgcccatcagtggtagaatggctaaagaaagtgtcatacatatacaccatggaatactgtgcaaccataaaaaagaatgaggtcatctcctttgcagggacatggatggagctggaggccattatccttagcaaactaatgcagaaacagaaaaccaaatactgcatgttctcacttataagtgggagctaaatgaagagaacacatggacacagatgggcaccacagacactggggcctatcggagggtggacaatgggaggagggagaggatcaggaaaagtaactaatgagtactagacttaaaacctgagtgactaaataaagtgtacaacaaacccccatgacacaagttaacctgtatacaaacctacacgtgtacccttaaacttaaaatttaaaaaaaaaacaaaatgcaatgttaaaaaagagaagtgaaagaattttttaaatgtaactgcttaatttcacattgtttacagttcttctcaagtaagcttcttttcactgcaatctccttaaatatgtacatacggttttctttggattcactgaaatccaatccagcaggattctttcctgaataagaaacgtactggatcagtcctgacctattttatgatttttggtacttgtcacctgtaaagagaagttaagggaacatcaccaccaaccccacagaaatacaaaaataccatcagagactatgttcataacactctgtgaacacaaattagaaaacctacaagaaaaagataaattcctggaaacatacaacctcccaagactgaaccgggaagaaattcataccctgaacagaccaataacaagttctgaaattgaatcagtaataaaaagcctgccatccagaaaagtcccaggaccagatagctaaattctgccatacgtataagaagacctggcaccattcctactgaaactattccaaaaaattgaggaggagagactcctccctaactcattctgtgagggcagcatcattctgataccaaaacctgggaaagacacaagaacaaaaagaaaacatcagtccaatatccttgatgaacatagatgcaaaaatcctcaacaaaataatagcaagccaaatccagcagcatatcaaaaagttaattcaccgcgatcaaataggctttatccctgggatgcaagattggttcaacatacacaaatccataaatgtgattcatcacataggcagaactaaaaacaaaaaaattatctcaatagatgcagaaaaggctttcaataaaattcagactctcttcatgttaaaaatcctcaacagactagccatcgaaggaacatacctataaatagtaagacctacctgtgacagacccacagacaacatcatactgagtggacaaaagctggaagccttccccttgagaaccagaacaagacaaggatgcccactctcaccattgctgttcaacatagttctaaaagtcctagccagagcagacaggcaggcaagagaaaaaaattaaaggcatccaaataggaagaaaggaagtcaaactacctctctttgcaggcaatatgatcctaaacctagaaaatcccatattccctacccaaaagctcctagatctgacaaacaacttcagcaaagtttcatgctacaaaatcagtgtacaaaaatcagtagcatttctatacatcagtaatatccaaggtgagagctcaatcaagaatgcaatcctagtcaaaattgccacaaaaagaataaaatacctaagaatactgctaactagggaggtgcaagatctctacaaggggaattacaaaacactgctcaaagaaatcagagatgacacaaacaaatggaaaaacactccaggctcatgggtaggaagaatcagtatcattaaaatggccatagtgcccaaagcaatctacagattctatgctattcccatcaaactaccgatgacattcttcacagaactagaaaaaactgatttaaaattcatacagaatcagaaaaaagcctgaatagccaaagccatcctaagcaaaaagaacaaagctggaagcaccgcattacccgaattcaaactatactgcaaggctgcagtaaccatggtatgggtaccaaacaccatggtacccataccatgtatcaccataccaaacagcatggtactggtacaaaaacagacatatagaccagtggtacagaatggagagtccagaaataaagtcatatacctacaactttctaatctttgacaaagctgacaaaaacaagccaaggagaaaggactccctattcaataaattgtgctgggataactggttagctatatgcataagattgaaactggaccccttcctttcactatatacaaaaattaagtcaagatagataaaagacttaaatgtaaaacctaaaaccataaaaactctagaagaaaacctagggaataccattgtggatataggccctggcaaagattgcatgatgaagacgccaaaagcagttgcaacagaaacaaaaattggcaaacagaacctaattaaagagcttctgaacagcaaaagcaattatcaacagagtaaacagacagccaacagaatgggagaaaatatttgcaagctatgaaaggtctaatatccagaatctataaggaacttaacaaggaaaaagcaaccttattaaaaaggcaaacacttttcaaaagacagactcttttcaaaagacatatacacagtcaatacgtatcaaacatcactaatcattagagaaatgcaaatcaaaatcacagtgatataccatcagaatgaggcaacagaatgctgttattaaaaagtccaaaaataacatgctggtgaggctgcagagaaaaggggcatttatacattgccagtggaaatgtaaattagttcaaccattggaaagtggtttggcagtttctcaaagaacttagagagctactatttgaccccgcaatcccgtttttgggtatataaccaaaggaatataaatcattctgctataaagacacatgcaattaacatgtttatcagagcactatttgcaattgcaaagacatggaataaacctagatgcccatcagtggtagactgaaaaaagaaaatgtggcacatatatatcatggaatagtatgaagccataaaaaagaatgagatcatgtcctttgcagcaacatggatggagctggaggccattaccctaagcaaactaatgcaggaacagaaaaccaaacacttcatgttcttattaaaagtgggagctaaacattgagtacatatagacacaaataagagaatagtagacactggggcctacttgagggtgaaaggtgggaggagggtgaagatcaaaaagctgcatatcacttactatgctgattacttggggtgtataccaaaccccacgacacacaatttatctatagaacaaacctgcatgtgtacccctgaagatgaaagattaaaaaaaaaaaagagcagttgacctctctgtacaacttatctttattttcatttctctttctccctgacagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtaaggagcttgtgcagcatatgagatctctgggctgtttcactcaattaccagattattagatttctaggtagaccttcatggaacatacttatcttttcctctggatccatgaatactatacattatccagataaaatctagaagaacagtattttatcttaaaagtattttattatgtatttcatttctgatgctcatttttatgtgaatttagcaaaatcactgagtttttttcagggagcataatttaatcttttaataataatgatatgactttcactctataagatgatttcacattattgaactcattttaatatgaagtaatcatcatataaagtagtccagtttatatggactactatatatgagtagcatgagcatgcatgagaatcatctggaaggtttcataaaactccattttctgttaaggaaggtctaggctgcagcctgagagttttaatatctgacaaaagttttaggtttagggaccgtgctttgagaaccactgaggtggaccttgctggtaactttatcttcaaatgaagcctaatttgtttatgtgattttaattgtattcaggaaacatttaatgaatagtaatgtgactaaggtactatactaggcattataagcagatagaaacatcagtaagaaatttcctttctctccaaggaagtggtgaaggagtagaatatagaaaagaatttcttaccgctagtctagtgcttttctttctacaatcatgatctttaagatctaaagttgggctaccttgttaaaattgtggctttattgttttgtaatcttggacaagttacttaacctaggtcttagtttccttatcagtaaaatgaagagtaatcactttattgaattgttggtagattaaatgaaataatatatgtaatgcacttagtactgatatatgaacttatatctagtaatttttagctattatgaatagcctttattcattaaacaaatgtataatgagtgcctacagtgtgacagatactgaattaagtgatcaggataaatactaagcaagacagtacacatcctctgcactcatatcttgtgggaagtccaacatttttcaaaaaactgaggcacttcagttaatatcatttattgtggggctaagcaccttttttcacgagctacaacactagatacgaaatagggagctatgtcatcagcaaagtaactttggttccttcatttcttttgcctcctttgaaaaaaaatcggtaatatctgactctttgcagaagtgtcatgaaacttaattgagtactttctataaaatactttgagttgctctgcaagaggtcctgtatggattaaaagtattgtgttttgtcttctgtagggtgttttagaagccttattttatatatcacccgattttttatttttaactcacttcagattttaaggtgaacctctttatctagaacctagttaagctttagttttaaggttatatcttccactgatctggtctgtacttttcacggctagtgccaacagattagttataaaggttaggaagatactaaatttgtcattcaggaaaagaaactctaccagccccactatggctaacttttttcatttcatggacttagttcagtttaaacttccttgattgtggaaataatagccagggccaaactatgtttccctggttctagggggagacaactttttgtatggtagtcagaaaagtgaaaagttacagatttatcaggtttaatatatagtttagccctgcccgtgtgctacaagtggttatttggtttgtttgatttttaatccttacttgtacattttgtagtcggtagtggcaaccacagggtatgaaaatttaacatggcttgaatttcaaacactcagaatttcttaatgttacaactaaagaggatgtagaaagcatcctttctttattcatctggaatcaaaggcctagttaaggctaaatgacttacccagggtcatacagcttataaatgccagaactctggttagcacattcacttgtacatacccccagtctaagtccttatcagtaaactcatgccaaacactttacctcgttactagcagaataatctaccatcattactagaagaatgatgattagaggcacagaaactgcctggaatatctaggaattaaataattttaataatttagataccaatcttttatctgaaaagagatttcttttaagcttagaatatttttgtttttatgaagagtatggctgccatcaatttatctgcttatttacattatctatatatgtgccctttagagaaactattgaacatatttccaagaattagaggaaatagtgaattttaataagctccttgactttaattctttagttagtcataaatcagctgtgtctgttgtcattctgagttgtacaaaaaatcttgggatatttcctttgtcaccattactgtgaaattattattgttcatacataacttgacatgatgtccttgcagatggaatttagtaattcttgttcaagtctgtccaccagtgcaggaattagtttgtacagtgatcatttcatagctatatcataccttattatggttggtgtctatttttctcctccattattttatgtttgtgtgtgaaactatatcctttgtaccaagtaaaatggttaagtgaaggaaaatactaaaggtaatgcttccagtaaaaagtaatcaaaatatttcccatcacctgtacatgccatgtctattcctaatagtttatgtgccctaaggttgttgatgaaatgatcaatttagttttttacaccacaagatgtttcctcagcctgaactaactacacatactagacctgattcttccacatagattgcttgtgataattcaaaatgggaatcttgcctttatgtttaatagtttgaagtacctttcaacaatatttatttattgttttttgttttgtttttagagacagagtcttgctctgacacccaggctggagtgcgggggcatgatcctagctcactgcagcctcgaactcctgggcttaagcagtcctctcacttcagcccccacagcacctgggactacaggcatgctccatcatgcccagctagttattttattttttattagaaatagggtctcactatattgcccaggctgatgtcaaactcctggcctcaagcagtcctcccacctcagcctcccaaagtgctgggattataggtgtgagccactgtgcctggcctcaacaatttataatttggttttttaaaggatattgactattttaggctatatatgatgactagctttcaaaatgcttttctagcttatataaacaatattgaatagatgatttagtgatagagaactccacttaaattcagttccccacttcaatctttttccttgtaaaaattaaaaattattcaccttaacagttaaactacctaggctgttctgtctttccttctcttgtctttttcccactgtcttaataaatacataagttaaactgaattcttaatatgataaatgtaattggaaaattttatttgtaaatgaaaataatgactagtaaaaaaataatttataaatacgataaagtttgatgccctggaggcgaggtgcctggtttaaatacatgtttaggtagatgaccgtttggtatatccacttatctaaactgaacagttaccttctctccatgcctcatttccaaaaggttttagtcaaagagttttatttgacatccttaaggtttatgtggaggcaaccttgaaataaaagtaattcaattaaagtatttgctatttgctagatacctatgctgtactacatgaagacagacacagtctctttcgtgtaaagggcagtcaagggggaaagatagacaactgaataagcaattaaaatatgttgtgctaatgtggtggtatggttaagactaccctgaagcaaatatctaatgcatatttggggttcttttggaagaaatgatttttaagctgagacctaaattatgagtaggagtcaaccaggtagggacatggtggaagaattttctgtcagtgggcacaacatgtaaaaagacaggcaagagaacatggagtcactgggggaactagtagtaattcattgtaaagcttgaatactgagagactagctaatgtttccttttaaaaacaagcatcacttacaggatttccattttgatggttgtgtattcttgttcttcactaaaactgacaggttttaattcgagagtcaaagctgtttttttgattttggtttagagagtagacagagttataagaaattgatttcagatgacttttttgttatctcataactattaaactgtttattcaaatatctcactcaggtcagaaggaaaatctttagcaagtagaacacaaatgaaattatactttcagtctttcctttgatactaatattttaacctttacaaaactactaagatgtctgttggaatcatctaaatattctaaccaagttgtatccttaataaggattgacgtcaggtagactaatttataaactgatattaagcaataatgtgattaagaatatatagatataatatacatattaggctatagatatgcatatgttaagtctttttacagtagtattttcagtctttgataattgtattaatagaaacttaaaacaagtacatttactatttttgatcccttatgctgcaaaaaatcttgatttctctgtttaggggatctgagggagaggaaggatattagactgtgagtctgatccagttctgttgtttttagctttctgaactttgtgaattaacttagcttctgaacctcagtttagctctttaaaaaactcatgatactcattatctacctccctgtccacctggaatatattattaggttataacctgcaacaacaggaaagttatccttttattctgagatgaaaatcatgcctttataagagcttcatatgtagttttctgtctaagttaaatggaaaagttgaaagaaatacagagaagcaagataacttctgagaataacttctagacattcagaatatctctatgcttaataaacccacaatttaatcaaaataaaattctgggccactcatagagtctctccgcagctacctgaagccttcagcagttttaagtattttttctatctcaacatacctaagatagaaggtatactctttcttatgatagttattctgtgtaattagtgaaactggctttgttgcagcaaagatctggttgtgcaggaggctatttggagagtgagttggtaccacatatagttgaaaagctagctgtctcctctccaagattctagtaggtttctctgccctttacctgactccttttagaatcattaacctaaacaagtatcattgcaggtacataaggacttttgattcaactgctataaaacttttttgttttactacttatgggccacaaaagaaagaaagatctttgcttcaggaatttaaaattccagttagaatatacttaatgtctcagaagaagttaagctgcttttcaccattacatcttctttcatttcccacttaaggagatagaagtctatggtatctcattaaaatctagtgggatcatcaggaaatacaggaatagggaactgaagctttgtccacattgtagccttgacccttgtgagcctacactcttacaattacagatatttattttcgtgtttatcctgtaagtgcttctcagattgagttgtgagtaaacctggggaaagtgaattagagatttgcaacctaccaggataaaacatggtacattttcttggactattaattttatttactggtaggtaagctaaatcattttcaaataataaaacaagatctgtaatggtataaaatgaaaatttgatcaaactccagcccattgattgaggccagacttcatattctcagtagcatgaatttaccttcctctgctgttaggagcattttggtggaaaattttaagaaacaccattctatgagttttttagctgtttatttcaccttgacagagactccatatgggagcaaagcagcaaggtacttctaggttatttaccttctaggttatttacacagtgccaagcgtttgaccagagcacattagatgtaataagagaggccgggcgcggtggctcacgcctgtaatcccagtactttgggaggccgaggtgggcggattaccagaggtcagaagttcaagaccagactggccaacatggtgaaaccccatttctactaaaaatacaaaaaaaaaaaatcagcctggcgtggtgatgggcacctgtaatcccagctactcaggaggctgagagggaagaatcacttgaacctgagaggcggagcttgcagtgagccgagatcgcgccactgcactccagcctgagcgagagagcaagactctgtttcaaaaaaaataaataaacaaaaaataaatgtaataaacaaaacctgtctccccagatccccatccaaatttcaaaacattacccttctagctatgtgaagcacttttattaaactgtagattttgttttgaaaaaatagtctattaccaagaatgaatcttttaagcaatttattctcccctttttagaaaaggttctggcagaatgagttcagagataaaaggacgtgtgacttaggaaaaagcaatacgtatttagcatccacctcactatggagtgtaaactatttcattggaaaagtttctgaaaaatctcctaaagtctatttaggacctatccaaggttgttagagctagagatagaatccaggtgttcttaatttcctgtggggtgtctgggccacatagccttgataactgtctcagaaattatcagtgtttttataaatactgatatacctattatgatagatgtattccttaaagatttggcataaattattacaaattgagtcgtgtttgaaacattccagcggagctagattacaaagtaaataatcttttttctaataggagctagtagtcggtcccctgagtcaccccccacccctccttccttcttccttccctccttcccttcctttcttccttttgtaagtatttgggtttttctgttttcctcagacatacttatgtgaatctttgagtctcagtcacagttgaccttcaactcaaacaccaaagtatagaaaaagaagattgcaatctttcagtagcattttgataacagagtcttgtttgcttaaaacatgtggatcacgttagagtgattctacaaacaagataattgttgacattttgaagaaagtaaagaatgcatcctgtcccttttggttagttttatatgccagagctctgagtatgatgtgaatctgtaatttctttgtctcccttccccaggattatataaattgtaggctaatttcatggaataggaaataataaagtccgtgatctttagtggagttatacatatttttttccctccaaaaggttgttactcagtaagaaagttctatagtggtttatacatcagttccattggaaagaaagacatatttgtgtgtgtgtgtgtgtgtgtgtgtgtgtgtgtgtgtgcgcgcgcgcatgcgcgcgcacgtatgtgtgtgcgcatgtgtgtttttaagtaatagactttattactcatgcatttttgttgccttagcagaaggtcaaaagcagattacagaatcataaaccttcttagatgatactttggtatcaggcttctttcttttgttttgcttccccaaatacaaagatcaaaaatattcttagcagttattgaaaataattagagttgagtcttccacctcttcctaaagaggtcctccttttgattcaatttaagtttagtctcctattataagtagccattaaacttaatgcaggttatattctctggaagcaagaaattgcaactagtgatactataagtcatactgattttcccaaaagatatattacaattagagttatcatttttgttcagattttgatatccaactttacttttgaaaaagtacaactgccagcaaatactgtattaggtataaataatgggcacatttatatttataatgtttttaattataaagtttctttaaaaaaaatggatcagtaccataaacagggaagtacactagtcattcagtaaaaatttgaatgtttctagatgccatgggaaatataaagatgactcttcaggaacttgtcattgagtatcatgagacccatacatctgtaaatgtaaaaaaggtagtgtcataagagaggtataaggtcctgtgggccaccagagaatagaaaaactgtttctggctaaagcaatcagagacttcactagatccatgagctgggctcttagagaatgaagaacatcatttaccaggacagatcagtgtcattgatttggagtcagaagttattagctgtgttactttgggtagtgtcccttaacctccctgttctgtgtaccttacagagttgttatgagcattcagagtgataatatatttgacagtggtttatatattctaaatcaccatatgttattattaccactttagttttatgggaacaaagcaaaataacaataatagcatgattgggttatagagtttcagcagggcttcttttaactttaacagccaacattaatgaaactcagagctacttgatggctttttgtgtagccatcctcccaaagagagccagctttggctccctagctcccctagcccacatgaggatcattctccacttctgttgggttttatttaggttgccctgtaaaaatctcagtgtctaggctgactaaacatcaaaaatatgctcctaatcaaggagctgaccagtttctcttagtttctgggacagggttgccttcttagctagagccatcgctgaccccagtcagagagctctcctgacaaaacagtcttcagatagtctttttaaggtctccaagttgataggatgatggctgggagtaaaggggggtactaggaataaaccattttgtcttggagctctaatatgtatataatactaagagaagcaaaaataggcccctgtgaagcctctactctgtgggagctaacgcttaggaatctgaacataccccaggtaggaatttccacgtaaattttacctaaaagtagaaagggttttttcatttaaaagtctttttttctaaacactgcaatggaattgtacaaatcctaaggatctgaatattagaaataaatacataacagtgagggcctttgactgagaaaacatccctttggtatctctctattgactggaaggagctacataatgccagaccagcagagattatgtaagcaaccaaaaacgtagtattgaagcactgcagcatgatcctttcctctctaggttttgggtcttgtatattatatttgaagctattatttagtgcatctaggttctggctaggaatgaactggaacatttcagtgggattttaaggcatggtgaaaaaagtagttgatgaaagagtaaatcaccgtgtttttctttctttgctgccactgcccatcttgctgtgttcactgaaatcaagtgtaggagttggggagtaggttaaatacctgcctctgctgctacatctggcaaatcttgatccatataatttagaattaataataggacattggcaaaaataggcattatactgtatgttcctcttttctagattagatccagtaccaaccatggggccacccaaattgagacattagaatctatacagcaatctttctgcattctttggaaatataatacctagattgaattcagaatatgttatctacattttaaaagttatatggtgtctctatttcagagggaagattaatattttatggcctgtcataaatgaccatcttagaggcacccatttgttttatgtatgcattaataatggaaattgagttcattcaactattgtaatttttgtacatctgtatcatgatttatatattgcctcattgatgagcatgtaaattatttcaagtttttgccattataaacagtgacatagtatctttatgcatatctctttgtgcatatatattaattttcctagggcagtgcttacaaactgtatcacattatactatatgtaaaaattatttttactgcccatattatcacctgggggatggtggcaaagctacagaggtctctgacagtgtgtcacatataaaatcttatgctctaaaaaagggcttgacaaactatggtcctcagaccaaatttagccccctacctatttttgtaaatatggtttcattagaatatattcatgcccatttgttagtgtgttgtctatggctgcttttacactacagtgacagagttaaatggttccaacagaggaaccattgtatatggcccactgtattagtcagggttcttcagacaaactgaaccaataggatatatagtgagatagagcctgaaagatgtattataaggtcagtaccttataattagctcacacagttatcaagtctgagaagttccacgatctgccatctgcaagctggagacccaggaaagccagtagtgtattatagttgaaaggccagacagagagctagagggctgatggtgtaatgattccagttcaagcctgaaggcctgagaaccaggagtgccagtggcagaagacagatgacctaaagatattctcttatgttttcttccagaaactttatagttttagcttttgcatttatgtctatgatctctctagtgttaattttcatgtgtcacataagataagggttaagaccattgttttccgtatttttattcatttgttctagccttatctgttgaaaacttttcccatttgaattgccttggtcccttttgtctaaaatcaatcagtaatatatggatctatttctggtttctccatcctgttcagctgctctatttgtgtctatccttacactttaaatttttatcagccatcagatatttcacagcatgttgattagaaagctgtacatatgcctagaagtggtattgttaggtcatatgaaagtatacgtttctttaacttgcctacatatgcctaatccctctatggaaaaattatttcagtatctcctctgctctcagaatccttctctttttaatctgtcttccacagtgccatcagaatgatattttcgaaaccaaatatgactttctctcctaaggccttccatggctgcttagtgtatagaaactccttgcttagaatataggatataagctccttcacataaacagcctgcttttcaaaatgtgccctgcactccataattcactagtccacctacaaatgtattccttgaaagttttgtgtacttttactgatatactgggaacatgtaattcttcctctctagagaatatctttcctccacttcatcccatgaaatcctatttatcttttagtatcattccctttgtgatatttccctccaattgtccccatgttttcactgtatttaaacagttcatgtttctttgagtatactgtgagttctttaagaagcttgtcctatttatttttgtttcctcattgcctaatactactggccaatacttgttactcagtttttttaaattaaattgtctatgataagcagaatggtccttgaaaaattttaatctccttctgaatctatcaaataaagaaaataccaccttacctatgttattcaaaggtttctggtgaagagcaaatgaagtaataggcatggaaatgtttgaagaatgttttaaaaatgtgatggccttattgttgtttataacaaaatttcactagaattaatcctcttggtttcttacaagctttattatggtggaactttgccttcatatatttgcattggttaaaattatcctaatattaaaagactttaaagatttttatttctaatgtttccagtaaaactgaaaataacttagttaaaaaatatttttgcatttaaaactatagaaaataaggcattttctttataaaatctcagttgtatgtgtgtatgtgagtgtctttttggatatctttgattcagtgaatatactgagtactgctcagttcaggcactatgatcgtgatcacattacagtaatagctaatatttagtgaaccatactacgttactgtgctaagaacatcacatataatctaatttaatattcacaataacccttattatccacattttatataggtaagtaacttgccagaggtagtacagccgctgatacagaaacccagtctgacttcaaaacctgacctttaaatattgtgctcagggatcagcaaactataacacccacagcctggttttgtaaggcctgccatattttcaacaggttgttttaaaaaaaagatgtgacagagacatatgtggcctgcaaagcataaaatatttactatctggccctttacagaaagtgtttgccagcctaaagatggttaaagagagtccctgtaactctggaagctcccaatccaaataggaaataaacacaaacattttaaaagtctgcctcaagaggcaaaatgtggttagtgatgttattataaagatttaaacaagaatcccaagggggccaggtgtggtggctcacgcttataatcccaacactttgggaggttgatgcaggaggatcgcttcagactgggagtttgagaccagctcatcaacatagtgagacctggtctcttaaaaataaaattttttttaaattagctgggcatggtggcacatgcctgtagtcccagctacttgggaagctgaggtaggattgcatgagcccaggagtccaaagctacagtgaactaggatcatgccattgcactccagcctgggcaacagagcaagaccatgtctcagaaaaaaaaaaaggaaccccaagggattggaggttgtagtcattccagccagaaaacttagaagaaatggcatttgaactggttttgaaaaagttgtaaagtgaccagacatcttaggtatagaaatctgcacacccggagtacttggcaggtgatgataaaaatacttgcccatgacatgccaagataccagaactcctgggcattatttttccttctacctcttatttgctgaattatgtagaagagtgcatcaaaacatctgcttcttagtttagcctttagtcagttgtgaataaaaaattggttctgatagttatcttgtatttttcaagtgaatcaaaaacaaatctgatagagggtgcttcagtgcaagttattttttaagctgtaaaaatgtgaaaatggtagtgctttagttaaataaaccttgcattttgtattcagtcttagctgtcattggattggcaaaactgaaaaccaatgtttacattcacagtaattgcaatttttttttttttttttgatacggagttttactcttgtcacctaggctggagtgcagtggcaccatctcggctcactgcaacctccacctcccaggttcaagcgattctcctgcctcagcctcttgagtagctggaattacaggcgcccaccatcatgcctggctaattttttgtatttttaatatagatggggtttcactatgttggccaggctggtctcgaactcctgacctcgtgatccgcccgcctgggcctcctaaagtgctgggattacaggcgtgagccaccactcctggccaggtttcttatttttaggaattcagcatgtaattttataatgcatttgcattaatttgggagaaaaaatgaaaccatgcttttgaagaatattggcaaaagttgtcaagttaagatagaattgcttgttaggaaactttttaattgaattgaggaaatgacacaagattggcattgttattactcaacccttgattgtaaacagtgccaaaaatataataacactgccatgaaagatttatattttgtaaataaagcacacagaaaaatattaaactacattgggagatgcattttctgccaacataattaagaatattacagttaaataatcaaatatttggatattgaggaattttattctcaaagagaaaaaaggatactttatgtggattgaaaaatattccagacaccaaaaataaaagcagaggaggcataaagattccctgattttacagtttgtgtagaatagcatccattgtatgaataatgaatattatgtctatattcatgacatttttttaaaatctgataatagcttcaagctgtttctttttctgaatatcattaatattaatatataatcattaaactaattaatgtgtatgtgggcaaatcactgttccctattctattgtggatatataattgaaattaaatgtttctcatttgaataagtgaaatctcttctttgaacatttttcttagcctgaaaagaatatatattaatgataagtagcaactttggtttctttgttatacgttggtgcagatattttggttggcattgattttatattaaaaatatatatatattttatcgcattttcagtttgataaaaagacttctactataataactataatatacccttaaatatttatcagtacatattcctctgtattttagtagtggaattatctatgtaattgagtgaaaacaggagtaaccacagatgcataaaaaaacacatctgtaaattattgcatttgccatcttttattaaagactgccttgcaattctgtttcacggaaatgaattaccagtaggtctttagagtatgctaagatgacgaaaagggaagaaggaattcttctcaaaagatttgaatgtagtctttgagttgtagctaaagaatagtctgaaccctctatctactcatgtcattctttaaaaatagtggaaagaaatggttccaaaagctatattttgaagctattatctgttgtcaagggcaaactagcattttaaagctattgctttgatatggtttagctttgtgtccccacccaaacctcatcttgaattataaccccgaggtgttaagggaagaacctgatggaaggtgattgaatcatgggggcagtttcccccatgctgttcttggtgagttctcacacacttcgtaagcatctggcatttcccctgctctcacttctctcacctgccaccatgtaagacttgcctgttttgccttccaccatgattgtaagtttcctgaggcctccccagccatgtgaaactgtgagtcaattaaacctcttttctttataaattacctagtctcgggtatgtcttcatagcagcgtgaaaatggactaatacatgcattttggtaaaacagtatgttattatccagtttcatgtttaattagtttaatttaaattaatcaaatgccattttgtattaggggccacaggtaagagaaactcacagaaaaggattgttgaatttgtggatttttaaaggccattgctgtctcctttcctgcctcctctctatatttaggctagtgactaccagaaagaaataggaagataaaagctcacacttaaaacaaacaaacaaacgaacaaacttattttacagtcttttatcaatggagtatgagacagcatatttttgcaaagtaccgctccatttcctaattcaaaaaggagatttggacacagttttccctggcagcactgaaataagaatttgctttctctcagtggccgtataaaacagtgagaataatgcagtcaactctctaaattaatttaaagaaatataattgtagatagtttgaaatggtaaatattcaaaaaattaattttccttcactttggacagttgtatgccatgctattgtaggttaaccctattaccagaaagggggtcccaatccagaccccaagagagggttcttggatctcacacgagaatttggggcaagtccatagagtaaagtgaaagcaagtttattagtaaagtaaaggaataaagaatggctactccatacgcagagcagccctgagggctgctggttgcccatttttatgattatttcttgttacatgctaaacagaaggtaaattattcatgaattttctgggaaaggggtgggcaattcacggaactgagggttccttcccattttagaccatatagggtaacttcatgatgttgccatggcatttgtaaactgtcagtgatgctggtggtagtgcctcttagcatgctaatgtattataattagcatataatgagcagtgaggatgaccagaggtcactttcctcaccatcttggttttgatgggttttggctggcttctttatgcaagttgttttatcagcaagacctgtatcttgtgctgaccttctgtcttatactgtgatttagaatacctgacctcctgggaatgcagcccagtaggtcttagcctcattttacccagcccctattcaagttggagttgctctggttcagatgcctctgacaactccagagtagagaagtggtgaacagaggccacagaaatgatgagcagtctacctaccatgtggagaagacacctcagaaatggagagattttatatttttgttgcatgatggtaaacagctgtaaccaccagcttggcctttttggcagctggctttatttagcattttaagctttaagtttgcctctggtgcctggaattgttcaattaaaattttaaatttattcttatcatcctctaacacaaagcttacttatacaataccaaatctagcctgagacacttgttcttgaatcgattcttttttaaataataagttcagtatgaaataaatctctgctgaaatgaaagaaagcacccattatcatggaactgtggttcctgaaagctacttaggtaggttaatagttgaggcctattaatggatatgccatattattacattaaagccattctcaatgaaggattaaagttgttagttttaagagttgtttttgttttgttaagaacagtttgtacaatgattgatttttgtcaaagaattgaaaatgccatctaatacaggtagggagaggaggttgattgtcagtttgatttaagtcttaaaagttcatcaattagcaaagaacaagaaactgtttttttaagagggcaaattttatgtatctgtttaccatgaaagagaacttaagagaagctgtatttccacttttatcaaattagaacctttatgtcaatattaaccagaaaatccttagttacaaacttgaaaacatctatacttaaggacagttgttctgttcattcaaacagaacaagtttcttcccaggttgagaagtcttaggtaacctgtgactcatgctttaattttaaactacttcttcatatggcctttcagttgaactaaaaaggccttagatttagtagaatggactctttgtgtttctaatttgtgataagtttggcctttgttagttggttagaggtttccttgaatcattccaggactagccctctctttagtcaaagagaaaaccttttcccatccttaataattttaccagttactaggtaaatcattccaggactagccctctctttagtcaaagagaaaaccttttcccatccttaataattttaccagttactaggatatcatccttttttacttttaatctttaaagagtttttctcagttattctttccagaaaatcacatggtgaggtatcattatttttaattaacatagaactgaagaaaaaaagagagattgtgttaattggacagtagtgttagggatcagaattttctggatttaattacatttgtatcatattgtcattttggtgatgccaaatctgtttatttagcataatttcctttaaataaaacttttaagtttaaagcaatgaacacctattgctgaaaaacccagaaagtacagaaaatccaaaaataaaaataccacttaaatatatatgtgcatatctatatgtattctttttggtcggttttgaatgaatatatttttaaatattagagtttatttcttagagcagttttaagcttatagaaaaattgaacagaaaataagagttcccctatataccccccactccccctaccccctgcaccaagtgccagccatgacttattctccccaacctttttaagagagtcccactctgttgaccaaactggagtgcagtggtgcgatcatagctcactgcagccttgaactcttgggctcaagcagtcctcccacctcaaccaccgagtagctgggactataggtgtgctaccatgccttgctaagttttaaattttttgtagagacaggtcttgctatgttgcccgggctggtcatgaactcctggcttgaagcagttcttttgcctgggtttcccagtgcactgggattacaggcatgagccaccatgcctaaccctctattattaatatttgtattggcatggtatatttgtcataatcagtgaagtgatattgatatattattaactgaaatccatagttcacattagggttcactttgtgctgtacaattctcttgcttttgccaaatgcataatgtcatttattcactgtagcataatcatacagaagtttcactgtcctaaaaatctcatgctccacttatttatccctccccacctgccttgccccttaacccctggcaaactaatcttttaaatctccacaattttgctttttccagatgtcatatagttggaatcatacattatgtgttttttttctgactggcttttgttttttttaaggttcctacatgtcttttttgtaactttacagctcatttctttttattgctgaattgtactgtattatatggatgcatcacagtttatttatccatttaacaacagttagttggtgctggaactggacatccacatgccaaaaaaaaaaaaaaaaaaaaaaaaaggcaggggagttgggattagacactgaccttatacctttcacaaaaatgaactcaatatggatcatagatgacatcttgattgcttccaattttttggcaattttgaataaatctaatgtaaatatttgtgtgcaggtgtgtgagtgggcatacattttcaactcacttgggtaagctgtagcagtgagattgctggatcatatggcaaaactatgtttagctttgtaagaaactgccaaattatcttccaaaacggctgtctatctaggctgttataacaaaatataaactgggtagtttaaacaacatacagttttggtgagggccttcttcctggtgtttaccttcgcatcgtggagagagaaaattctgtgtctcttcctcttcttctgagaccaccaattccatcatgggaactctaccttcattatctcatgtaacttaattacctcccaaaggccccatctcctcataccatcacactggaagttaggacttcaacatatgaatttgaggggagaggagggactcaaacattcagtccataacagtgattataccatttggcatttgcagcagcaatgaatgagagttcctatttcttcacatcttccccagcatttggtgttgtcactatttcagattttagccattctaatagatatgtggtagtattctgttttaatttgcaattcactagtgccatacagtgttgagaatcatttcatatgcttgtttgtcatctgtacatcttctttggtgagatgtctgctcaggtcttttgcccattttataattgggttgttagctttcttactattaagttttaagggttctttttatattttggaaagagttcttatatattttggttataagagttctatttatatataaagttgagttgagttggatataagttctttcatctgtgggttttcatttcattctcttaactatgtctcatagagcagaggttttttgtttgtttgtttgtttttttgttttttgttacagagtctcgctctgtcgcccaggctggagtgcagtggtgcaatctcagctcactgcaacctctgcctcccgggttcaagcaattcttctgcctcagcctcccaagtagctgggactacagccacatgccaccgtgcctggctaattgttgtatttttagtagaaatggggtttcaccatattggccagactggtcttgaactcctgacctcgtgatccgcccacctcggcctcccgaagtgctaggattacaggcatgagccacagcacccagccgagcagaggttttcaacttcactgaagtttaacttctcaattgttttattttatggattgtgcttttggtgttatatctgaaaactcattgccaaatccacagtcacctaaataatctcctgtgttatcctctagaagtgttacagttttgcattttacatttaggtctgtgatccatgttgagttcatttttatgaaaggtataaggtcaatgtctagattctataccctgtttttgtttgtttgtttgttgtttttgcaagtagatgtctaatttttccagcaccatttgttgaaatactatcttttctccattggattgcctttgctccattttcagagatcagttgaccatctctatgtgggtctttttctgggatcttctgttccattcatctatttgtctgttttccaatatcacactgtcttgattactttatatataaagtaatcttcaaaaaagtctttgaagtcaggtagatcagtcctcttactttgttattcttcaatgttatattaactcttttgggtgttctgcctttctgtataaactttagaattagcttattgatagccataaagtaacttgtcaggatttcaattgtgattgtgatgaatttatatataaagttgagaaaaattgacattgacaatattgagtcttctatccatgaacctggaatagctctttatttatttagattttctttggtttctttcttcagttttataatttttgtcatatagagctcataatgtattttattagactttaacttctgtcatccctttatctctctctctctctctctcattcttgtgctaatgtaaatggtggtgtgtgttttaaatttcattgcccattggtggtatataggaaaacatttgactttttttttttttttgaaacaagagtctcgctctgtcacccaggctggagtgtagtggcgtgatcttggctcactgcaacctctgcctcccgggtgcaagctgataatcctgcctcagccttccgagtagctgggattacaggcgtgtgccaccacaccgggctgattttcgtacttttagtagagatggggtttcaccatgttggccaggctggtctcaaactcctgacctcaggtgatctacctgcctcggcctcccaaagtgctgggattacaggcgtgagccaccacgcccagccacatttgacttttgtatatcaaccttgtatcctacaaccttgatatagttacttattagttccagcaggggttttttgctggtttttttggggggtggaggggcaggggcaagttgccaactcttgggatttcctacataaatgaccatgtcatctgtgaacaaagatagttttatgtcttccttcccaatctgtataccttttctttctttcttttgtcttattccattgacttctgctactgactgattccttttatttttagtgttacgtaggaatggtgagaggggccatccttgtgttgttcccaacttaggaagaaggtatcaagtttctcaccattatgcagtttgctagctgtaggctgtttgtagatgttctttcttgctgagagtttttaatcatgaataggtgttggatttggtggactacttttcttgcatctattgatattattaaattatttatctcctttagcctgttgatttgatggactatcttgattgatttttcgatgatgaactagcactggatgtctgaaataaattccaattggtcatagtgtataattctttatttatttatttatttatttattgatcattcttgggtgtttctcgcagagggggatttggcagggtcataggacaatagtggagggaaggtcaacagataaacaagtgaacaaaggtctctggttttcctaggcagaggaccctgcggccttctgcagtgtttgtgtccctgggtacttgagattagggagtggtgatgactcttaacgagcatgctgccttcaagcatctgtttaacaaagcacatcttgcaccgcccttaatccatttaaccctgagtagacacagctcatgtttcagagagcactgggttgggggtaaggtcatagatcaacaggatcccaaggcagaagaatttttcttagtacagaacaaaatgaaaagtctcccatgtctacttctttctacacagacacggcaaccatccgatttctcaatcttttccccacctttcccccctttctattccacaaaaccgccattgtcatcatggcccgttctcaatgagctgttgggtacacctcccagaccgggtggtggccgggcagaggggctcctcacttcccagtaggggtggccgggcagaggttcccctcacctcccggacggggcggctggccaggcggggggctgacccccccacctccctcccagatggggcggctggccgggcagaggggctcctcacttcccagtaggggcggccaggcagaggcgcccctcacctcccagacggggcggctggccgggcggggggctgacccccccacctccctcccggacggggcggctggccgggcggggggctgacccccccacctccctcccggacggggcggctggccgggcggggggctgacccccccacctccctcccagacggggcggctggccgggcggggggctgaccccccccccacctccctcccggacggggcggctggccgggaggggggctgaccccccgcacctccctcccggacggggcggctggctgggcggggggctgacccccacccccctcccagacggggtggctgccgggcggagacgctcctcacttcccagatggggtggctgccaggcggaggggctcctcacttctcagacggggcggctgccgggcggaggggctcctcacttctcagacggggtggttgccgggcagagggtctcctcacttctcagagggggcggccgggcagagacgctcctcacctcccagacggggtcacggccgggcagaggcgctcctcacatcccagacggggtggcggggcagaggcgctccccacatctcagacgatgggcggccgggcagagacgctcctcacttcctagatgggatggtggccgggaagaggcgctcctcgcttcctagatgggatggcggccgggcagagatgctcctcactttccagactgggcagccaggcagaggggctcctcacatcccagacaatgggcagccaggcagagacgctcctcacttcccagacggggtggcggccaggcagaggctgcaatctcggcactttgggaggccaaggcaggcggctgggaggtggaggttgtagcgagccgagatcacgccactgcactccagcctgggcaccattgagcactgagtgaacgagactccgtctgcaatccaggcacctcgggaggccgaggctggcggatcactcgcggttaggagctggagaccagcccagccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagacggcgagatggcagcagtacagtccagcttcagctcggcatcacagggagaccgtggaaagagagggagagggagaccgtggggagagggagagagggagggggagagggagaataattctttttatacattgttaggtttgatttgctaatattttgttgaggattttgcatctacattaatgagagctattagtctgttttctttctcatgatgtctttatgtggttttggtattagtgtaatattagcctcatagaatgatttaggaaggattccttctgtttctattttctggaagaaattatacagaattggcatcatttgttccttaaatgtttagtagaattcaccagtgaaactatctgagtgtggtgctttctcttttggaaaattattgtttattctatttctttgatcaatatagagacctattcagattaccaaattctccttgtgtgaattttggtagattggatctttcaaagaattggttcaattcatgttagctatcaaatttgtgggtacagtgttatccataatattcctttattatcgttttaacgtccacgtgattagttgttgtggcctgtcttttatttctaatattagtaatttgggtcttctccccttctttctcagttagcctcactagaggtttcttcattttactgatattttcaaagaactagcttttcagtttgttaattttctctgttgtttttctattttcagtttcattgatttcttctgcttactttggatttaatttgtgcttttttctagtttgctaatatggaagcttagataattgggtttagctttttcttccttttcattatgtgtattcagtgctgcgaatatacatttaagtaccacttttgcagcgttccacaaattttaatgttttattttcatttagtttaaaatattttttatttcttgacatttctttgattcttgtgttataaataacacaaagtgcttcagctatctttttgttaatgatttctagttccattgtggtttgagagcatactttgtatgatatctgttcttttaaatttatatttgacccagccatcccattactgggtatatacccaaaggactataaatcatgctgctataaagacacatacacttgtatgtttattgtggcactattcacaatagcaaagacttggaatcaacccagatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcacttataggtgggaattgaacaatgagaacacatggacacaggaaggggaacatcacactctggggactgttgtggggtggggggaggggggagggatagctttaggagatatacctaatgctaagtgacaagttaatgggtgcagcacaccagcatgtcacatgtatacatatgtaactaacctgcacattgtgcacatgtaccctaaaacttagagtataataaataaataaataatttgttaaggtgtgttttgtaggccagaatattgtttagcttggtgaaatgttccctgtgaactcgagaagaatgtgcattctactgtggctagatgaagtattctataaatcaattagattgatggtgctgctcagttcaactgtgtctttaccaatattctccctgctggttatgtcaattactgatagacaggtattgaagtctccaagtataatagtgaatttgtatattctcattgcaattctgtaagtttttaccttatgtattttgacagtcagttgttaggtgcattatacatattaggtataattgtgtcttcttggataattaaacctctgtcattatataatgctgtctattgctgataatttttttgttttttgttcatttttttaaaaacttttttattcaatattagagctcaggtaagatattgctgataatttttcttgctctgaaatctactttatttgaaattggtagagctactctagctttcttttgatttgtgttagcatggtgtatttttctccaaccttttacttttaacctatgtgtatatcttcacatttaaagtggatttttgtacctaacatatagttggtcttcttttttttttaaatccacttggacagtctctgcctcttaactggtgtattttgggctatttacatttaaagcagttattgatatagttgggttgtttctataattgtggctgttttctatttgttgccctatttttgtgtccttttttatcttcctctagttttctgccttctctggttttaatgggtcattttataatgattccattttttattatgtcttagcatatcagttataacttcttctagtggttgccccagagcttgcaatatatatttaccacaaatccaaatccactttcaaataactttatatatcccttcatgggatatataatgccaagaccttataacagagtattcctaatttctctctcccatcccgtaaagcattactatcattcgtgttagttatccataagctatgatcaccaaatacattgttgctagtattattttgaatacactgtaggtaaattaagaacttaaaaaagatttcatttatacctctctaacactcttctttatacatatttgagtttatgatctatataattttccttctctctgaagctagcaacaaatttcctgttttgtttatctgagaaattcttaattatccttcaaaagtgaaggagaaatactgcagaatgcagaattctaaatgggtggttttattctttcaaaggaattcaaacatctttattctattccactctcttcttgcttgcatgattcctgaagagaaggcacatgtaaatattgttcctctctagataaggttcctccagcccagcgtttttcaaaatttttttctgactttttgcagtttgaatatgttattcttaggtgtagttttatttctttggggttttttgttgttgtttgtttgttttttgtatggatacttgatgttctctaggttttatagatttgtggttttgtgtctctcattaattttggaaaattctcaggcattattatttcagtaattttttctttttctttcttctcctctggtactcccattacatgtatgtccaccttttgtaaattgtcccacagttcttggatattctgttccattcttttaattcagttttgtaagtttatgttcacatatctttaagctgattctttccttggtcatatccaacctactactgaggccattaaaggcattcttcatttctgttatggtgtttttttatttttagcatttaaaaaaaattttttttccttggagtttccatctctctgcctgcattactcatctattcttgcatgttgtccatttgtttattattaggtttttagcctattattcatagttaaattcccagtctgttacttgcaaactctctgtaatatcggagtctggttctgagggtttgtatcttcagactatattttttgccttttagcatgccttgtaatgtttttattgaaagccaaatgtgaggtattggataaaaaggaactgaagtagataggctgttagtatgaggttttgtgtttatctggctaggagttggggtgtgcttactgtagccatagctatggtatcagatgctaaaatttcttctagtgtccttgtttttgtctcccttgtctttaggccttttagagactcctgaaataggcagttcttttagctgcaatttctccttattgttcatcagtcttattgatgtgatggtatggtttgtggggaggaggaagtgttccgtagtaatatcattaggtctcagtcttttagtaaacctgaattgggtatttctcttccccctggtgggttaggctttgataaaactccagtagattaagctctggtaaactagttttcctttaggccatgcgttgttaaggatctgttgagtatgaattgagctaaaacgtgaaaattctctggaactgaagaaaagtacaattatgttttattataatgatagtaatcatcacaaacagctataaaaaggaatatgaggccaggtgcggtggctcacgcctgttgcctgtaatcccagcactttgggaggccaaggcaggtggatcacctgcggtcaggagtgaggtgggtggatcacctgaggtcaggaattcgagagcatcctggctaacatggtgaaaccccatttctactaaaaatacaaacaattagctgggcgtggtggcacattcctgtaatcccagctactccagaggctgaggcaggagaatcacttgaacccaggaggtggaggttgcagtgagctgagatcacgccattctgagatcacgtcattccactccagcttggacaacaagagcgaaactccatctcaaaaaaaaaaaaggaatatgaaaataagttggttttaaatgtaatgtttaatttttgtaacttctgttattataatgtgtagaaatattccaagtgagattcttataaatgaatttcaatatttatttcaatatgaaatctacaaaattctgaatggagggacagacattctagcaataatacatgcctagcataatttcatctggctctgtacttcatataaaaattaaccataacttcttacattactgaataactaaaatatagattctataatgtttatcgaaatgctcaaagatcattctttgggtccaggaaattagaggcaactgcctggaaaagtgtacagtaaaataataaaattaacaaaaacaagaataatatctcttttcctgtcatgtactatttcggtagtatatatttatgaaatagttgatgggtctgaggcagaagacctatgtatttctgaagtattgtgcaagcagtgagaagaatagaagtgtccatgtagcttagcaagtatttatattccctttttgtaggtatttgaggtcttaaactattatctaagaaactgttaaagttcttaaataaaggtagaacctgagtaatattaacgttttgcatcgtaaagtaataaaactgtggcatttgcaaatctcaaaaattaccaagaatgatgcagttgtgatgctggatggtaggctcatctattgtctaggtaagcgatcatttcctatagcaaactgtgggatccctgttaggtacggcacgttatattattaagtttatttattcaattacgcatttattttgtgctttttatttgcctgcaatagtggtagttactaaggcaacaaaatgaataggtttatgtttatgtccttgttccagacttatgggggagacagatacacataaaaacatgcagtttgctaaatgcaatgattgagatacctctgagagttaaatttctgaaaattttaattcctgaaagccaaagattttctgtaccacttctgtgtggagtacatatcaaatgtcgggaccagggatactaattattaactctccacagcccatctaatagaatctatttgaggaatacacctctcgctgtcttgtgtatgtcatgtaaacactccctcccttctacacacacacacacacacacacacacacacacacacacacacacacacacacacgcccatgcagaaacacatgcccattcacacctgttcctaaccctgggaaactaatcctttaggctgggctctgccaatcaaattccctgtttagaggtaatgtaacctggtagttgtgctctccaactctggagtctgactggtctggattctgactccttcactggtcatctgtaagtgtacttgccccataggattgttctggcaattaaaagaaataatatttctaagcatgtagcacactgctcagcacatggtcttagtgttagaatcattacaagatagggactctagtttacatggaggtgagactaagctgtaaaatcttgtagactgatgctgatacctacaaggtgggctgtgagcaagagataagtcacttagcagaaaggagagtatagcagacccacccagaccccacagccacatagaaatgggtaagaattgcagatttctcattgcgggaagatcagttatactttctgctcttcatctcttggcaattccattgtattctttcagtaatctttcttttcatttgagctaatttgtctaggtttttattccttacaaccagtgaaccttgactaacaccattctcaaagaatatttactggttttttttatataggttagaggaaataatcatacgcaagttacgttccatgtagtactaacttctgaactccagtattctttatgaattatatattctagtctaacccagcaggtagcatcatcaggcataagtaatattctgtttttcctcttcttatacttttctggtttttgtggtatatctacctcttatctccaatactgcaaggaaaagaaataatttgttggtacactaagaaaatgcatcctttagagccaaaatgtaacataatctgattatgttgtatatgttgtttcctgtgcactgaagcctaagaagagcattttgggttatatcactgattcattccattcactactctgattaacagtgattctcagtgactttgtaggacatatggttgccatccatgacatcaaggcctgaatattcatattttcccccaaacatttcatctctgactttcatattctgttgtgacaattagttctgtaagaattttacatattgtataaaagttttattttacatgctcttaaactactttcttttctttctttctgtttttttttttttttttttttttttttgagacggagtcttgctttgttgcccaggctggagtgcagtggctcaatcttggctcactgcaagctccgcctcctgcgtacacaccattctcctgcctcagcctcccgagtagctgggactacaggcacccgccaccacacctggctagttttttgtattttttttgtttttagtagagacggggtttcaccgtgttatccaggatggtctcgatctcctgacctcgtgatccgcccgccttggcctcccaaagtgctgggattacaggcttgagccaccacacccagcctcttaaactactttcaatgaaagggtcctagttctaagatttaatgaacacattcttgaacccccatccaaatatttggatttttgtaagctttgaacatactgcctctcagcgttcatctttttagatagaagagaatcatcctattgtcatttggggggatcaccactcttttaaataaaatgatttgtcttctttattagaccattctttgatctgcagtggttgaaccacacatatttatacataacacatcatgtatgtgtgtccaacttagtgatctgttgaattaactttaaaatcattttgcgtcccctctaaaagttctttctctaatctttttaatcttttataaatttcactgacaagaataatgttaattttaatgataatcagggctgaaatttatttctgaaaacataaaatatttgtattcatgttgtgattcattttggataccatcaggtgttatatcccaaattttggatcatatcatcaagagtagatactttaatttataaggtcttcatgagtaaactgaaattttttatccctaattatgtcacttaagaaattaaaggaggaaatatatttaaggacggaagcaaaatgtgtgtgctttaatgtttaatggttggaagtaagtgtttaaatagataataggaagaggagtttacaagtttaataaacctctttgtgataaatttgctcctgggttttctgtcccaaagtaggctatttttccttcatggaaagcttattacgtaattttacataattattagaaaatacgactgtcacaggacagctgattctcattctctaagggtattattaactcttaaccatgagctttaagataactaaaatgcaccctaaatgtgtcatacaaataaattaaatttgagataagctgtctttagctattatttttctttctttggggatcccagtatgaacccaaaatgacaatttatgaagttgttaagccacaattcacatccactaattgctttatatggctatacatgatgatgcatgtttgaagtttatatcatttatgtaaattcctagatctagtacacattatagagaaaaatctgtatcttacccataggaacttctctagagcccctccttttatcatgctatttaaactcacacctggagtagccacctcgcctctccctttgttattccatgaagagtcattttgagtctcactgaaactatgataatggagtgggaatggaataggactaaagattctggaatcagaatgtctgggttcaactcctgtctctgactcctagctgagtgaccttaaataaggtgcttaacctcagctataaaatgggaacaagaggccgggcgtggtggctcacgcctgtaatcccagcactttgggaggccaaggtgggcggatcacctgaggttgggagttcaagaccagcctgaccaacatggagaaaccctgtctgtactagaaatgcaagattggctgggcatggtggcacacgcctgtaatcccagctactcaggaggctgaggcaggagaatcgcttgaacccgggaggcggaggttgctgtgagctgagatcatggcgttgcactccaacctgggcagcaagaacaaaactccatctcaaaaaaaaaaaaaaagggaacaagaaagtacctcatcacaactttgcggattaattgagataatgcgttggaaacatttagtatagtaccgcgcatacagttggttctcaataactgttagctcttaattccagttgctaatagagagctgggacaaggaggtataaatgcagcggctatgttagaagcatcttatagcatggctcattgagaaaaggtgaagtagtatatggaaaaaaaggagtctggcccttcatccctgccagaatctttatgacctcagatgaatataggagtatcgtaaaatgatttggagctaccaggtaagatgttgtggcctactgataaataactgtctacaggttgaggcgtgtgttacatagggtagaaatttttgtggtttttttttttttaaacagagttttggtgtgtcgccaggctggagtgcagtggcaccatctcggctcactgcaacctccacctcccaggttcaagtgattctcctgcctcagctactcagcctcccaagtagctgggactacaggtgcatgccaccacgcccagctaatttttgtatttttagtagaaacagggtttcaccctgttggccaggatggtcttgatctcttgacctcatgatccatctgccttggcctcccaaagtgctgggattacagacgttagccactgcgcccggcctagggtagaaaattttaagtaaccttctaggcgaggaagtggcagaagtcttcctttgtaaattctagtccaagttctaaagaaagttgtcatgatactgtctttgttttaagctcaaatgagaaattgtatgagaaacataatgtcaagtatcaaatctgtacaaagcattgtcttttaaagcaatggcaagccaaagcctacttcccaccatatcagacatctcctccttgccctgtttgctacatgtatcttcttccctcctcccacttgcatgctctgttagttaaggtttcatgccttttgcttcatagttctttttcttcatttatggatatcccctcttcttcccaattaaacccaaaaggataaaatatagccatttttttgagtaatacctttacactatttgtttcagctatgccaccagaagctatagattgtaaagtattaattagctctctttctagagattttacacagcgcaaaaggaagggagagtggagtgacctatgtcagatcatcagtagcagtgacagtagcagctgtggtttggcacataagaccatactccacaccccatcatctttcttccacaatggaagcagaggcagctggggaagaagatacattgtgcagtctgagatggcagcaagagttaaagatgggagtgtgatggtagggtgaccgttgaagctactggtactttttagattggtggaatttatgatactagggagatttgctgctccagttcctgttttagtaggctaagatgtacgtctgttttatcagcaatttgtacagcactttagctatgcaatactaaattaagctatacagtgttacactaactgccctctttcctcatattccatagaaatcttaagtgttttgtttttgcttcctttaacatgactctgcgttttcattttcttctcttacgatgtggccagaatttctacttaataattcttatatcttagggtattgacctttacgtataatgaagaaacccaataggtctccctgatttaacataattggatgataatttagcagaaaaattacaaatagccttaaagccattgtgaaacatctcattcgtaactcctcaagtatgctaattacagaggcagctgtaaaattcacccagagcaaaaaggaatccagtgtgctgactgacagcttcatcctgcgagatcctgatggcatacctgcttattctagtcgtttctttcaagggggcatgacatgtagtgaaggaataaggggaacttaagagtggaattgtgatttttttttttaaatagggcaatggaggaaagtgaggctggaatttagctcttgggtaaatttgatgaaattaagccttgccttcctactgctttctgttcctatattcttgtttcttgccaatgaagagaagctgttctagtatctttgtgatcctttgagccggaaggaggttctaagttaggagaaagtactaacttatttaaaaaaaatagaacaaacaaaaaaactccctcaaacgtctagccatggactcatagggtcttatgaatcatcaaagagactgttggcagtatcccctttattagcaagctgtctgtagtctgcaacttcttggcaaagcaacttttatatgtttataagttaaatggctaaatttgttttagaaatattaagagtgacttcagggagccttctgtttagtggcatgaagcaaacaaatctcttttgtcttttttcttttgacactgtcctgcctgccttatcctgaactgcataactcactaagatattacctgttttccattagccattcttttagtccccaacccagagttaagtctgtcagaatatcattgagatcagttaaccataagtttagctgcctttgcaaggcatgtctgttgctattaaaagcagcaggcacctcatgagaatgctgcccagtcattcccagagtgtgatatgctaattcttaagaatgttgctaacactgcactatgtttcatatgattcaatttagaactttttattcaattggttggaggcttcaagttgacagtaataatagtctttcaagttgttgactaagtagagcagtgatagaattcatatgacatagaattcatatgacaggccatagttgctcattcaagtccaagaagagatctctacaggccacagtggctgaaaaacaacaggaaagtagcctagatgttcactttttaatagtataacatatctttcctccctattttaagtgaaaacagatctctgtcattaaatgaggatataaatatttatgtcatcattgttgaaatcccaaagaatagaccttacacatttctgtgttcattttaaatggccgtcttttgtgtccaagttaaatttaaaaagctccctcatccctctaaaggtctcaccatagctagttagctttcagccttgatctccttttactcttgcctcctctaaaaactttttgatagttctctaagaacctaatcggagtcatacttggcaatacactgttaaagaaaatgtgtatcctagaagtccagatagtctttgtagatataaattaaacatacaaatcccttgctgtaatatgagcagaaagtgttactgttttagacaagtagctgctattctgtgtttcagtacagaacagggttttggtcaaatcaaggtagtgatgacagaatgtcagaacttcacggtagctaggagtccctactcttcattgtagtcatttattgaatattttgaaaaggtaaaaactgctcattgttttattgtctgtggtaaacagcatgaattagatatactttgggcataaagtgctcactgaaatggggtcctttcatatatttttcagataatatgatattttggcaaataatctcttcctagatcaaactatagctggcttattgagaattgttcagcagaatcgtccccaaaataaagaactaacattttctgagaattactttgtgtcagccattgtgctaagctttctacatgtaacattttatttcatccttaaaataacttaatgagtaagatactattatcagtcccattttatagatgagtatggtgctaatattaatgccattttccagatgaagaaactgggatgaagttaaatataacttcttcaaggtcacacaactggtaagtgatagaggatttggacaccagtttttgtgattccaaagcccatactctcagccactacatgctacagtcaaagactgcatgcataggcatttgccttagtatattttgcttgatgtgcctctctgctccagcctccagcaagactatgggtttcagcgatctcccctttgctaagggcagataagagtgttacctgtccttagtaaagagaatgaatgaccttataaaacaggattattaaccagaggagtgtcagtccgtttgggctgctataacaaaatactataaactgggtggcctataaacaacagcaatttatttcttgcagttctaaagactgttggcaccaacagattcagtgtctgatgagggcctgcttccttatgggtgatacttttttgctgtatcctcacatggtagaaggggcaaacaagttctctggggtctcctttaaaaagttattaatcccattcatgagggttttgcctgctcttatgacttaattacctcacagagacctcctaataccatcaccttgggaagtagggatttcagcatatgaatttggggggaaaataaaaattcagaccatagcatggagacagacttgaaaatgttcctgaaataatcagtaataaccatattaattcatgttgaacggggctagtttgtactgattctttataaatgtatagtgctaacttatgtgtgatttttacatatgaaacgttttcttgctggaaggttggtatggtgtattcttttagagccttaaagtcttgatggaatggcagggctctcttgattaaactggccatacttaaattattttttaaaaaatatagattccaaaatggctgaactaatttacattcccaccaatggtgtacaagggttccctttcctgcacatcctcgccaccacttattattgtctttttggtaatagctattctaacaggtgtgaggtgataactcattgcagttttaatttgcatttctctcatgattaaagagcatttttttccatctatctgttgaccgttagtatctcttcttttgagaaatatctgttcagatcctttgcccatttttaaattggattatttgctttcttgctattgttgtttgagttgcttattattatagatattagccctttgttgggtgtatggcttgcaatttttttttccaattcatggattatctcttcactctcgttttctttgctgtacagaacgttttattttgattcagttccatttgtctatttttgcttttgctgcctgtgcttttagagttctttccaagaaattgttgcccacaccactgtcatgaagcttttcccgttttcttcctatagttgtatagtttcagatcttaaagtcttataaccattttgagttgatttttatatatagtataaaagttcagtttcattcctctgcatatccagttttcccaatactgtttattgaagagatgagcctttttgcattgtgtgttggcacctttgtcaaaactcaattgaccataaatacttgggtttatttctgggctttcagttctgttccattggtcgatatgtctgtttttatgccagtaccatcctgttttgattacagtagctttatattttcaaatcaagtgggtctggtgcctccagctttgttctttttgctcaagattgccttgactatttgggttttttagtgaattcatacatatgttaggattgttttttctatttctgtgaaaaatgacattggaattttgatagggattgtattgaatctgtagattgctttggatagtgatacggttatgctttacatccccacccaaatctcatcttgaattgtaattcccataatccccacatgtcaagagacctggtggatgtaattgaatcatgggggtggtttcccccatgctgttctaatgatagtgagttatcacaagacctgatggttttatcaggggctcttccctcttcacttggcacttctccttcctgctaccttgtgtagaaggtgccttactttcccttcgccttcttccaggattataggtttcctgacgcctccccagccatgctgaactgtgagtcaattaaaccttttttctttataaattaccgaatctcaggcagttctttatagcagtatgaaaatggactaatacagataatgtggacattttaataatattagttcttccaatccatgaacatggtacatctttttttacttatttgtctttttaatatcttttgtcaatattttataagttttcagtgtatggattttcacctccttggttaaatttcctcctgttttattttttgatgctattgtaaatgggattgtttccttaatttccttttggaatagtttgttgttagtgtagggaaacactattgatttttgtatattgattttgtaacgtgcaactttactgaatttgttcattagttctgacagttaaataagccagtcacagaaagacaaacactgtataatctcacatgtgatatctaaaaacgttgatctcataggaagagtagaaaggtgataatcagtgcctgctgcggtcgggggatggtgtgggaggggatggggaaaggagagatgttgatgaaagggtacaaagtttcagttaaactgtaggaataagttttagtggtctgtggtactgcatggtgaccacagttaataataatgtatatttcaaaattgctaaaagaatttatttctaatgttctgattacaaaagaaggatacgttggtgaaataatgggtatgttaattagcttgatgtaatctttctacaacgtatataaatatcaaaacaccacattgaaccccataaaaatacatatacaattattaattttcaattcaaaataaattaaaacaaaacaaatatgtaggtttcataaagtaggatgtagtataagtaatgagtaaacactagggtctgatcttggccgttttattaacaatattacctttgagaatttcttttaatctctcttagtctatttcctctgtaaaatgaaagtttgaataaacctttgtttcccaaactctgaaagattactagagatgattttaggtggcatatgagattactttaggcagtgccttgataaaacattaaaataaacattgaatcacatagtaagaaagttactcctttttcaatctttctgattacatcaaaaagaaagtctcagtttggtattaagatatctttaatagttctctaacactggataattgtttggttgtgggggtagggtaggggtgagagtgaacaggtactgtgaattttatactcctcaagagtttccacatgagagtcacacagaacaatgaaagtaagaagaaaaaaagtttctacagaagcgaaattaattcccttagaatgaaaaagtacagaaatgcttttttgctctttctgttgacctcatttcccttgcacttggaacaaaatcaatgtgttatccaactggcacgtttggcaggaggaaccaaacgtgtgaggcacagccgtttctgacttctctcatggtgtggcccatactcaaggcacttctcttctaccatgtaataggctttggttgacaaactttgcttaggacaggatggcaactgtgagaaagtccacgaagccataaatccaaaccacaaaatcacattctgcaattcatcgacattggttatcaagctgatattttgattgtcattttatttctctctctttttcagttggtttcaaactcttaggaaatgtaagaggaaaagcagttattaccctttaaaacctcactaataatctccctttttaaccgaacttcagcttagagttttccataagcaatggtattcatatagaatttaataacatgtttttttcagtgaatttatatttatggttaacatctataaaagaaactcatttaagttttaaaagatgaattggcttttaaaatattaaataatacatatggtacatggatataaaaatcataaagatggtacacaaatgactaaaatttagaaaatactgaacaagattatttgtgagatttcttttagattaaaattcttttgcatgtatatttgaatagaatatataatgttatatggtaaatcaagtaaaagaagggctttctaacatagcatgtactatgttattttctttcattttgaaatatgttgttattgaggaaattaagcttttgttctatgccaattttcttctataagtgtaaatatcttttagtagtttactagacagtagcgtgtatctttttgatagcatatttgttggtgatgatttttttttaatctatttttctttcattgaatgcagtctagtctggatgagggttttgaactggaaatcttgagtagttattatttagaggtgaagaatcatgtcatcactgtataccctttctagcacagtgttcacgtagtagttgttttagctcgttttgcattgctataaagtaatactcaaggctgagtaatttataacaaaaaaagatttatttggctcatggctctgcgggctgtgtaagaagtatggtgccagcatctgcctctggtgagggcttcagaaagcttgcactcatggcagatggtgaagggacatggcaagagaggagggaagagagagaggggtgaggaagatgctgggctctttttaacaatcagttctgctgagaactagtagagcaggaactcactcattacctctagaacagtaccaagtctttcatgagggatctgcccctataacccaaacacctcccaccaggaccaggccccacctccagcactccaacactgggaatctaatttcgacatgagattaggagggggcaaatgcccaaactgtaacagtaatgatcactaaatatttaaacaagtgaatgaataaatgaatgaataaagaataaaaaactgagttctctgtcttaaatatgtgggcagtttttatttctttcttaaagctgttaatggagcaatctgtaaggaaactgaggccttgggttaatcagaagataacactttcatataagtaaaatttggagctagttacactgaacatttagaataaccttgctaggaagaagttgttaaaggaaggcagccctactaattttgcttttacttacaggaagctgaatttatggtcatatatgagactagggttttccttcctttctctcttttttataacaaaaaaattctccttcttgctctttcattcttctttttcttacatgcatgtactatatttctgatcatcttcacctcaaggaaagcaccccagttttccttacattaggggagactattacagcttaatttaaaatgcagctaattatttactcttatactcttaattatagtttcttgtctgataaaggtgcccacctcttaactggcaccctagatgaactgcagtactgatggtgaattattttactgccatttattcaggcaacaaatgtcatgtttcaaagattttgttctaagaatcctaaaaggagttttatatatcagagggagagaatatgaagaagttattagccaaactgactttctaataaccatgtagttggcttgattgactatattatattcctagatcatttcatttattttaaaacattttgcatatatacaggaaaacaatttgaagactgtgttttgttctggtgaatacattttaaacatattctaggtttattctttacaagtacattatttctttaatggtacagtgatttttattctaattcattatagtcagagacatcttaactggagttattttgtatgttcaggttaatattttttgttatcaaaaatttaacttagtacattttatggtagtgaaatatttctggtatctttgggtctcgtagttactactatgtggtcgtgaatatgtaaaataaactcggtgctggctatcacattttggattatacttatcattggattataaaggtgatagaacatcagtaacattcatgatttatggaaatttaattctgaaagtaatcataatctgtaaaaattagcatctagtctctgaactttagagttcaaggtaaaaagcaatacacattctattatcatatttgaaaatacagtttttttgttgtgatggtggtggtggtagttgcgtttttgagacgaagtttcgctctattgcccagtctggagtgcaaatggcatgatgtcggctcactgcaacctctgcctcctgggttcaagcgattctcctgcctcagcctcctgagtagctgggattacaggcatgtgccaccacacccggctaatttttgtatttttagtagagatggagtttctccatgttggtcaggctgatctcaaacttctgacctcaggtgatcctcctgcctcagtctcccaaagtgctgggattacaggcgcgagtcactgcgcctggtgaaaatatagttttttctttttaatttttgaaaaaattctgtgggtacatagtaggtatatatatgaggtaatgagatattttgatacaggcatacaatgcataataatcacatcagggtaaatggggtatccatcacctcaagcatttatcctttatgttacaaacaatccaattatatgtttttacttattttaaaatgtacagttaaattatcattgactgtagtcaccctgctgtgctgtgaaatactaggtcttattttttcgactttttgtacccattagccatcctcccttaccccccacctcccactaccttttccagcctctggtcactgtcattctacactctatctccaagatttcaattgtgttaatttttagctcccacaaataagtgagaacatgccaagtttgtctttctgtgcctggcttattttatttaacacagtgacctccagttccatccatgttgttgcaaatgacagggtctcattcttttttatggctgaatagtactacattgtgtatatttaccatattttctttgtttattcatctggacacttaggttgctttcaaatcttggctattgtgaacagtgctgcagtaaacatgggagttcaggtatctctttgatatactgatttcctttcttttgagcatatacccagcagtgggattgctggatcatatggtagctcaatttttagtttttttgaggaatgtctaaactgttctctgtagtggttgtactaatttacattcccaccaacagtgtatgagggttcccttttctgcacatacttgccagcatttgttattgcctgaattttgacattttttctggggttaaatgataccttgttgtagtttttgatgatcattgatgctgagcacctcttcatatacctgtttcccatttgtacatcttcttttgagaaatgtctaatcggatcttttgcccatttttgattggattattacttttatcctgtagagttgtttgagcttcttttatattctcgttatttatctcttgtcacatgggtagtttgcaaatattttctcccattctgcaggttgtctcttcattttgtttattgttttctttgctgtgcagacttgagtcggtcccatttgtccatttttgctttggttgcctgtgtttatgtggtattactcaagaaatctttacccactccagtgtcctggagagcttccccaatgttttctcttagtagtttcatagtttgaggtcttagatttaagtctttaatccattttgatttgatttgtgtatatggtgagagataggggcctagtttcattcctgagcatatggatatccagttttcccagcaccatttattgaagagagtttcctttcctcagtgtatattcttggcacctttgttgaaaatgagtcagtgtcaatgtatagatttgtttctgggctctcaattttattccattggtctatgtgtctttttctatgctagagccatgctgttttggttactatagctccacgtttttatgctagtgccatgctgttttggttactgtagctccatagtataatttgaagtcagataatgtgattcttctggttttgtgctttctgcttaggacagctttggttatcctgtgtcttttgtggttccatataaattttatttatttatttatttatttatttatttatttatttatttagtagccacagagtctcattgtctttgcaaggttggtctcaaacccttggcctcaagccatcctcccggtttggccttccaaagtgttaggattataggcataagccaccacatccccatttaagttttaggattttttttttctatttctatgaaaaagtcattggtattttcatagggattgcattgaatctgtagattgctttggatagtatgggcattttaacaatattgattcttccaatctatgaacatggaatacctttcctttttttggtgtcctcttccatttctttcatcagtgttttatagttttcattgtagagatctttcacatctttggttaagttaattcctaggtatttaactttatttgtaactattgtaaattggattatgttttggatttctttttcaggttgttcactgttgacatatagaaatgcactgatttttgtatgttgattttgtgtcctgcaactttactgaatttatcagttctaaatttttttttgtagaatctttaggtttttacaaatgtagtgtcatatcatgtgcaaacaacaagaatttgatttctttctttccattttggacaccctttatttctttctgttgtctgattgctctagctagaacttccagtactgtgttgaataacagtggtgacagagagcatctttgttgtgttccagatcttagagaagtggttttcagcttttccccactcagtaggatattagctgtggatctatgtatatggcttttattatgttgagatacgttgcttttatactcagttttttaagggtttttatcatgaagagatcttgaattttatcacatgctttttctgcatcaattgaaatgatcatgtggcttttgttcttcattctgttgatatgatatgtctcattgattgatttgcatatgcccaaccatccttgcatctctgggataaatcccatttggtcaagaatgattgtttcagtttcatttatttctgctctgatctttattcttctcttttactaattttgggtttgatttgctctagttttgtggttctttaagatgcatcattaggtcatttatttgaagtttttctacttttttgatgtagacacttactgctataaacttctctgtcagtactgctttcactgtatcccataggttttggtatgttgtgtttccatgatcgtttgtttcaagaaatttttttaatttccttcttaatttcttcattgatccattggtatttaaggaacatattatttaatttccatgtgtttgtatagtttctaaaatttatcttgttactgatttcttgttttatttcattgtggtctgagaagatacttgaggctgagtacagtggcacataccttgtggtcctagctactcaggaggctgaggtgggaggatcacttgagcctgggaggcagagtctgcagtgagctgaggtcacaccactgcactccagcctggacaagagtgagaccctctctcaaaaaaaaaaaaaaacaacttgatagtatttcaatttcgtgaatgttttaagacttgttttgtgacctaatttatggtctgtccttgtaatactatccatgtgctgaggagaagaatgtgtattctgcagccattggatgaaatgttctataagtatttattaggtccatttggtttctgatgcagattaagtctgatgttcctttgttgattttctgtctgtccaattctgaaagtgaggtgttgaaatctccagctattattatattggggtctacctctctcgttagctgtaatatttgctttatgtatctgggtgctccagtgttgagtgcatatatatttataattattatatcttcttgatgaattgatccctttatcattatatagtgaccttctttgtcccttttttttttttttggaaaataatggaatttattctagacaggatttctttttttttttttcctgccttcaagcatctgtttaacaaagcacatcttgcaccgcccttaatccatttaaccctgagttgacacagcacatgtttcagagagcacacggttgggggtaaggttatagattaacagcatcccaaggcagaagaatttttcttagtacagaacaaaatggagtctcctatgtctacttctttctacacagacacagtaacaatctgatttctctttcttttccccacatttcccccttttctttttgacaaaaccaccatcatcatcatggcctgttctcgatggtcgctgtctctttggagctgttgggtacacctcccagatggggcagccaggcagaggcactcctcacttcccagacggggcggccgggcagaggcgctcctcacttcccagacggggcggccgggcagaggcgctcctcacctcccagacggggcggccgggcagaggcgctccccacttcccagatggggcggccgggcagaggcactccccacttcccagacggggcggccgggcagaggtgctccacacttcccagacggggtggccgggcagaggcgctccacacttcccagacggggtggccgggcagaggtgctccccacttcccagatggggcggccgggcagaggcgttccccacttcccagacgacgggcagccgggcagaggcgctcctcatttcccagatggggcggccgggcagaggcgcttctcacctcccagacggggcggccgggcagaggcgctcctcacctcccagacggggcggccgggcagaggcgctcctcacctcccagacggggcggccgggcagaggcgctcctcacttcccagacgatgggcggccgggcagaggcactcctcacctcccagacagggcagccgggcagagacgctcctcacttcccagacggggcggccaggcagagactctcctcacctcccagatggggcagctgggcagaggtggctcctcacatcccagacagggcagctgggcagaggcgctcctcacttcctagacggggcggccgggcagaggcgctcctcacctcccagacgaagggcggccgggcagaggcgctcctcacatcccagacgatgggcggccgggcagagacgctcctcacctcccagacggggcggccgggcagaggcgctccccacttcccagacggggcagccgggcagaggcgctccccatttcccagacggggcggctgggcagagatgctcctcacttcccagacggggcagctgccaggcagaggcgctcctcacctctcagacggggcggcctggcagaggcactcctcagttcccagacggggcggccaggcagaggcgctcctcacctccttctttgtccctttttatagtttttttttcttgaaatctattttgtctattacaggtatagctactcctgctcttttttggttttcattggcatgaaatatctttttccatccctttatttttagtctgtgtgtctttataggtgaagtatgtttcttgtaggtaacagatcattgaattttgtgtttcttagctattcagccactctatgtcttttgattggagaattcagtttgtttacatttagtgttattaataataagtaagatcttactcctgccattttgttatttgttttctggttattttgtggtcttctcttccttctttccttcctttctattttccttttagtgaaggtgattttctctggtggtttgttttaatttcttgctttttattttttgtgtattcattgtatgttttttgatttgagattatcatgaggcttgcaaataacttatagctcgttattttaaactgatgacaatttggcaccgattgcataaacaaacatgcaatcaaaaagaagtctaataaatactctgtactttgtccccccaactttttaactttctgttatttctatttatatcttatggtaccaagtatgtcttgaaaagttgtagttatttttgatcggttcatcttttagtcttttacttaagatatcaataggttacataccacaattacagtgttataaaattatgtggttttttgtatgcttagtatgaccagtgaggtaccttcagatcattttttaattgcccattaacaccttttttccttcaaattgaaggattccccttagcatttcttgtagaacaggtctgatgttgatgaaatctctcagcttttgtttgtctgggaaagtctttatttcttctttaagcttgaaggatgttttcactggatatactattctagggtaaaagttttttttccctcagtagtttatgtcataccactctcttttggcctgtaatgtttccactgaaaagtctgctgtcagacatattggagctccatggtatgttatttattttttcttttgctgcttttaggatcctttctttatccttgacctttggaagtttggttattaaatgccttgaatggtagtcttctttgggttaaatctggttgatgtataactttcttgtacttgaatattgatatctttgtctagaattcggatgttctctgtttcatccctttgaataaacgttctgttcctatctctctctgcctccttcttaaggccaataactgttagatttgcccttttgaaactattatttagatcttataggcatgcttcattgtttttcattcttttttcttttgtctctgttgacagtgtattttcaaatagcctgtctttaagcttaccaattctttcttctgcttgatgacttctattaagagactcagtatgtcagctgcatttttcaaccccagaatttctgcttgattccttttaattgtttcaacctctttgttaactttatctgataggattctgaattccttctttgtgttatcttgaacttctttgcatttcctcaaaatagctcttttgaattccctctctgaaaggtcacatatctatgtttcttcaggatttggtccctggtgccttatttagtttgtttttcaaggccatgttttcctggatggtcttgatgcttgtgggtgttcattggtgtctgggcattgaaggtatttatcgtagtcttcacaatctgaactcttttgtacctgtcttagaaaggctttccagatatttgaagggagttggctgttgtgatccagttttggtcattgcagccatatctacattagggggcaccccaagcccgataatgctgtggttcttacagacttgcagaggtactacctttgtggtcttagataaggtctagaagaattctctggattaccaagcagagactcttgttctcttcccttactttgtcccaaacaaacgagtctctgattctgtgctccaagcctcttgtagttgggggagtggtgacacaagcacttttgtggctaccaccactggaactacactagaccagacctgaaaccagcatagcactggatctcacccaaggcccagtgtaacccctacctggctacctcctgtgttggctcaaagttctagggctctataatgagcaggtggcaaagccagtcaggcttttatccatcccttcaggacagcaagcaagttcccctgggccccaggcaggtccagagatgccatctgggagccagcatctggagttggaaaccttagaaccctatctggtcctctattctcctgcagctgagctggcatccaaaccataaggcaaagtgcttcccacttttcactcctcttttcataggcaaaagagtctctccctatggccaccaccactacaagcccacagggattattgccaggctacggttcatgttcacttaaggcccaagggctcttcagtcagcttgtggtgaatgttgccaggcctgggacttgcccttcagggcactgggctcccttctggcccaggcaggtccaggagtgccatacaagagccaaggtctggaatcaggaaccccaagagcccacttggtgctctgttccactgtggctgagctgttatccaagttgcaagataaagtcctctttactcttccctctctactgctcaagtggaaggaaggagtctcttttggagctgtgaactgcactgccttagattagggaaagggtggcataagcactgccttagccacctcagctggtggctcactaggttacgtgccccctaggtccaatgactctcgaacccagcacagcactaaaacttgcctagaaattacagttcttgtggcctagactgcctttcaagttcatttagggccccaggacacttcagcctatagtggtgcggcttgttgaaactcaggctccaaccgctgggatggacatttcccctctggctagggcacatctaagttctccctccatgggcattggctgagttctttgctaatggcccgggtgttgcttgccagttggcctggtgttgctttctgctgtgacatggtaacactgagttccagtgcaaagtcccacaatcactgtgctccccctcccccaagcacacagattctttgcaccacacggccactgcatgggggtggaaggggtagtagacaatcgaaaactgtctttcctactctcttcagtgtctctttcagcaatatgaagttaaaatcaggtactgtgatcacttacctgatttttggttcttgtgaaggtgcttttttgtgtagatagttgttaaatttggtgttcctgtggtgggggcagcgattggttgaggcttctattcagccatcttgcttcatctccctccaatagattaaaaaaaaaaaagattttagaattatctaatttttttctttaaaagatgtagatgattggcttataattataatcttcaggtgtttccagagtcattgtgttctgtcatgaaagtaatgcaagagcaattttgctgtaatgaaaagctagaagtttcgagaacactttattttctaattccaaaacaacaacaaaaaatagaactttgctagctggctgtgtctactgtcattctttgattagatactttgagttctgcataccatgaggtgttggtatgatagcatgttatgatagaaacttttagaaaagaccagagacttgagagatagactaacctgcatgtgaaattcacctccgtcacttttgctctggtatttcgagcaagttatttaacttcctttgtaaagtgaagattatacttctttagagttgctgtgaggatgaaagcactcagaataagttcttgttgaatggtggatgtataaggaataccatgtggtaatgattatatgtttcaatattgtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattgggtaagaatctgattttttccctcaaactgtgatatgtagtagttagggttatgtatctttacaatatattgtgaattttacaatatgtagttcaatttttatagtcccaccaaaggacagaggttctagagctatcctaaggtcacatggagactatttttttttgtttgtttacttagaacagctaagaaagttgcttagtagtgctctattactgtctccagttctcctcttcctttgcttctttctcctcttatcacagctctcttttggcttttgttgttgttatttttgagatagggtctcactctgtcacccaggctgaagtgtagtggctcactgcagcctcaaccaccctgggctcaagtgatcctcctacctcagcctcccaagtataatagctgggtctaaaggcatgtatcaccatgtccagcttctttttatttttattttcatatttcccaccccacatctttccttgtgtcttagtcttcatatgtagaggagttattgaccccattctaagtgttagacgtaaagaaggtacatgtgaagtcagaatatcaaatcgtatttcttctcatgtaacttttgattgaaattcaatggaatcattcgttctgcccacttcatctctatagagcccactgaacaattccaatttccccagaaaaagagtgattatgaaggatgtgggaaggaaagatgatagaatagatgttcatatgattgtatccacatctgggttatagtctggaatgcaaagcaaagaatagccgtgaagatggcagagtaactctggtgaaatcaaaccttcactccagattcataataaaaaactggccttaagtttggcccatatactgtgacctaaaggcgtataagtctacctttttctacatataaatagtgatttagtaatttggggggaggggaaggcaagatttaaggagggtgttttaatttatgaaaataaactgttatttttatttccattaatattgctttggggccaggcatagtggctcatgcctgtaatcacaacactgggaggctgaggcaagtggatcacttgagcccagaagtttgagaaaactcaacataggcaacatggttgaaaccccatcaattaaaaaaaaaaaaaaaagcaaaaattagccaggcttggtgacacatgcctgtagtaccagctgttcgggaggctgaggtgagaggatcacttgagcctgggaggcagagattggagtgaaccataatcacgccactgcactccaatgtgtgcaacagagcaagaccttgtcttaaaaaaaaaaaaattactttggaaacactaagatgggaggagagaggagaaaactgtggaagtcagtgccttattcagtacagggaagtgtgaatctgtgtccccaattttacaattttggggcttttcttaaatatgacaggtgaaattaatatctgctgtcatttgatatggtgaaaaacagagaaaggaaatgcattatgcccacaacagaagggctggaatcggtttcatttacctaaaatagtaaaaaccgttaaaaggtttgctggtcttaacggtgctgtaaaagtttatccaggtctatgttttcctgggacaacttttaagttctacaagctggcagttatggtgactctccagggtaaaataaagaggaaaacccttggtatcagaactttacaaataatatctctaatgttctttagtaacaactgtgaatcctggtatcatcctggtaacaaaaatcttaagttgtattcagtttttttccagacagctggttgctgcctagtatgaaatgcagctctgaaatttcccatttattcctaagatgtgaattattttctctataagaaatcattcttcaaaggctttacttactttctaattccccttgtattgtttagcctgcaaatatatttagaatatgtatttttgagtttttaaaatactatgtgttttactttttctaatagtgaaaatgaaagaaaaatcagttaaaaatgcctataatgccaccataagtaggggtataaattgagtaccctcaaagcacccagtgtcagtacattaccagtagaatctgaatttctcccccagagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaagttagaccaactagtgattctagagtggggttgtctctttcagtttaaaagaattcttacttcccatgacttgtgatttttgtatattattattgctaattattagggttttaaaaattcaatggactatgtacttgtgtaactgtcagtctaatcaaagtgtttttattagccatatccaataatgccttataagaagtctaaaatgaactggaccactgacttacgcattgtcaccagcaataatcattattatcattaaaagtatcaccctacttcttggtactaaaatcttcactagtctgttggagctgccataacaaaataacatagactgagtggtttaaattacagaaatttgtttctcccaggtctgaggctgggaaattcaagatcaagatgctagcaaggtagatttcattttctcttggcttgtaagcagccactatttcactctgtgctcttgtgacctcttctttgtgtgtgcagggaacaggagaggaagtgttctgatgtctccacatataaggacactaatctcatcatgagggccccattctcatgacctcatctaagcctaattatttctcagtggtcctatttccaaacaccatcacattggggttagggattcaacataggaatttgtgcgaatgtaaacgttcagtcgataacactagccagccatacagactgttagcaataaaaccaggtgcttatcgttttgatttcactgtcttcattaacagttacagacaactgaacacatatgtagagttttgtcttataataatttgtggaatttgaaagttatactaaagaaaggtaaggaatcaaaaagtaagttttgtaagttgaggaataaagactactactgtgtatggaacagtaacaattattttttgagcttgcctgtatttcaggcactgtgctggtgctggggatttcatgataaacaagatactccctgctgtcaaggaattcccaaatctaatagggcaataaacaattaccctacagttgagtaacactattatagggttaacatggggtattatgaaaacacatagataaagcacaaatcctgattggacacttcttataggatctgagtaaacctggagttagtctttatttactatcaataaatgaaggatgtattaaatgtatgtaaaagtaggaaattaaggagaagaaaattctagtcttagttctgctcagatactatctcctccagaagtcatccctgaacccttgactggcctgtgttccccactctgtacagttctctgttgtagtgtttagcacttgcttacttctgtctccttcactagattataagtactttggacataatacctagctgtagttaaatgcccagtaaatattaaatggtattgatttcaatcccatcagtttgaaaacattaacacttaatcatttaagctttttggctatttaattaatgtatttgttgtcccccatgtttcaaatggggatgaggaaaataaataaatttagaatgaggactataatgcaggtattaatctaagtcattagataataatttaaatcctctttctacctctgaagaatccaaatgaacctgaagcaaattgccttttttattcaaggctccctctcttgagcatatgcacacactaccatatacatgcgcgcatgcgtgcacacacacacacactgagatgtgtatatatataaacaaagggcaaataattcatcagccaagtataagaatgagttaatgtaagagggattaaatgaacatttgggcacaaaacacaataaaaaaatgtatagtttaccatgtttcttcaatttaaaacaccaaactgaatttgtagcttggttgaagaaaaagatactaattttgtctactctttcacttgttctggaacgcatcacaagcttttttccttgttttcttgatgagcaaattaattcatgctcacttaaaaatatgcaagttggtaaataccctattagttcattttcacactgctgatagacataccccagactgggcaatttacaaaagtaagaggtttaatagacttacagttccacatccctggtggggctcacaatcttggtagaaggtgaaaggcaattctcacatggcagcggactagagaagagagcttgtgcagggaaactcccatttttcaaaccattagatcttgtgagactattcgctatcacgagaacaccaggggaaagatttgcccccgtgattcaattaccttccactgggtccctcccacaacacctgagaattcaagatgagatttgggtggagacacagccaaaccatatcattccacccctggccactcccaaatctcatgtcttcacatttcaaaaccagtcatactttcccaacagtccccccggagtcttaactcatttaagcattaactcaaaagtccagagtccaaagtctcatcgaagacaaggcaagtcccttccacctatgagcctataaaatcaaaagcaagttagttgcttcctagatacagtgggggtacaggcattggataaatacagccattacaaatgagagaaattggccaaaacaaaggggctacaggccccatgcaagtccgaaatccagtggggcagtcgaatgttaaagcttcaaaatgatctcctttgactccacgcctcacagccaggtcacagtgatgcaagaggtgagctcctttggccttgggcagctccacccctatggctttgcagtgtatagcccccctcctggctgctttcacgggctgtcattaagtgtctgcggcttttccaggtgcatggtgcaagctgttggtggatgtaccattctggagtctggaggatggtggccctcttctaacagctccactaggcggtgtcccagtagggactctgtgtgggggctctgaccccacattttgcttctctactgccctagcagaggttttccatgacagccccattcctgcagcaaacttctgcctgggcatccaggtgtttttatacatcctctgaaatccaggcagaggttcccaaacctcagttcctgacttctgtgcgctcacaggcccaacaccatgtggaagctgccaaggcttggggcttccaccctctgaagcaatagtctgagctgtatactttagcccctttttgtcatgacggaagcagctgggatgcagggcaccaagtccctagactgaacacagcagaggaaccctgagcccagtccacaatatcattttttcctcctaaacctctgggcctctgatgtgaggggctgccacaaaggtctctgacataccctggagacattttccccattgtattggtgattaacactcggctcctcatgacttacacaagttttctgcagctggcttgaatttctcctcagaaaatgggattttcttttctgtcacattgtcaggctgcaaattttccaaacttttatgctctgctccccttataaaactgaatgcctttagcagcaaccaagtcacctcttgaaatctttgctgcttagaaatttcttccgccagataccctaaatcatctctctcaagttcaaagttccacaaatctctagggcagagacaaaatgctgccagtctctttgctaaaacataacaagagtcacctttgctctagttcccaacaagttcctcatctccatctgagaccacctcagcccatactttattgtccatatcactgtcagcattttgggcaaagccattcaacaagtctctaggaagttcgaaactcccacattttcctgtcttcttctgagccctccaaactgttccaccctctgcctgttacccaattccaaagtcacttccacattttcaggtatcttttcagcagcactccacttcttgtaccaatttactgtattagtccattttcacactgctaataaagacatactcaggactgggcaatttacaaaagaaagaggtttaatggacttacagttccacatagctggggtggcctcacaatcatgatggaaggcgaaaggcgtgacttatgtggtggcagacaagagaagagagcttgtgcagggaaactcctgtttttaaaaccatcgaatctcatgagacttattcactatcatgagaacagcacgggaaaggtttggggacccagccaaaccatatcattaccgaatcaaggaaaaagtattatcctcaatcccatttatgtagtctcattttctaatacagtcatgtaccacataacatttcagtcagcgatgaaacacctgtatgatggtagtcccatagattataaaactatacttttactgtaccttttctatgtttagataacacaaatagttaccattgtgttacaactaccttcagtattcaatacaatagcttgctgtacaggtttgtagcctgggagcaataagctattccatatagcctaggtggatatatatgtatagcctaggtgtggtatagttggctatgccatctaggtttttgtaaatacaccctatgatgtttgcatgatgataacatgcctaatgatgtatttctcagaacatatcctcgttgttaactggagcatgactgtagttgatcgaattctatataatttaaactcttttcacttaatacagcaatagatccattcccctaggttgctaaaatagtcattgtaaacatgttttttttttttttttttttttgctttgtcacccaggctggaatgcgttggtgcaagcatggctcactgcagcctcaacctcctgggctcaagaaatcctccttcctcagcttcctgagtagctgggaccattggcatgcagcatcatgcccagctaattttttatggtagagacgggattgcatgttgctcaggctggtctcgaactcctgggctcaagcagtcctcctgccttgtcctccaaagtgccgggattactgtcgtgagccaccatgcccagcctaaacatcttttttaatgactacatacatatacgctgtacagatatgccgttgcttatttgaccaaccattcttctaatattaggcagtcagcttatttccaatgtttcattcttataagtaatgctatgacgtatgcctaaaattatccacattatttccttaggctagatttctggacttggaagtatttagatgcaaggatataaactttttttttttttttttttaaatacagggtccaggctggagtgcagtagcacaatctcagctcacggtagcctcgacctcctgggctcaatgatcctcccacctcagccatctgagtagctgggactacaggcacatgccaccacactcagctagatataaacattttacagctttgatccatagcacagcatgacagttttataccaaacaacccttatagtacagttggcagtatctacttggactgcaagaatagtaaaaccagaatttcctccttgtagccaacagctataactcccctgccagtggtagtccaggcagcaattttctccatattctgttataaatatagtagtagccttttatgcataattttttctctttgtaaatccttttatttttattttcgacttgagtcgtttctcggggatttaaatgatgggttttttttctttactcttttactgaaatgtttttctactctgatttaattctgctttaaaatactcaggattggttttgatacctaagcaaatcataaaaatctctgccattgttttaagagaccaaaagcatgaattaatctattatcaaagtatatagtatccaaggtaatcattgtaagacttttctgcttcaagagggtgaagagatgaaaaattaaacttaaatgatgtatagtgttcacacagtcagaggtatagtgttgacacagtcagaggagaatctattttctgtgttgctcattctttgaaaaggggttaaaattagctttatacacatagcttctgtgtgaagatgattggttaatgctttgtggcttggtattgcacttcagatttctgcatgttaagattgagtccgaccggacgcagtggctcacgattgtaatcccagcactttgggaggccgaggtgggcggatcactaggtcaggagattgagaccatcctggctaacatggtaaaaccctgtctctactaaaaatacaaaaaattagctgtttatggtggtgggcgcctgtggtcccagccactcaggaggctgaggcaggagatgatgtgaacccgggaggcggaggttgcagtgagccaagatcgcaccactgcactccagcctgggcgacagagcgagactcaatctcaaaaaaaaaaattgagttcatccacaagattttaccaccagcatcccagtgactgtggcagccattgctattgtggcgatctcttaagtagttcagtattacagtgtttgaatcacagaatcattgacagtcaaagaaataagaactattaaagttggctatccaacattgcattctaagattgtggagattagggatggggttaaaataggaagaaaaacaagtctttaaaagtttcccaggtaaaatatttacaaattgagtttattctttatttttaaaatgctgaatgagttctttctaaaagtaggtacattgaaatgaatagagacaagaacaatttgttaaaagttttttgtaaagtatttggttgccctgtgaaacaaagaatcagcaatgagtggtgtatttgttcactattttattgaactcctataatatgctggacacagcacagagcactaggaatacaaagtcaaaatataatgtgtggctccttatctcagggagtaaccaacaggtagacaatatacatgtaacacatattacagtaaatttagatacgtctcctgaaggagtttatgtaccaggtacagtgaagtcacaaagagaagtatctccctcagtcaagagaaggacttcagaaaagaacaccagatattagtttataactgcaagctagtcctttgtggatgatataaaaataaatttttataaagtggaaaaaaaaattattattcccagtatctgaaacctcaaggtagaagaattcctccactgacatacttgagggcaaaagacaagaagcatgtttgtgcaaaaagtttcatgctcattatgaaaggtgtacaatttccttcttccattatttactttgttttgtttgtgtgtgttttgttttgttttacacttaggtatcctttatgaagccatagagataggcctgagagctcttttgcatgtagagatgggcctgaggaacttaggtacctttttttaaaaaaataatggtagggtttcactgtgttgcccaggctggtctcgaactcttgagctcaagcagtctgcctgcctcagcctcccaaagtgctgggattatagggatgagccaccgcacccagccttaggtacccttttgatttggttccagagagggctcttttagttaggaaggccattaatgttagtgttacttcttggtaaattgatcactcctttgtttcactgagcatccaaatcatgctgacaaagttagtctttattcaaggataaaacctatgctggttttatcagttcccccctttctttctccctctagcatttcgtatttctttgttgttgtttctgctccatgcctgggtatgcagcttcccaagaatcacattaaaactatttctggttgttttcttttccgaacaaatgtgacattttcttcatctccttgattttgagctgaagaaggcaaactgtcaaaaataatgaggccagatggatttgaacactgaatagcagtctgaaacagtgctcagagactttgcctttacaatcattattacagaggcaatgagggaaagctccttggtggccatgaaatgaagagaaactgaaacagctcttaggggattagggaaagtcccaggcataggtagcactgacttgttcatgtatttattcactcagcattgtgtggagtgctagatgctgtgatgcaaagaaaaataagtcatggtcctaaccttttttggaatactgtttggaagacaaacatgtaaactgactcctgatgcttcagggtttctatataagaactattattccttcagcaaatatttattcctcctctattatattccagattcttttcaaaagacatcctgtatgaatacttttaaacacacactatctctagcaagactaccaaaatattacttggtggacatctatggaatttgcttccataaatattagaatgggctttctattactgttattaggtaagagtagatggttcttcaagaaggatgcaggttaagggagactgttagttctcacaaatttttaaaatattcatctcttaacttctttttattattaacttgtaatgtcaatgaagaagacatttacaaagtctaacccaaatctgaattatcagaaattctaaattaaaaattttaatgaggttttatcacagtatttgtattctaaaggaaaagctcagtgaccaaatatgaaagcagtttgaataaactcttaaaagtcactcattacaaaaggaaaaaggagacttcaattttcagctatttcatgaattgataaaggacattttgatgtgtgtatgtgtgttttatatgatatgccaataaaatttaatatacagggcattccagaatggtttctgccccactgatggacttcaaatatgtctcatcaactacagtattaaatgccataattaaaggtctcctttctgtgagaagctcttagtcaaaggagaaagtctgccttctgataggatactgtgatatctatgaccatctataaattaatttattttttcaggtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtaagtgtcagtagggcattttaaaataaccaatactttttggttgtataggagtcagaaaaattatttgtgtgtctatgtgttgttaatgttcattattgtgactcaggtgcaatttttctgatactcagtaatgatcccttttgtgaaagaatggaaagatcccataacatagccattcacatgcactaatatttagttgtttgcaagtaatggttgactacatctccactgaagccagttactggagttgtttaaagtacttggcttgttcacagcatttaacagaaacaacaagtaattaagcttacttaatactttctaattttgcatatagtcaatatgtaaccagaatccatccatttctacacatcatcgcactgatactgagaggcttaaatgccctaaattttgcctcagttgattgctttatagaaaagagagtaaatgtaattccctttcaagttctattacatttctaccaagtgagaaactgtatgttaaatttaagcaatataatatcacaatctttgtttgaatttaattgttgcagatgattatattttatgggtttggtgtatgtgtttttatgagggtccagccagctttgtatgccctgtggaatatcaggataacaatatttattgtggattttattctgttctctcgtttatgcacatattattggttagttcattcaaccagctgttaaatgcactcaaaattatactaggtgcagaggagatttcaaaggagattgaagatacagttcttgccctggtccagaatctaataagcaaaatacacacatgaaataactagagaataattaccagaacatataaattggtataagataaatgtatgcttaaatgctgagaagaagcggagaaaagaaaatgtgaaaaaaaggaaagccacatcatttttacaagagtatacttcggagagtaaaaggaaatggagactttcttattatatgacaatacacattgtcatgatgggatggcgatatgatttttggaaagataccttgccaggcaaaggttacagattcctttaatatggaataagaatacaacttactacccaaagatagctgcacagaacacgtagcagcaatcttaatcagaagggaaaatgtcttcaagttcccatgaaggcatccactatttatgtttctccctaattggggtgtggatcctatctttaagaaactcatttccattcttattgcaagaaaggggcaaggtttataactacttggttccttgcaactgtttttgagagtctgactatgcatctgcctgatcaacaggtacatgtaactggtaacaacctccaaacattcttgatgcttattgttacaatgagtgaatcaagagtcacttccccagctatgccaccttctctgtaggcctggattttaggcctgcctgaagtcaactcctctagtccaggtttctcaaccaaagcactattttagaccagagaattctttgttgtgaggagccgtattctgcatgtaggatatttagcagcatccctggccagtaagaccctcacttaaaattgtgacaaccaaagatgtctccagacattgccagatgccagatgcccctgtggagcaaaattgccctggttgagaactacagttctagtcacaagattctaaagttaaataaacatacacatgtctaaatgtttaccaacctcacatgtaggtaggcactgagacttacagggttgtactcatgttttgcttttcttctcccaatcctccttagtaataccattaggcttattctggaatagaaagaaaattttttgctttactattttttttttcctttttgaagttgtactttagaattttggatcctcataactccaattttgacctacaaatcaggatctctgtcacttcatgatggtagaattctgtctaggcttgaggagaatattgttctattactttgtttggttttatgcataatgtcaacttcagtgtattcagaacttgggtccagagaagcaattcatatgaagaaagagtggtgctgagaagactttctgtatccaaaggaataaggctcatacttatatttcacattgttcctaaaaactcctggcagtcaaagtttgcccaaaataatttcactcatttgaacctaagcaaaattaaaacagtatttcataacccaaaatagacttgaatacctcaaaatattttatgttaggattcacaataaaagtttaacagtagaaataccttacatttatatagtgagtagcagtttgcctaatgtgattacctccttatcatgtaccttatttgatgactaaccgctgtagcatttgaaattgtagagtaattccatattcagtgataaatctttgagcttacttgcacctcattatttttctcaaatatttttagtaaagaagtatttagtaaagtttaatgtttttgtagtgtgaatgaaattgtttgcaggattattatgtagattcctttacataaaccaaaattggaattgtttgaaaatgccctagaaatatcttgccatcattgccaatagagcgtgagaaaaagtcactgatgggataaaatgccaaaccattgaccactgatcacagaacaagaaagaggcaacctgtgctgtagagtcaggatatctgtatttgcatccaactttgaccaattactggctgtgtgtccttgaacaaattgcttagcctatttcttaactggtttatttttctacatgtgaaaaaataatagtacctatagtatagagtctttttgaggattaaggagttatgaaaagtaaagcactgcgaatagtacctagcaatacagtgttaaacacattagctgctattattatatatatgaatagttataggaatatctctgcctgttagagacactctatagtatttattttgcagctctttttcacatggcttcatttcagactgtatgcgctcacattttagaaggagcatgaaacgagctagtcaaggcctccattagctctgcttgtggttacgggtaatgcttagggtccgtaaagaagaggaactgttaacattcagcatgtacaatttctctgggccaatgtaccacctcaacttcattttgtttagcttattgaaagagaatattgccatatgatgcgatttttcagaaacaaaagttcttcattcccaaaaggtgagtgaagacttagtatttgaagtaaatgtgtgtgtgttgactttagtgaaattaatcttcagactttcctatatatgtcataagcattctagaaaatggaggaagactaaagccatacatccagaagagtgacagaagataaacactgagaataagttcagcccagaataaaaacatggataaccaactctcaactttcttagatgataatttcatgtgccaagagatgttaggaagtgatccaagtttaatatctccttcataattctttgacaatctttaagttttattcatgtaaactttctgtctcctatacactatcctttcaggaattttataccatataacaatagtgagaaagagttgacctgttgaccatgagctattgtagacaatactgcaggaatgaaatgccatgctagaaggaaaaatacaaggctagatgtttggaaaactgcaggcaaaaatgtcatgggaccttaatcgggatttctcataaatttttagacctatctccctcagtctcaggacttctcatctttcttggttttatatccataagtgaggtctgggaattctctcttcttcaatgaaaaggttttaaaagccaacactgtggctctgctctctaattttgttactattattgctgttaactttcatcagatctgtttctcaaagccaagtttgtcctaaaagcctcataaattgaatagcacagtcctcaggatttaatatgaaaattggaggcaatattagcatttttttcaagtacgtcaagtgaattttgaaagctatgcaactacattctaaaacgttctaccaaatacattaatcctattctgtgttactggaaatcgcctatgtgcaaagcatctcctttgtcacctattttcttatttgaatcttaaatctaaagcaaagaatttatagttggagaataacagcagttgacagcccagttgtagataggcacagtatcagaaaggttttctgaaaatattgcttatcaggttctgggatcaatttttatttttctgaaatctgacttaaaaaatggttgcagatgctcactttaaagactaacattgttaaagacattgtttaaagagcagttaatgttactctgtagtttcagccattaaaagttatcataatacaaaatcctttttttccccctatgacacctccctttatggcagttattacaatactctcatgagcctctcttggtctaattccaaatccgcacgcaattctactccccttattacactttgaatcagattttggaagcccagagggcaaaaccaaaaactacgttaactattccagacagatggctctggacaggaatttccattgagatgtggctcatgaaacaacagtggatacctgttgagagtaccatggaggaaagcacagggtgaaatcccaaggtgtgaactctgtgattacttcccagagcagaagacaagaaaagtatttgcatccacagaggctctatctagcttacaatgctgagtgctgtacagtgcagctgttactgcattaatccttctggtgtttctcacaacaaagaaaagacctgggtcttattctcttattgtatagtaaaacaaagcagattacaggaaaagtgcacagatctctcagccacttccaacttctcacactaggatatcctcctgcccctatctatctattttgacaaaaataagatcccatctactctgagaaagctttggaggcttatgtaaactcaggctacttctaagggatgaaattcagactaatggattcctccccctttttaaaattttttttaatacagtcatatctgttttatcctttggcaggatttttgctgttacccattactgtgtgctttacgatgtactaaaaatgatacagtgccatgtcaacacagaataaagttaaacatactacatgtagccaaccactgctttgcaaaccatggactgctctcagtcatgccacctgtcaagcatcaaacctgagtatggacgtcagctgcaagccttcatttacctgccatgtgatttgaacttttaaaccacgtggtaggtaaggaaagaagagaggaagcatagagtgactaaatgcgaacattaacactatagtaatctttttagccttttgcagtaaattgtcccatggttgatatagacagttttaaaattacttcctcttaatgttatatatggatcttaagggttaaatatcacccatggacttgtgtctccattactgggctggtattatgcctggagcaatattcattcaacagatacttattgagcacgtactttgtggcaggcattgttctaggtgtttatcctaagggaatatatactcaagagcctgaaagagttctgactgtggctctgccattaactagttcctttttggatttttatttttattttttgaaatttacttaatctttctgtggcttagcttcttcatctgtaaaatatgaataataatagtacctcacaggtttgtcataatagttaaatgagttgagacaaggtgagggaagagcacactattataacactgcctgggacataatcggtgctcattaagttcagctgctatctttaatggtcattcttatgagaaaaataaagggccacacctgtgtagcactggtatgcttgcagaggcctacagtcacatttgtcatttttataatgggccacctcagtgtctgaaatctctactattattataatagttatttctttggtttaagaaaacagttctgttatccaccaaggttaacacatgaacaactcttgatagcaaaacatacactaattattaggattatccccagaagaaacaggtctctaagggtgtgggacagggtgcgatgttgtttttatgagagtaagacgtttaagagtggagaggaggaaacacatcacggttcattgtcacagtagagattgtggtcatcctaagagtaacacaaggtcctgcattcctggctagggatgactgaagagtgggtgaagacaccctgaaaagaagactgtcaggtttacccaagactgtctttggtcttatgctatatctttctggtgttacaatatgaacatggagaataagatttacaagagaaaatatatatagcagtttcaagcatatgcagactgcctgggttccaacctgaatttaccacttattagtataaccttgagcaatgccttaacttccctttgacatttgtaaaacaaacataatgatagaattttatggggatgctgaaaggaatctaattacattagataatgtctaaaaacaatgtctgacagttagcaaaagctcagtaaatattagcctctgtcattgttattgtagtttgctattattggagctgctttaattatttagtttcttcttttcctgagtcccacttaattttgcttgccttctatgagcctttggctgaatttgaaattcaaaagttccaaatctttttgatccctattttattatagtctcggtattctaccaatgatctcaattgtaaaatgacattgccaatataatcgttgttgaactaataaatctgaaagcaaggtttctattattttggttctatatctagttgaaattctatcactaaaatttgcataaatcacttaatctccttgtgttttagttgcctatctgcaaaattaaaaatattggggcaaatgtagtttcatttgcaaattatatatagcatttgagaattgcccctcaagttttctgaaattcagattctctaagttgaggtgatgattaacctagtcagattttatttgataagagttaagaataggcatctccatttgtattagtctgttttcgcattgctaaaaagaaatacctgagactgggcaatttataaagaaaagaggtttaactggctcatggttctgcaggctatacaggaagcatgatgctggggaggtctcaggcaacttacaatcatggcagaaggcaaacggggagccagcacttcacatgactggagcaggaggaagagaattgggaggtgccacatatttttaaacaatcagatctcacgagaactcactactgtgaccacagcatcaaggggtgatggttttaaccatgagaaaccgcccccatgatccaatcacctcccaccaggccccatctccaacattggggattacagttcaccatgagatttgggcaggtaacacaaatctaaaccatatcaccattcaagtttttaatcttcataaatgccaaggttttaaaagactgccgggtagtcctaaattgctccactgagcagataagcaattactatgagtagcgtcattttaaatacatgcaaaactattggtatagtgacaataaagcattaactaagattaccataactggagatttaggaaaatttcatctgagttgcattgttctcttttcacaatgtataaattgcttaaattgggtgatagtttagtttaactttattactaagcattaacctcaaggattgaagctcagattgtggaatttcacctgctatccagtgagcagagagggtattctttggacatagggaccttttaagtagccttaaaactatagtaatcagggtgatgcatttcctcaaaggcttgcccagtttatgtcatccaagcatgccactctctacacagcacacttaaaactttttagaacagaaattgccgatgtgttttagctcacttgccagtgcttgttgattgtcagtaattacatgaatctctcttgaaaacagttctgggagcggggagggatagcatttggagatatacctaatgttaaatgacgagttactgggtgcagcacaccaacatggcacatgtatacatatgtaactaacctgcacgttgtgcacgtgtaccctaaaacttaaagtataatttaaaaaaaaagaaaacagttctgacaccaagttataaattagcagatgagaatgtgtgattgattaacagtgtatgaaggaaagggaccatcagcatttatttgtgttaagtttttttatcctaatcctaaacttcaaattctttaagggcacaaactatgtcttactcattttggtatcatgagtgcctagcttggaccactgtgtatgtagctcttaataaatgtttgttaaaattaactaattcatattcttaaattcttttgtactatatagagatagagagattttaattgtaataatctttcgtgagtttttcttctttatttgaaaaaggatccagacacagagatgaagaatgacttgtaccatcttctgagaacaaatggactgaaagcttgtgactagaatccactacttttcaacctcttactcctagagcccatccttttggccaagggcttttagattgctgtgaaggagagtgtttatatactaacaatttcttttaaattctttcccaaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaagtttctagaattttatatcattggatgatatgttgatcagccttatgtggaagaactgtgataaaaagaggagctttttagtttttcagcttatttactttgttttttttcctgtttctgatatagtaactaattcttaactcagagacattggtccattttaatactgaaaaccaattttcattggtacacattacaaaattgctaagaacactgtttgggagctttcattctcatattttggacattgttttaattgagtgaaataatcataactccttgctcccagagaagctatcacctccatttctaaaaccatttcaggtttgtttggtagtctttcttaatgtatttattatcgctttttgtgagtagggtcctgttttatccaggaaccaatttctgccctagcctatcatgccctgcttttgagagtaccaggtatctttgggattgggaagctggctgtttcagaagtatatgtctcatagtgtgcagaacttggtgaccaagtgagaagcgggaccaatgggagactcacaatggactgagtcttgggattatcttttccaaattcttccatgttagaatcacttcagaaaataagactttgatgctttgtctctgagcatcatttttctcctcataaaaacacttccttattgtatgtagcctgcctcctacagaggcctggtaggtgttactgcattctaaaagaaaaatgtcatctctgtaggagcgactatcaggcctagtgtgaaatattagggatcctaggcagaagagctattagtcctggccttcatatcttcaccaaatgaaaatactgtatataaaatttcaccaccaaacttaactaaattctttttctcaagtcaagcctcccaaagaaaaaagaaattaacttcctacagtgtcagcaagcaattttccatttagttttggtacaaataaaagtcatttgaaacaa

SEQ ID NO: 2205 - DNA, 333530 bp, Homo sapiens; identical to SEQ ID NO: 2204
  source 1..333530: mol_type = genomic DNA

SEQ ID NO: 2206 - DNA, 333530 bp, Homo sapiens; identical to SEQ ID NO: 2204
  source 1..333530: mol_type = genomic DNA

SEQ ID NO: 2207 - DNA, 333530 bp, Homo sapiens; identical to SEQ ID NO: 2204
  source 1..333530: mol_type = genomic DNA

SEQ ID NO: 2208 - DNA, 331392 bp, Homo sapiens
  source 1..331392: mol_type = genomic DNA
attcgcgcgcgcacgccggcgctggccgaggcttccccgcctgcgctcgttgtcagagccgctccggcgcgtgcgcgcgttatctccggccgacccgagcagccggttccctcctctccaggccccctccccatcccacccccgccgcctggccccagccgacccgtcccttcgtctccccgcggaatggggccggcactgctcagggtcgcgcgccctggacccagctcgctctcggtctcgcgctgtcagcgactgcccggctcgcgccgcctcgcgctctgcctcagtcagtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctggggtaagggggcgttttgggagccgggccccgcgcgcctcggggtcttgggctgggctgcgcgcgggatctgaggaggctccgcggctgtccctgctcgttcacccgggcctgttgctgcaactgctgccggttaaccagcggctctcggaaaagtggggagggagcccccgggacgctctggcggatgccttggcgcagccccgggggcgcgggcagagggtgaggggcgcccgcctctccagccgggacgcggagctgcgccgctgctgccctcggcgtcgcgcatccttgcctagggcaggggccaaagcctagggaaggagaagggttgggggcgggggtgggaggtgtccgtcgtttcccctccacacctaccttcccttcgtcagcagctcggtccctggagtcgcggtttgtggggaggaagatgcccgtgcgttatgggctctttctgagtgctgctcgggctagaaagcagggagtggaccctcacaaagatccgcgagggactgatgcagggcagttaaaggcttgagtgcagctgtactcccttttgatgtgcaaatgacgagctggcggcttttgagtatcaacttatttgggaaggttaaatgagtccatatttatcagttctaggaggtttgtcctgcaggattgagtgggttgtcgggtgcagcacctgttctttcttcacagtggggattgcaatcttcagagacgcagtgtatttcttaagtggcagtgtcatgcttagggtttgtcccggatgagcttttattttagcattttgccatataatatatagattgaggccttggttaaaggcacggacaggtggtgtttttttccttcctatgttttaattattcacagtttatttaaacccactcaggaaggtggacccagaaaagccaaattctgtagtacataaccccaaatttcaaggttttgcggaacaaattcaacacaagttttgtgtcagtttagagttaaacgcatctcaagtaactgacttaactggcttgcctctatgaaaactgtaggcaggtttcattatagattttttttttcttgttattccggcggttaggtgcatgtttattttcttgattaaatttacattctatgttttatgactaattctttaaataggtgcatcatatagaaagtattttaggagagaaattattatttaagcactacagtatatcagatatatgagaaataatggagttgtagtctctgctctttaaaataactgtaaaaacatcttaaaaccctatgccaaataataaggccctgtaccttgctgtccttgtgaaatctggtatgtgtatagaaaatcttaattacttgatttgtaaatactacagtagtattgaaaaggtgggaattcaagcatttgtaattgtgatttcacaggtttagtgtgtaaaaaatgcagggagttagagatgaataggctataagacacgtacaaaggtagttccaagacatggattttctttttgctgccttataaattgagaattctatttgaattcaagagctgaacagctggaatgaaacttgcatagattgcagaaacagatgcaaaaatgtatctttggtcaagttgtgagttaacttgaagagtgtcttgtgtaataggatagtgattcaaaataatttccataaagtacggccttatataggttatattttgaggatatttttgaatttaaaaagtcacctgaagttgttttcctacaaatcagttctgtttaagatgtatggaatcgaaaaaaacaaaacaaaactaattctgattacatcctgcattgttttgttgcaaattcttaccagttatttttacgcaattggagtgtccttaaaagtggtgaatcttaaaatttgccagtggattggaaaaaactgttaacttattatttttaaaaatgctgttatattagtacattggtctggagggggagctagtgccaaagcaaagtatagcttaatagctgtttgaacttttaaaacacccaaaaccagatttttatgaccaaaagaaacataaatttttaattaaaagagtaggaaattgatgtgggcatatatatgtacatagttatttgtggagtgaatatattgtgtattacaaattagtttaaaaaagtcttttcatgcgctgcaataatggaaagctaaatgcttaaagatttattggatttctcacttaaaaatctctaaaatgtacccccaaacttagagtatgttatagtattttcttaaccttcttgtcctgttcatcagaatctaaggcatgtattcttgacccattgtacatgttgtgtgttcttaaattttgtttttataatagctacaatcctaaaatttcaaaaacgaagcttcaagtagaatcttatatgggcgaaggtattaattgtgtggtaagctaggtatttatcaaaagtagatataattccttttttttttttttttaaagtagagataattccaataaaaaaatggaccttttagacatctggagaacaatatccccaggtcacttaacccttatctcctgcagtataatgcagtgcgtccagctgatctaccaaattgaatgtgtgcctttgaatacgaagcagttgttttgtggcctgtggcatttcatttaggtttctaagctgtaataaattagtatgttaatttacttctttccattcacatattctttaaatccaagcctagaaactgatagttatatgtatattaaaatcattggaatattggtttttttgcagatagtgtttgggctgtttattatccatagctcttcattatgtaaatagaatctcaatgctgataaagtaaatagattcttccatttcattaatggttatttttgatttatgataaactgcatttaataaatctcttgatttagttaaatggtggatacatcatttcatattatagcaaattgataaatataaaagaaagttttacaatcataagagtaaatatttaaaaaaacttgaataagttactttactaaacataaaattaagatttttaaacaactctgaaactaaaagtattactattatggtacctttttttttttttcccccaaagagatgtgatcttgctgttttgtccaggttggccttgaactcctgggctcaagcaatcctcctacctcagtctcttgagtagctgggactataggcatgtgctaccacagccagctttattatagtacttttgtaccctgcatcaatgctgcttctgttgatacttttcaaaggagatatcaacttctggtcttcaacagtagtgtagcatcctcttattgattctctggctcatatttcactaccgtatagtatggagtttctttcttggagtttgaattgtttttacattgcagcttgttatagtgaaacaattaaacatatttaaaagtaaaagatatttacgactgatttttaaagaacctgtaaaaaaatctccaacagaagaatattatatggggatgtgtagatttaacattttattttctttaatttttttttttttttttttgagattggggttgggggttgtctctctatgttgcccaggttggagtgcagtagtggcgtgatcacggctcactgcagccttgaactccctggttcaagccattctcccgccttagcctctggagtatctgggattatgggtgcatgccaccatgcgtggctaattattttttaatatttgtagagatgagaccttggtatgttgcccaggtttgtcttgaactcctggggtcaagtggtcctcacaccttggcctcctaaaatgctgggattacaggcgtgagtcactgtacccggctcctttattttattaaaaagatttttgtttgtttgtttgtttctaagtttaaaagagacagggtcttgccatgttgcccaggctggtcttgaactcctgacctcaagtgatcatcccaccttggcctcccacaggcgtgagctaccatgcttggttgtaagatttttaaaaaatggattagtttcaaatctcaacttctctttctttcaacattctaatctcctggcatttttttcctttccccagctaccccccatcatccaacagtcttccatttggaataatgggaaatcaaaccaataaagttaatcttacctcccaccaggcaaaggtttttcttaatctctacaatattctgaacataaaacccatataaactttatatgatactacacattttccttttaacggaggaagagcaaatgggacctatggaattatgccgtatttgtcaatataagggttacttttgtactcttactgaaagcagagttatagggctaatttcatttaaattttcttacccatctactttaaaaaaatacctctttgtggtagtcttttttttggtcagaaaatgacaatgtgaaggagaaatacgttttgaatttataaatcttcttttaattaacaaattataccaatataagggtagtgttaatgtggttcaaatttgcctttgctattctgccttttcttctatagtgattgtatagttatactataacttcttcctcgaagcactggaataaaagaaaaacttttaaagatcactacgaaatgctcactgtatttgttgtattttataacttgggtttttaaaatttatttttccataaactgaataaatatgaaaacgaacttgaaagatcttgtcacagccttgatgactggtcagtataaagttcacattataaaataataaaacattgataataatcttagatgaaaatggaaaattaagctaatgtttattttagaacctgagtaatgagtttatatcatgtagcaatgaggcacatgaagacggttagaattagtttttctaatgaataaacttcatgatataaacttgaaagtgcataaatgctataactttctgattgtaaacttgaacaaaagtaaaatgaaaatgggagagtcctcttaattacctttaacgtataactaaaatgaacctgtgtatctgtctaagtcttatttgatcaagactttcaatggacaatgaatgagttttaagtttttatcaatgttgtgactgatttttctataatatcccttaaatgagatatcaaattctaataatatctagaaccagattaaatttggttagagtataaacaatatttacaaaccatcaaaactataataaaagcattgtaatgttatttaatgacttaagccaacattccataagctaatctaagcatttttacaattaatacaattgatagtaatatcttaattagtggtaaagtggacagatataatttatagattctgtattgtctgggaccttggggcagtcagtgaagagagggagatagagagaggagcatactggttgatgagcttgccttatttggagatgaaggagatttattcagtttttctctttccctctacttacttctccttgtttgtcatcctcttctagcaatggtaagaaatgcgggaattgaccatctttacagtatacttttttccttagagttcatagaacatttccaggtaaaacattagcttttatgttataataggtttattataatgatatcatttccttttgaggtggtaggcaagagactagaagaacttcatttgtatagcatttaatattatttattaaaaatgattttataggccgggcgcggtggctcatgcctgtaatcccagcactttgggaggccgaggcaggtggatcacctgaggtcaggagttggagaccagcctgaccaacatggagaaacctcatctttactaaaaatacaaaattagtcgggcatggtggcacatgcctgtaatcgtagctacttgggaggctgaggcaggagaatcacttgaacccgggaggctgaggcaggagaatcacttgaacccaggaggcggaggttgcagtgagccgagatcttgccattgcactccagcctggacaacaagagtgaaactctgtctcaaaaaacaaaacaaaacaaaaaaacaaaaacaaattctaaccttcatgtgcctcattactgtaatgtaaaaaaaaaaactatgttcattgaagagaactaacatattaaactaaaaatgaagcacagtgttctccactcatgggagtactgttagcaggtttaagacagttactgtgagaagttcacaaggtgaaagtgtctttgataattagggcctaatcaattgggatttgacttactcaatttctccaacacatggaattgtactggtacctgaaggagaaaaatatataatagaagttgtattagtttttatgtcttgagctctctgaataactacttgattcattcagttgccaaatgtcaaaagattgtaattttgagaaagttgattctttacaattagaactaagccagggtaaacaatttgctttctttttctaagttttaggtttttctttctctcttaggaagtttagtgaaactctaggggttaggcaggttgtaactgaaattcttgaggccaaaaggtcctgtcttatgcttggtaaaccgaccccctcaacagcgtgagaaatgtagatgtactgataaccctgattgcttcgtgacataattacagacatccagccctctatcaactaaaattccgtttatttttaaggttcaaatattagaagtatctgcttgatacatctcataggttgtcaagtgtgcatacgatgagagatataatgttacttttaatttgtaagtaaacaaacacacaatattatgttctcaatgctgagtaagctgaaaagatgtatacctactgaggatgcaccaaataataagcaacagaaacctggtaatgtgcaattaggaatagttcctcttaataataataaaaaaaagattagtgtttaggttttaatggcataaagatgtaatgaaaataaaattaccaaagaagtctattttggagaaatttttgtcagactagataacaaagaaaagaacacatcctttttttatttttattttttattttattttagagatgaggtcttgctctgttgcccaggctggtgttgaattcctaggctcaagtggtcctcctcccttggcctcccaaaatgctgggattacaggtgtgagccaccaaacttggccagaacacatcctctatatgactgtctacagaggcttagagtagtacagaagtacctgaaaggaaataatgataaataatgaaaatgttttaatagggatcatgtgttcatttctacatgtatatcagtatagtacctatcgtttgctgtttctgcttgtaaatgcacggttggaaaataagatacccaacctttggaaattattcagggaagtgcatctaaagtttagagaaaagttggtttcttcatattttaatgacacttttcagcacgtatagttcacccttgaacagcactgggtttggggcacagacccccatcaagatgaaaatccacatgtaacttttatctcctcaaaaacttaattactaataaactactgttgacttccagccttaccgatgacatagtcaactaacacattgtaccttatatgtattatatactgtgttctcaaagtaagctagagaaaagaaaatgttattaagaaaatcataggccgggcgccgtggctcacgcctgtaatcccagcactttgggaggccaaggtgggcggatcttgaggtcaagagatcgagaccatcctggccaacatggtgaaactccatctctactaaaaatacaaaaattagctgggcgtggttgcatgtgcctgtagtctcagctattcaggaggctgaggcaggagaattgcttgaacctagaaggtggaggttgcagtgagccaaggttgtgtcactgccctccagcctggcgacagagcgggactccatctcaggaaaaaaaaaaaaaaaaaaaaaatcataaggaagagagaatatatttactcttcattaagtggaagtggatcatcacaaaggcctttatcctcattgtctccacattgagtaggctgagaggagaaggaagcggaggaattcgtcttgttggtctcagcatggtagaggtggaagggggaaggggaggcgtgagaggcaggcacacatggtgtaactttatggcaatacgtcatacttctgccttttttgctttttcatttctctgaaaacatttccatatggtaccaatccttcttccaccgtttgctttagtttcagtgcccatatcagagaagggtccatgtcatgaaggagtcaaaagcagtcttgaacaatcagacagtcttctgccatatcgtctgatgtcattttgttttcttgcattccttctacattacctggtactggattggaagcacttaccgagtcatctttttaaattcctcttgtgtgatgtctatttcttgaatttctccaagatttgtatcttgaaaccctttaacccacccccccctttttttttttttgccatatccacagtctttttcgtgatttccttgattggccctgtggcaaatcctgtgaagtcatgcacaacatctggacacagtcttctccagcaggaatttattgtttcaggcttgatggctttcatggctttttccataacaacgacggcttcttcagtggtgtaatccttccagactttcaggatggtttctttattggcattctctttcatagagttgacagtactttctgtagtgtactgtgtccagtgatcctcgtgaccccctgatttagaagctgaattagagacattttgtttgggggcaagtagactacttcagcacctttggtgttgaactcatggggttccgggtggccaggggtattgttcaataataaaagaacttacaggcaaaatacttcctgacttcagggacaaagcatcaatggaaccaatccagaaaaagggttctcattgcccaggctttttttgttctatgaccaaaagactgggagctggtgtttatcttttcccttcaaggcttgggggtttgtagcattatagataagggcagttctgatcataaaccacactgcattttcaccaaacagtagagttagcccatcccttcctgcctttaatcctggtgctttttctcttccttactaatgaatgttttttatggcattgttttccagaatagggcacttttgtctatattaaaaacttgtttaggcggatattctttctccatatttcttttttttttaagagatagggtcttgctcaattgcccaggctgacatgcaaatggcatgatcatagctcaccgcagtctcaaactcctggacttaggcagtcctcctgcctcagcctcccgaatagctgggatgcaagtgtgcaccactatgcctggctaatttttaaatattttttatttttttgtagagacagggtctcactgtgttgcccagtctggtcttaaactcctggccttaggtgatcctcccacctgggccttccagagtgctggggttacaggtgtgagccattatgccttcccccagctaattaaaaaaatgttttttgtagaggcagggtctcgctgtattgcccaggcccaggctgatcttgaactcctggcctcaaacgatcctcctgcctcatcttcccaaagtgctgggattacagggatgagccactgcacctggcctcctcagtgattttctttctttctttcttttttttttttttttttcgagactgagtctcgctttgtcacccaggctggagtgcagtggcgcgatctcggctcactgcaacctccgccttccgagttcaagtgattcttctgcctcagcctcctgagtagctgggactacaggtgtacaccaccacgcctggctaatttttgtattttttgtagagacggggtttcaccatatcggccaggctggtctcgaactcctgaccttgtgatctgcccacctcggcctcccaaagtgaatgattttctttcttttttttttttttttgagatggagtctggctctgtcggccaggctggagtgcagtggcgcaatctctgctcactgccagctccgcctcccaggttcacgccattctcctgcctcagccccctgaatagctgggactacaggcacccatcactacgccaggctaattttttgtatttttagtagagactggggtttcacagtgttagtcaggatggtcttgatctcctgacctcgtgatccgcctgcctcggcctcccaaagtgctgggattacaggcgtgagccaccgcgcccggcctaagtgaatgattttcttaatgtcatctggaaagtcgtctgctgcctcttggttggcagaagctgcttctcctgttatcgtgacgtttttaaagccaaaactctttctaaaattatcaagccatccgtggctggcattatattcttcagctttagatccttcgccttccatttgttttaagttgtataatgactttgctttttcttgaaacttattaaagtttatagggatgcctttctttatagcaatcctgtacccctataaaagctacattttcaacatgagataaaaaactatttcacaaaacgtgcacaatttttgcatctgctggtgtgccttcagcaatggcttcatgaattctttttttacaatggcccttatgctggattcatttattttgaagtagcacgcaactgcagctgcagacctcaatctacagtacgtatcaagcaattcacctttttcttgtaatgccatgatttttctctgcttcttgggagcacttccggcatcactagtggcacttaggtgtcatttgaggtttatagtatcgtactaaacataatgaaaccgcgagagatcactttttactggaatatacaatttattggaaagatgaactgcttgcttggagatgattaatgtcacatggtactttaagcaaatattcactcttgagctcacctcattaacaacaggaggtggctacaaaattatttcaatagtacagggtgtagtacagttaaatttatgtagttatgatttaatactgcatctttactcttttgagacagggtttctctcagtgtcaaatgccaccatgtgtggctaagtgtgtggtataagttgtgacaatttttaactttttataatagatttgtatatatttgtagtagtaaatgataaaatagactagtatctacatatattttaagcactcatgacatacctcttactttctatttttcttttcttttcttttttttttttttttttgatgaagtctcattctgtcacccaggctggaatgcagtggcacgatctcggctcactgcaacgtccacctctggtgttcaggtgattctcctacctcagcctcccgtctttttctttttttgacccagggtctcactctgtcactcaggctggaatgtcatgattcaatcatagctcactgcaacctctgccttctgactcaagcgattctcccatttcagcctcccaagtagctgggactgcaggtgcatgctaccatgcctggctcatttttgtgttttttgtagagacagggttttgccatgttgcccttgtccagggtggttttgaactccagtgctcatgatcctcctgccttgacctcccaaagtgctgggattacaggtgtgagccactgcacatggcctacttttttgatatttctaggttatatggttgtctatgaatattttcaaattgtcacaaacctcccccaaatttatcaacatatttattgaaaaacattagcatatgagtggaccctcaaaattcaaacctgtgttgttcaagttttaagccctgagagctctaagagtttaaagctaaaaacaattagaaaaaaaatggagtttctttttttttttttgagacggagtttcactcttgttgcccaggctggagtgcaatggcacgaactcggctcaccacaacctccacctcctgggttcaagcgattctcctgcctcagcctcccaagtagctgggattaaaggcatgcaccaccacacccagctaatttttttgtatttttagtagagacagggtttctccatgttagtcaggctagtctagaactcacgaccttaggtgatccacccgcctcgccctcccaaagtgctgggattacaggtatgagccaccatgcctggccgttttttttttttttttttttaaacatgaaatgttctttttccccctggttttattgaggtataattggcaaataaaaattgtatatatttaaggtgtacaacttgatgttttggtatatgtgtagattgtgaaatgtttaccacaatcatgctaattaacacatccgtcacctcacatagttatttttgtgtgtttgtgtggtgagaacatttaaaatctcctttctggctgggagcagtggctcatgcctgtaatcccaacactttgggaggttgaggcaggcggatcatgaggtcaggagtttgagaccagcctggccaacataatgaaaccccatctctattaagaatacaaaaaattagctgggtgtggtggcgggcccctgtaatcctaggtatttgggagtctgaggcaggagaattgcttgaacctgaaagacggaggttgcagtgagctgagatcacgccactgcactccagcctgggtgacagtgcaagactctgtctcaaaaaaaaaaaaaatctactttcttagcacatttagtgtgtacaataaatattattaactgtggtcaccatgctgtacgttagatctctcgaacttactcatcctgaataaccctttggccaacatctccccatttcctcctcaccccagcccttggcaaccaccattctgttctctgcttctatgagttcaccttttttagattccatatataagtaagatcatgtagtacgtgtatttgtctttttctgccagtcctattttacttagcctaatgtccttcgggttcatccatgttatttgcagataacagtgtaaaggggaggcaaactttacctccacctttttaaagttttttttttttttttgcttggcctcacaaattaccataagatagattatcaggagaaaagcacacaaatttattcaatacaagttttatgtggcacaggagccctcataaggaaacagacccaaagatacagttagaattgaatacttacatactgaattggacaaaggataataacttgtgaaaaataaactggattatatggggaggcttaaaggatagaagttattttaacaaagtctgtatggaattctctttgtctccatatcccgtccttgatgataaaaatgttgctttccttttagtttaaggaggacatcattcacatgggaatttcatctgcttttaagaaatagaagaaaggtcagagcgctcttcttacacctgctgtttttcaagtgcctttgactcaaaatagtcaatatgtcagaatggcgtatttaaactccaacaggattgtcttactttttaaaagctgaatatgaatcctgtgtgtgtgagcatgcacacacacatgcacacataacacattttctttctttttttttgagacggagtctctctttgtcgcccaggctggagtgcagtggtgtgatcttggctcactgtaagctctgcctcccgggttcaggccattctcttgcctcagcctccctagtagctgggactacaggtgcccgctaccatgcccggctaattttgtttttgtatttttagtagaaacagggtttcaccatgttagccaggatgatctcaatctcctgacctcgtgatccgcccgccttggcctcctgaagtgctgggattacaggcgtgaaccaccgcgcctggcctacataacacattttctttacccgtttatccattggtggacgcttacgttgactccatatcttagctatatgaataatgctttcatgaacattggagtgcagatacctccttgacatactgatttcatttcctttggatgtatacccataagtggaattggtggagcatatggtagttctatttttaatattttgaggaacctccacactgttcttttataatggctgtctcaatttacattcccaccaacagtgtacaagattcccttttctccacatcctcatcttttgtctttatgtgaatagccattctaacaggcgtgaggtgatacagaattgtggttttgatttgcatttttgtgatggttcatcagtattttttcatataccaattggccatttatatgtcttcttttgagaaatgtctatttaggtctgtagcccattttttaattgcattatttgttttcttgctattgagttgagttccttatataccgaattccttcttagtaattttaaaaatagcattattaaggtataatttatataccataacattcatagttcaagttctagtaaatttatatagttgtgcaacaattatcacaatccagttttagaaaactttcatcttccaaaaaacccattcttgtccatttgcagtcactccctgtgcctatccccagctccaggcaaccactgatctgctttttgtctccatggttttgccatttcttgatttttaatattaatggaatcatacaatagtgtagtcttttgtgtactcctcctttcatttagcatgattctgtttagtaatgggaatgaatggataaagtacaaaagctttgaacttggaatcaggagacttggatactagtagtgtgtgccaccaaatatataaacatggttaaccacttgtcccctctcggcctctgctttttcttccataaaatgaattattttgactttcttatatcccacttttcacagctgggtagacattcactgaccttttcttaaaaggtacattaactcttcctcttaaatgtagccactgtgtgtgtgtgtgtctttttctggatcaaaaaaatgaggcttatgtcagctatggtctgaatgtctcttcagaattcttacgttgagacctaaccttcactttgatggttttaagaggtggggcctttgggaggtacctacgtcatgagcgcagagctctcaggaatgggattagtgtctttactattaaagaggcctgagggagcttgaacccccactttctgccatcaccagacaccaaaccttgatcttgcacttcctagcctccagaactgtaagcaataaatttctgtcatttataagttacccagtctaaggtattttgttatagcaccccaaacggactaagacatggtctaatggatgattcagcaatgaacaaatttggaattgtctggaagaatcaagatgggtgattaaacattttcttgggcatttcttagttcacacatacaactctgaggatggggataatcttaaatgctgagttaataaagatttttgacgagaacaaagccatagttgaataattctgtgaggtagagcttcaaaagtgattgaaacttgttatgaagagaagtacaagactatatgctgttttagttttttgttttgggagtagaaagtgggttggaacaatttcagtgaagtttgtgccaagctgcactcaaggtagtcaagtggggttagatagtttttcaagaagaacgaaggaaagtgcatgactatcattgggaaggttgtcctagaggcaaagctgacaggtaacattcaggttataaactaggaaaacaatacatgtatgggggatttaaaaaatagtgtacatgtgtatatgtgtgtgtttgtaacaggagtagacaattgactgagtaggctggtgtcaggtatatgctaaaagagtaatgttcattttcagtatagtataaaaaaagagaattgaatcacagctgcctaaatttaaaaatcagtgttgtaactgctttcaaataatcaataatttgacttttagaaaccttcagggcttgttattttacctacagtagtaggaagtatggctattaaatgattgaactttatttttacccaacatactagagcatatgagtgataacccacagagcagacactggaggaggggaatgtagctataaatgtattttaatgatggtgtcattacagcggcgtaagaaaatttgtttcatgttttagagtcacactttttgttcaaaagtagcatttccaatgtaggtaaaccactttttgataacaaatatctccaaatcaaaactatgtttattttatgaagatttgtcactctgacaatattataaacattatattaagactttaaagcaggccaggcatggtgcctcatgcctgtaatcacagcattttggaggctgagatgggaggattgcttgagcccaggaatttgagatcagcctgggcaacatggtgataccccatctttacaaataattaaaaaatcagccgggtgtggtggtgtgtgcctgtaggcccagccatttgtgaggctgagttgggaggatcacttgagcacgggaggtcaaggctgccggtaagctgagattgtaccactgcgctccagcctggatagtagagtgagactgtctcaaaaaaaaaaaaaaaaaaaaaaaaaagacttacaagagactttaaagcagctacaaaagttgaatcccaaagctttttatgaaatgtcagtgtcagcgttatggaaataaatgtagaactctctgaggtgactgttcttattgcaagaatctttttttgtttttgtttttttttttgagacagggtatcactctgttgcccaggctgtagtgctgtagtgctttcatggcttactgcagcctcgacccctggggcagaatctatcctcccagctcagcctcctgagtagctgggactgtagacacataccaccacgcccagctaatttttttttgtttttgatattttttgtagagacagggtttctctgtgttgcccaggctggtctcgaactctgagctcaagcgacctgcccacctcggccacccaaaatgttgggattacaggggtaagccattgcaccagccaagaatgttcttttgaaaatgtgttatgccatatttattttaaaagtcccactgaatttttaatacatataaaatactgaaatatgagttgtgtaattggaaaaatgtcaatgtaaatgaaaagagacactttttctgttctgaagcttcaaaatattaaagatcatcgttcatattttcctggggaatttttatttttagtcataatagtaaatgagcagccgtcagaagatatagccatttctaggtttagaattccttttctttatatagttctcttgaatacttgtctttaagaaaatagacattaaggatttcttgtgtaatcaaatactactttgatatttgtacagagcatgagagcaagactagaaccacattaaagcaggaagaataattaaaagttttgtaacatagcaaagaatagatggggtaatttacaatggaaaagtagacgtacagaacatcattagatgggatatagaaagctctctttaaaaaagggatatcagatcaaatagactgaagaatttgtatcctacaagttaagtaaaaaatgagatgagcaattaatgagaaaatgtgctctaaaatacttggttgcattgattggcaattcttttccacttcctataggggctatttcagaccttttctactaattttttttttttttttttttttgagacagagtttcactcttgctgcccaggctggagtgcagtggcgcgatctcggctcactgcaacctcctgctcccgggttcaaatgattctcctgcctcagcctccggagtagctgggattacaggcatgcgccactatacccggctaatttttttttttttttttaaagtagagacaaggtttctccatgttggtcaggctggtctcaaactcccaacctcaggtgatccaccctcctcggcctcccaaagtgtgggattacaggtgtgagccactgcgccggccttttttttttttttttttttctctcaaatgagacagggtcatgctctgttgcccagactaaggggagtggcgcaatcccagctcactgcagcctcaacctcctgggctcaggtgatcctcctgccttagcctctggagtagctgggactacaggcatgcgtcaccatacccggcttttttttggtattttttttgtagaggctgggttttgccacattgcctgggctggtcttgaacacctggcctcaagtgatttgcctgcctcagcctcttaaagtgttgggattacaggcgtgagccaccactctacttcttcctagggcctgattccagtgtactgctcttagactttgtaggttcactttttttttttttttaatgtaagatcaagactatccaacagaagcttcttcagctttgcttttctctctctctaaattgtgtaagttctgtctcccatttggtgtcagggatatgcaatatgccctttaggttttcatggctacctcttttatcccttctactgttagaatgtataggatcattaattaactcttttatcatttttattttaatcttccctagcaacaatttaatggcttaaacaaaaacctttccttattattattatttttaaatactgtgcaacaggccaaaggaaaaaaaacaatttatgtctgttgtttcaatttggttaccttattttttactaaaactgttctttctgttgttaccagtgaccttctgaattgccaaatggggattcttcagtcttgttgcttcagatttaacactgtgaaccacttttcctcctcccttctccttataactttgctgtcctcttggctcatttacaaagtcaacttgtttctcaagtatttgccttacatgtttttcattctctagattctttttcttgaaatgttacctattcttttggctttagtgagaatctcttccaggtgacccctatactgtaagttcctgaacgtcagtttccagctggagattgtcatctaattgtcatgctgtcatgcttaacccactcaaatttgaattttcttttcttttaaaatgtattttttctactttccttttttttttttttaaattattggcttttccttcccattatccaaacttgaattgtgaatcatctttgtattccccgtcagattcattcgcttgtcaaactatcagaggcctgtgaaccagagcaattgcatcttaaacaggagttgggtaaaatgaggctaaaacctactgggctgcattcccagacagttaagacattctaagtcacaggatgagataggaggtcggcacaaaatacaggtcataaagaccttgctaataaaacaggttgcagttaaggagccagccaaaacccaccaaaaccaaaatggcaatgagagtgacctctggtcatcctcactactacacttccattagcaccgctctatgacagcttacaaatgccatggcaatgtcaggaagttaccctgtatggtctaaaaatgggagacataaataatccaccccttatttaccgtatcatcaagaaatagccataaaaataggcaaccaacagcccccgagactgctctgcccatggagtagccattcttttatgcctttactttaataaacttgctttcactttgcactgtggactcgccctgaattctttcttgtgtgaaatccaaaaaccctctcttgggatctggattaggacccctttcctgtaacatgtttctctgtcctgtaacctatttctggcaaccacagaagagactatagtgcagaaaccctgacccaacggctacctttgggtaagtgttgggatcctgtaacaaaactgcgaattctatcactacagtgtttatctcattcatctgcttttttctgtttcatttttttttgataacagtttaggttctcattaccactaacatataaatatataattataattcagtaattgctatgatgaagggtgaggtggcagaggaagttctagtaggatatggtacatagtgatgattagcttagcatcaaaaacaagtaggggcattccaggaagacaaactgaagaaaggcttattaggagtgtgctatgtgtttgttgtcaacttgtgagacttcttctttaatccttactgcagttgtgtgcttttcgtatttgcatatgctattgcctttcttcagatattgattaaaatttgtgaaagagcatgcaatggcagaatgacacaaagtaacatatatctttattacctagctttaagtgagtagagtggtaaaatgtaaggtaatgaaaagtgagtactgcctgcactgaagatttaaaacctgatataatttgcattaaaagctgtcttgaaggtttttcactatttgtaatgtaaatcttcactaggcagctgttctcagtctactgttgttatatgtggctttatcttttatttctacctctcttctgtctcttctctctctctctctctctctctctctctctcgctgtgttgcccaggttggaacacagtggctattcacagatgtgatcatagagcactgcaacctgaaactcctggcctcaagccgtcctcctgcttcagcctcctcagtagctagggctaaaaatgtgtgccaccaggctcagctatttctacctctttcaaatgtgtgtgattgccctacagtggggttgggtaatatcttgatattagtagccactaatactgaaaataactgaaggccacagcaagtaaagagagaatttactatttttgtttccttagagaagccaaatattttgtgattttaaaatgggaagcattaaaaacaacaattctaaaatgccttatacagaaaggtgatttattggctatgtaaataggaagaatagagatggagaagtccaggaacaaccagatccaggaacttagatgctgtcttcagagtattctagcttcattttattttttctcctgttggcctcattttctgcttatgttagaaagcttctttcatggcaaggatgcatggcctcagacagctgagaacttagttccctaggatggcctctgacaggcttatctctgggctaatcactgtggggaattgtcgttgacattaacatcagaaccacacaaatcgggggtagtgtcagttccccagaggatagatgttgttaaccagagaaatagggaaaaggaatttgaagtagcaaaaacaatgtaaagccatttcagaggcagaagaaagaaaaggcaatagtagacacagtgaaagagaaatacttacataggagagagaagcagggaaagggaagggaactagaatttaagaattcaaaactaagaatttactgtgtggtaagcctgtgttaagcgttttacattttatctttacagctcagtggaggcagctgtattatctccagaggataaccatttgtagatctggtagtgaaaagcccccccaccttttttttcttttatcccaatttggcatatttcctttattttttatacaacttttttcatttttaaattatgcattaatacattaaaatccacactgcgatacacagttctatggattttggcaaatgcatataatatgtatctaccctcataatcaagacacagaactcctgctgcccatttgtagttaacctctccccctaagttcatcgccctggaaaacactgatctattctctatggctaccattttacttttccgaatgtcatacacagttgtcactccttatctgagggaaattagttccaaaaccccttcagatactaaaattcacagatgctcaggtcccttatgtaaaatgacctagtgtttacatatacacacacatcctcctggtactccagtcatcgctaaatataatatacaatgtaaatactatatacatcgttgttatgttgtttatatgtattatttttgttgtattttttttactataatattttctatccatattggttgaattctcagatatggaactagtggatatggagggccaactgtaagtgacattgtagttatatagacttttggatcagcctcttttacttagaaaattcattgagattcatttatgttgcgtgtatcaatagttcgttcctttacattgctgagtagtaatctgtggtatgaatgtaccatggttagtttatccatttgtctgttgaaagacgtttagcttattgctggtttttggcaattatgaataaaactgctatagacattcatgtatagctttgtgtgtgatcataagttttcatttcacttgggtaaatacctaggagcagattgctggatgatatggtaagcatatgtgtaattttgtatgaaactgccaaattgttttccaaagtggttgtaccattttgcatttccaccaacgatgtttgagagttccagttgctctacatccttactagcacttggtagtatctgttcctttttctttcttttttttttttttaattttagctcttataataggtgtatagttgtatatcatgtggttttagtttgcattttcttacaattgacttttggtgtatttttattttcgtgtgctttaagatatcttcccttttttttttttttttttctttaaaagacagagtcttgccgtgttacccagactggagtgcagtggtgtgatcatcactcactgtagcctcagacgactctgaactcaagcagttcttctacctcagtctcccgagaagctgggaccacaggtgtgtgccaccatgtctggctagtttttaatttttttgtagagacaaggtctcactgtgttgcccaggctgtaaaatatctttcttgagctggtcctgatggcacaagtgtgtaatcccagctactcaggaggctgaggcaggagaatcgcttgagcccagaagtttgagatcaccctgggcaacatagcaagaccctgtctcaaaacaacaacaacaaaaacttttctttaacattccgagaatgcttattggctttaaaaaacaatgatagtggccaggcacagtggctcacacgtgtaatcccagcactttgggaggctgaggcaggcagatcacgaggtcaggagatcgagaccatcctggctaacatggtgaaaccctgtctctactaaaaatacaaaaaattagccaggtgtggtggtgggcgcctgtagtccagctactggggaggctgaggcaggagaatggtgtgaacctgggaggtggagctggcagtgagccaagatcgtgccactgcactccagcctgggcgacagagcgagactccctctcaaaaaaaaaaaaaaaaaagtttttttccaaaatagaatagtaaatggccctgacaaggtctttgacaagcattggggttgcacactcaactgtatcacacaattccaggggacatcattcacataaaatttttttttcttttttcctactggagttgtgcagtgtagcagtctgggctatatatttacagttattatctaggattatcagtgattaggttccatggaaaatttgagtactaccaaatgatgcatttaaaaagcatttttcaatgtttctctgaaatgaaatttttgtccaggagctagttctgaagaaatgccctacaggcagtatgtctaatggatcagacctgggagacataaaggcctatttcaggtactcaactctgccatttactgcatgagtgaccttgggcatcttgtctagcttctttgagttcattctttatcagcaaaacaggattgataatctctcctttttatagatgtgacaagaattataaataatgcatgtaaaatatctgatgtagagcagacctcttcaagttgcaactgcttttacttctgtttattagcacttagtactgattagccacagctttttatcaaacaaaagcttagggtatcagcaaagcagaaagaaaagaatttgaaaaacaattgaaagcatttactacctaacatttaaaaaaatactgaagtagaattaggaaagaaataagaatttattggattaaatgttagctgtttagtattgtttttattttgtatttaatagggagagaatagagggctatactattatattttctgtacttgggacctccaaaggtcttaatttggtcttatcaccactaacaccaccactgccatctccatgtcatgcttgtgttaaagaaagactttgaaatacgtcacctaatgtttagggtcgtagaaatgcaatttactgttttgggactagagtacatgaattcatattacttgacatcattagttcttcccagtaaaatgagaatatttgaggtcccagagtattttataaggttttaaaaacttcataatttcttaatgtttttttgttattacccatagtgattacaataaaatccttaaaacagcaaggaaggagaaccaaggagattagatgtgctttatggatgcaaggagagaggtttagcaagcaatggagtagggagtaaagaagaggagtttagcctgagtttctggatctaggaagtaatgtagaagtcttaactgtagaagagtctttatagtgatagtgattttttttctttgattttaaattatttctgctttggtgttttctgtttgttggacatgttggtttcatacctctgtatagtaaagaggttttaaaactttgacccaaactattttggctcacacttttacttctcatatgggcttttataataatatggagagaggggataagaagttgtctaaagtaaaatcaaaagttgtttgtccatttcctctctcaagtaagaatatatcaagaatatttcagtctagccattttgtagcttgagattagagaaggaaagtttacattcacatgttaccttcatctgcctttcttgtctttgacctgttacaacagaaattaggcagttttttttttcccctcacatattcattctctgcttctctcaagttaatgaaacctagatagagggcccaattgccacttgctgaaagaacaaatttctgaagttctcttgtagcaagttactaccttgtgactaaattctggtcagttagatgtcagtagaagtatttggtatttcccagaagtctatttaaaggaagagctttaccattctttatcattttttccagctgccaacttagatcatgaggataggggctatacttgtaaggatggtagaatggagagctggaaagaccctgtatatttatgtcatggtagagcagctctggagtattatcagattattttatgtgagagagaaataaacttctgttttgtttatgccatagttattttggattttcttattatgcattgctgaacccacgatccttcacacctccatctaaggcatcttcccttctgcttcctgttctgtggttgaactcttggtgctgtttcatctctccactgctaagtccctgaattctcttgctctccacattttctataatgattgttcacaggcacagtgttgcagttagaagctgctatgcattgctagttatgtagcacctgaaattttaattttttaaaaagaaactttaacaggaatatgaaggaatgtgtaagcacagttacacatattttatttcctaatgaaaaatataatttctaaagaacgatgtgtccattaagtctcccctgccctccaattttagttgatacagattggtttggctaattggctgccagcagttcctctagagaatatgtctagatcactaacagacccctttttacttgcctcttttggaaaactcatcctatccctaccctagtaacatgatccaaatggaagcttgttactgtcacagttattggttcaaggatggatatgtaagcaaaaataccagctctgtcctgggtttttagaactgcatctagcagaaaggagatcctctctacttttgaggctataaggatgtggacaaactggtttaggaggatcatagtaataatactcagaacagaagtagagatggagggaaacaagtcagtcttcctcagagaatggacatgtacctcatataggctaattagaatattttgtttagtaacttgataatttcaagtcagactctgttgggcacttgaactggagggtcatgtgaaggacagaagtttctttaaagccatactcctaaatgtaaataaatatatttaaaaaattttaaagggtgatagaaactatttcctttcttactttgaagggggttcctagctggtacataattcatactgtctcagttattcaaacaaattactcatttaataaagcatttcatggagaggaaaagaaactacaagttttttctctatggatgtggagtacttttaaaggaaaataaatgctcccttaaacaccaatagcaacaataaaatatgcacaaaagcctcctagtgttgagaaaccatcacgtaagtgctgagcactctagttctgctcgtggatctctttacaaatagaaaattatcttatctcttatgtttgttaaagcattatttgccatagctaagatatagaatcaacctaagtgttcatcaacacatgaatggataaagaaaatgtgtgtgtgtgtgtgtatatatatatatatatatatatatatatatatatatgtacacacacacagtggaatactgttcagcttttcaggagaaggaagtcttgatatttataagaacatggaagaacttggaggacattatgctaagtgaaataagccagacacagaaagacaaatactgcgtggtctcacttatatgtagaatctaacaaagttagactcatagaagcagagaatataatggtgattaccaggagctgtcagctggggagaaatggggagatgtggttaaagtgtacaaagtttcaggtatttagaggaataaattctggagatccagtgtacagcatggttgactgtagttaataataaagtgttgtatacttgaaaattgcttagaaagtagttttttttttttttaaattgaaatgggatctcactgtgttgcccaggcttatctagaattcctgggcacaagcaatcttcctgcctcagcctacttagtagctgggattacagacatatgccaccatgcccagctagagagtagattttaagtgtccttactattaaaacaaaaaaagcttggatatatgagataataggtatgttaattagcttgatttaatcattccacagcgtacacatatatgaaaacatccagttgtacacaatacatatgtgtaacttctatttgccaattaaaatgaagtttaaacattgtatccatctggagttcctcttgtgggaaaatgacttctttggccacctaaggtctttttttttaaactcttaaatttgagacatctatagttggtataattggtaagtcacaagtattagtgagaattttatttgggtccatgaagaaccaatacaggcaataaaacacaccaagaattagggaaaagctaaagcatagtccaattatctcaattattgtaaatgagaagtacccttcacctaaatgaggctgagtagaaacttccttacctctgcaacaatttataactgtggaattagaatttagattcaagctagcaaaactagagctacattttatactcaaaactatgtctgccacttaaaagaggaaaaaaaagaatgaatataagctggttatattgaagtatattttacacagattttttttagtagttaatttcttatttagataactaggaagggtaagtggaaagatacatatgtttttaaagaggggcaggtaacttttaattttctttgtaactttcagaatttctttccctacttgatatatggagacctactgtagaggatgtttgtggagttagaagagattagggttgttgaaatacagatgtcagtttaattgtaattcatagtattgaaccttagaatagtgaccattttctgttttcacaaattttagaaaagtatacatatatgttgataattattaaaaaatttgaaccaagctttcgttcacagtgagatttgtttagtaggtaaattattttatgtttaaaaatgagtacaggtctgggcatggtagtttacacctttaatcccagcactttgggaggccaaggcaggttaatcacctgaggttgggagttcaagaccagcctggccaccatggtgaaaccccatctctactaaaaacacacacacaaaaaaaaaaattagccgggtgtggtggcacatgcctgtaatcccagctacttgggaggctgaagcataagaattgcctgaatccgggaggcagaggttgcagtaagctgagatcgtgccactgtactccagcctggtgacagagtgagattccatctcaaaaaaaaaaaaaaaaaaaaaaaaaaatcagtttgtatttactcagattttttttttttaattatactttaagttctagggtacatgtgcacaacgcgcaggtttgttacatatgtatacatgtgccatgttggtgtgctacactcattaacttgtcatttacattaggtatatctcctaatgctatccctcctcctcccacaaccccacgacaggccccggtgtgtgatgttccccaccctgggtccagttgttctcattgttcagttcccacctatgtttactcagatttaatgggattttatctgggttttcaaagggctcccagatttaatctgggttttcagagggctccctagataattcttagatgcatccagattgagaagcatgaatccagagcaaaacagaaacagctaagggtggactttttttttttttttgaggctgagtcttgctctgttgccaggctggagtgcagtggcgcgatctcggctcactgcagtctccaccttccgggttcaagtgattctcctgcctcagcctcctgagtagctgggattacaagcatgtgccaccacacccagccaatttttgtattttgtatttttagtagagacatgtcggccaggatggtctcaatctcctgacctcatgatccgcctgcttcagcctcccaaagtgctgggattacaggagtgagccaccacgcctggccaagggtggacatttgagggcacaaacatttgaggtactgaccatcataaatacatacatacatacatacatacatacagtataggcccgctgtggtggctcgcacctgtaatcccaacacttggggaggccgaggcaggtggattacttgagcttaggagtttaagaccagcctgggcagcatggtgaaattctgtctttaccaaaaatacaaaaaattagctgggcatggtggtacttgcctgtgatcccagctacttgggacgctgagatgagaggattgcttgagcccaggaggcagagtttgcagtgagccaagttgggcctgggtgacagagtgagaccccatctcattaaaaaaaaaaaaaaaattaagaatacagtatagaggggcatcctacaaggaaaccttactcatgcaccataaaagtggtcatcagaaacagggaaatctataaaactgtcacagacaggaggaacttaaaactatgggctttagttaatatatcaatattcattaagtatagaaaatgtaccatactaatataagatgttaataatagggaaaaccggatagaggagtagtatatggaaacttactgtattatcttcagaatgtttctgcaaacctgaaactgttctaaaaaatgaagagttttggggtgggtgtggtggctcacgcctgtaatcccagcactttgggaggctgagatgggtggatcacgaggttaggagatcaagaccatcctggctaacgcggtgaaaccctgtctctactaaaaatacaaaaaattagccgggcatggtggtgctcacctgtggtcccagctacttgggaggctgaggcaggagaatgttgtgaaccctggaggtggagcttgcagtgagccgagactgcgccactgcactccagcctgggcaacagagcgagactccatctcaaaaaaaaaaaaagagttttgaaaatcaaggctgggtgcagtggctcacacctatgatcccgcactttgggaggctgaggcaggaggattacttgaggccaggagtttgagaccagcctgggcaacatagcaagatcccatctctacagaaaatttaaaaattagctgggtgtggtggtgtgcgcttgtggtcccagctacttgggaaactaaagcaagaagactgcttgagcccaggaggttgaggctgcagtgagtcatgattgtgccactgctctccagcctaggcaacagagcaggacctctaataaaaaaaaaaaaaaagacaccccaaaaagtagttgattttcaaaaatcatgagtaatataaactccttgagttcagagtcatttgacttaatattggtatgcttagggtttagcagagttaatacaaaataagctttaaagaagtgctaagtgacaatgttacatttatgttattttgtagaaatggcttttggaaagatgagaagtaacttgacaagctttttaatgttttcaataagtttttactaaaagtttataaaaaattttaatttagtaaaacaaattgaaaatatttgcataaactttctcttattgcttgagaggccactttgaaactcttaatgttgcacatggttctgaaaagacatcaagcttagtttagtttataaaagcatttcattaacagagtgggtgctaaatagtaaacatagttctttgacaagtagagttaaatgtaatatttcttttaaaaaactgagtacataaacctatttatccagtaggaaatgcaagtagaaatcacgagataccattacttacctattagaaaagcaaaacaaaaacaaaccaacaaacctagacaatagcaagctgacagagatacagagcaactagaactctcctgccctgcagatggaaatacaaaaaagtatacagctacttcagagaacaatttggtggtttcttataaagttaccatatgagctggcagtcccacttctaagtatttacccaaggaaatgaaacatgttcctgcaaaaaccagtaatgctctgttcataattgcccaaaactggaaacaacccaaatggtaatgtacatatagacaaatattaatgtgtgaatggacaaactatggtacatcatacaatggatgatgtaccaattataaaaaggaatgaactgttgatacgtgtgttgtagcaatttggaggaatctcgaagacattatacttttttaaaaaagctagtctcctgattccatttacatgatattttcaaaaaaataaaactgtagtggtagagaatgtgtactggttatccagtgctatggtttgaatgtttttgtcccctctgaaaattcatgttgaaacttaatcaccaatgcaacagtgttgggaggggggcccaatggaaggtgtatgtattggttcatatgggggagccctcacaaatggattaatgttgttataaaaagggcttgcggccgggcatggtggctcacgcctgtaatcccagcactttgagaggccgaggcgggtggatcatgaggtcaggagttcaagatcaaccaggccaagatggtgaaaccctgtctgtactaaaaatacaaaaaaaattagatgggcgtggtggtgagcgcttgtaatcccagctactcgggaggctgaggcagagaattgcctaaacctgcgaggcagaggatgcagtgagccgagatcacgccactgcactacagcctgggagacagagcgaaactctgtctcataaataaataaaaggataaaaagggcttgctctcttctgcttttctgccatgtgaggatgtaacatttgtctcattttgtcctccacctttcaccatgagtgtttacagccagaaagatcctcaccagatgctggcgccttgatcttggacttaccagcctccagagctgtgagaaacaaatttctgttgtttataaattaccctctctcaggtattctgttatggcagcacaaaatggaccaggggttatggtgggggagggtgtgtgactatggagagacagcatgagggagtttttggggtgatagaactgttctgtatcctgagtatggatatacatgtgttgaaattcatagaactgtatactcctacttcctcccaaaagtctgttttactgtatgctaacttaagaaataaaatggaagacatacaaagaaactgaacatgtgtctactttataaggcatttggtctaactactggtcaaataaacttgtataaatactgtctaatgttttctctattagattttttttacgtctcaaggatttgtatgaaaagtgactgatgcacagaaaacctttattttttattttttaaaaagtagaaacagagtctcactatgttgcccaggctggtttgaactcctaggctcaggtgatccccctgccttggcctcccaaagtgttgggattacaggtgtgagcgactgtgcccagctagaaaacctttcatattaaaataattagcactataatcatgtgcaaagaattgggatggtcacctagtacagcttcacattttaaaataggtaacaactatcatttattgaaataatgctgttcattggttttataacccaagtgatactatatccttagacactgtaatactacgtatatatgtatattttgaatttgatacgtcttttaagccttttaatctacagatcccccatctcatctgtctctttttcttacaagttagctattgaaccctgggctgtttgccttgtagagtttcccacagtttgcattctgctgattgcatactaatagtgcagtttaacactttcctctgttctctgtatgccctgtagattttcagctggattcagaggcttgatcctaattaggtgtgatccctttggcaaggcaataggaagtgtgtcatcagaaggcacttggctgtttggatgactctctttgtgacgttagcagccattgatactcactacttagatggattaattcattggaggttgcaaaatagtgatagtgatattctaaattatttctttttaatttattacttagcatacttccatagaatattttcttcatcactgtttggttattaaatagtataattcacaaggaaagccaggataaatacttgattctttatttttatttaccagttttcaagatactgaaattgttacatctaaacctgtgaagatgttttagggctttttttttttttttaacatgtttagattttcattcattgcaattaatatgcttaatgaagctcaaattgttgttacatctttgaccagtgggagcctgcccctcaccctctctctctttttttttttgtaaagataggttctttctctgtttccctttcctttccttacttttcaggcagagttttgctatgttgcccaagctggacttgaactcctgtgctcaagcaatcctccagcctcagcttcctgagtaactgggactacaggcacgtaccaccacacccgactctgctattgtttctttaaataaacattctgcccctttgtctgtctcttctctctcttcagctcttataatctgaaaattttctctatgctatcctataaatgttgtaacctttctttattttcatgtttttcccttctgggtggtgaaatctggtctctactaaaaatacaaaaaattagcagggcatggtggtgcatgcctgtaatcctagctgcttaggaggctgaggcagaagtcgcttgctcctgggaggcagaggctgtagtgagctggatgtcccacactgcactacagcctaggtgacagtgaatgagactctctcaaaaaaaaaaaaaaaacccaaaagaaagtaaattttgtttgagtttgttactaaacttggtgaatataagctgcattttttagtttccagtaaatcaaggcgcagtgtaatcattgtacattttatgttgaagagttataggaaaatacctttattttataataatgaaggaaaaggactttttggattggaaaggaatgttttgacaaaagattaaattaaaagattaaaacaattttttcttctgaaaattttttttcttcaaccagacaagataccattttttcaaatacatacatttttttcaaatggtatcttgtctggttgaattactagaatgtttttggcgtgtttagtagcaagtggtaagttcaattgaaatacaagctgaaaaattctaatggcccctggaagatggcagtataggcttttcatctcagaattttagatctggaggagacctttaaaatttattccagttccttcattataggagaatatctagacatctagggataatgatatgttatttctgagatcacatagtaaatttctgtttagagctgggactagtactaaacctcttcgtttctgtttcgggattagtttctcaatgccagaatgtgtttcttgaaaggcacgataaccagctcctgggctcctcatatcctacctaaattagtgcaactaaggcagtgtgacatatttatattggtatttttataaaggcacagaaacagacatgatttattcagtatcacagggatagtgttaggtcataagacccctgacctgttgattctatctctttatcttacctagtaagagatagcttagagatagtagccaaaatatccaatggttatgaactatagattgggagctggaagtggagctggtactagaaaccataaaaacgccagatgatgtttgtggtatggtgaagagtgctgggatgatgcaggcagggggtgatgaaagctttggtcatgagtaagtgggtctagaacctatagaatgggggggcggaataaaggaggcaatggagctaccatcaaactcatgcttatcaggaggatcgtttgttctgttctcattccctatagcatattgctactttccagctaagatttagaataatcatagacaataataaaataaaatacatctgatatctgcacaatattttaagcacagtactcataaatattgtactgtttgatccttgcagtatccttgtgagataagtagaagggatattggtgagtagaaactattaaatataatatgtgttaaggtagtgtgctagaaatcactaagggatataaaggtgaataaccacaggctctgttctcatggtgtgcccaatcttttggggatggggtgggaaaaataaacagttacaatgtataggaagttgaaaaggatttagaaattcaagctgtgtcccatgggaatttagaaagagtgatggtattgtaacaggaattttggtattttgccttcttaattcagactaactgaaaggataatgactgtaaaagcatcttgactgtaatagatactgatacgattttcctttataattttcagattattttttattttaggtgattttacacagctatttatatgaatgaatttatgaattaaggatgacagaaatcacttaaattgttttagtgatttttggcatattagtctggtttgagaaggagggagaaaacaagggaattgattttgtaatgtcaaacagaacttacaaatttaggacagatttacctagaccattatgaataaataaatagatccttttaattggtaagaaactagaccaaatttaatatagttgatttagtactagtttatgttgatgatgtagacaacttcaccaaaggaaggggagtagtgaataaattagttataacttattttactgtaaagtaatgttaattgttagaataattataggaaatatttgcttaccaataaatatgactttgacagtcttacaatgatgaattcgtttttgttgaaatagcagacaaaacagactttttcgttttgttcacttattcctagaatccattttagtctctagtttttgttagtatgtatcacctaccttaactatttttctttttgccaaaacagaaagaatgcggcttccgttgatatactggagtcacttagaatatcaatatcaacactacagagaaaggagaaggaaaggaagcaatataccattgtcagtgtgcttttctcttctgaggctttcatccttcttgtgttttctctcttaacattggcccatagctagaagacattgaggtcctgccttactgcatttttatcttagccatgagcagcataccccatactatatttaggttgataaattttcaatagtaaaattcttcatagtgagcagcctcttctaggctgtcgccacccctgccttaccctatttcactgtggaaagctcactttcttggttgaagcatctccctgtttgaagtccagctttggggaaacctagaatggccttaggaccatcagtgttacaagactcagtagtgcctgagtcatacttagcttttaaaacatgtttatagctttcactttttatgggtaaatagcccttttattatcaacacagtacttttctctttttcttaaaaatgaccaatttcaccactgatagagttaatttttgtcatctgttaaacatgttttcccatgactttgggttcttcttcatttcatatgtgattttgtgtgcatatgtatgcatgtgtgtgtggtttccttttttagaacaagatgtatttctttgaagatgagactcaatgggccatttgctgtttttctttcctcatctagggtaccttcagtttagctcacagttgtctttcttcctaatggtgtgggtaaaaatgactgactctgttcaatattacagattgaaaataaaacctgtgattcctagcctctttattttatacttctttattttaaagtctaacatttttctttctttatgctttcttttttctatcatggagataacttaagatgtttatttagttctataggtattctgtttctcctgaaaacttatacttatcgttttacttctcttcctttattatgttcatgttcagttagtctacagcagatcttgtaacgttcgactgaattctagttccactaacgataagcaagtatagcatttcttcttaagtgaataatttcttccatatatttgatgtggatatgatattatatgctgcactcttggttgtatcttttcaggtatatttctttttctcagagaaatctttcagtttgtatcttttctaaaatggggtttttcttacgttgggtttttattattgctgattactggatattgtttattctttggatgctgttgatattcacctatcatgaaagtaaactttcatggttaatcatttttttctattacgtaatgaagcaggatatttccctgactcctttgtgggactcgcaacaggggtgccttgtttacccagcctaccacccttccaccctattttttttttttttgagagggagtcttccctctgtcggccaggctagagtgcagtggcgctcactgcaagctccgcctcccaggttcacgccattctcctgcctcagcctccctagtagctgggactacaggcgcctgccaccgcaccccgctaattttttgtatttttgttagagacgaggttttgccgtgttagccaggatggtcttgatctcctgacctcgtgatccgcccgcctcagcctcccaaagtgctgggattacaggcatgagccactgcgccttgccccagcccaccactcttaactccttgtggaagggagtgcacaagtgaacgggtgtgggaattggagtgaatgagtactgaaaccagccggctgctttggcgccagagggctcaacctccactcactcagacccactgcgttctgcccctcgcaggagggagtgcgcatatgagtgggtgccggaacggccggatgctttagccacagcaggagtgaactctctgcaggccccacagcagtgtccaggagcgggtgcctgcgactattgaagctccagagggtgtgttacagtgctcttttagctccgctgtccgtggacagcttaagtgctaacaactcagtggaccctttgccttctttttgtgaagtggcagccctctgccagtgaggccaaagggccactgtgaaagccttttgtatccacacttgtggctcctgagctcttgtctggcgcccaggaaaaatgaggttacatgaatgaattgaaagatggtaaatgcaggggattttattggaaatgaaagggactctcagtggaaatggaagctgaaaaggggacagggtgggtaggtaatcttcccctgggaagttcagccatctctggcaagattcttctctgtagtaatgccatcaagctgtccttctgaagtcaagccacctctctccaatatctagccatcgtcttgtctaccagctgagtctggggtttttataggcacaggatgggatggggcaggaccgtgggtgatttaggaaaaggcaacatttgagccagaaaacggagatataagctctcactttgggccatggttacaggctttttggcttgagggtgaggttatgctggggacccaccattttctgcctagaatttctctgtcccccgttcctgtcaataatatgcatttcttaaatatctttagtttctcctatggtaatattttgttttcatatgagttccttctcattcttagatcctatttatgcttctttgctttaggataacttattgacatataagtggtatttattgaatacatctaatttttagaaaatttcagcattcagtgctgtcacaaagttaattaagttcatagtccccctttaaaatacagtgtttccaggtaagatggactaatagggatggtctttccacctaagacaactaaagaatgggacgaaataatgaaaccacagttctcaagacatttgccgtcaagcagcaaaagacattgatccccaagggatgggaaacaaattaggcgagatcatgcggttgctctagctcacacctagagagggtttgtagggatggaacaaagcagtggaacccaggaggagcctagagatttctctgtattgaagaggtagagctagctgggagattggggggccaaggcagctagagttcacaaggtagagtatgagaaaggagaaagctgcaagagacagaaattcacagatctgtagaaattgctttcaataattcaattgactactgatcaatacatgcctgtaaggaaactatgggaagctgcggaagaaccaccaaaaaggaattgagggaataatataataattagagctcacacatggttaggagtagggcctgaatccatcagacaaaaaaacttcataattcaacaggtatgtcaggtagaggacttccaacgttctagtttttatttctagatgttcaacttgggtcttttttgtctgtgtcttaatatacttaacctttcttctggcttttagtacatatggaacagatatataataacttttaatgtcctagtctcctaattctatcaaccctgtcatttctgggttggttttgattgattgatagctttccttctggctctgttttcttgccttagtttttttaacctgctagttaattaattgatgcatatcaggcatgtaaaataagacactgtaaattgtgccctgttgggtgctggacatttttatattcctatattcttttttttttttttaagagatggggtcttgctctgttacctgggcagtagtgcagtagcatggtcataggtcatggcagtattaaactcttgggctcaagtgatcctcctgttgcaacttcttgagtagttgggactacaggtgtgtaccaccagccctagtgcctgcagatatttttgaactttttcctggtctgtattgaagttatttgaaagtgttttttaacttttaggtattgcttttaatctttgttaagtgtaaccacttaatttaattttccccactactgaggcaaaacccttctgaatattttatgcttcatgaattatgagacttttccattctggctgttggttacagatgttaaattgaggatcagattgtcctttcatggcttgtttttaagctctattgggatcattatagagtcatctttattctagggcaaatttagccctcctgaggtctgtacctatggcctagagtgtaaagagatgtctctgctgtggctggatggaactcagatgtctccaagctcagtgtcagcccagagttgttcatattatagctcctggaggatgttttttgtctgactttatggaacttcaccctaagcatgtgtagattagtatttagttgatgactcaagtggaccccaatgtacatatctgtagcttttttctgcttaagtttctcctttctggtatatcattctagtaatttttgccacctccactgttccaaactctgttcttttcaagttagcaagactgctgtattctgctttgaatttccctcttggcaatggtgtctagaacatgtctctaggcagaaagccagggtggtcataggccttatctagtttgttttcttgtttcagggaacacagatctacactaattgttgttcactatctggaaactgtcatgtattttgtctggttttgcagttgcttaccatctgagggtaaatctgttaccagttattccataatggctggaagcatacatttcacactattggattattgaggagtttggcaaagacttttgggtgaagttacaggaaagaattacaataaacctttgctgactttagacttgatggctgtttaataattgtatgtttatgggctttgggagtagttgactatgtcttcttcaaatagatgtatgagataatgtaaataataaagcattatacaggctgggcatggtggctcatgtttgcaatcccggcactttgggaggctgaggcacgaggattacttgagcccaggagtttgataccagcctgggcaacatagcgagacccagtctctacaataaagtaaaacaaaataaattttaaaatcttaaaaaaaaagaaaatagttgtgttacctttgtggtgggaggagtttaagttggtgatattgcttttatattagttgtaattgcctaaaattgttttcagtagactttgatgtcattggagaaaaactgcttctcacaattaataatgtcaatcagagaaaaatctcatgttgttgacataagagtaaagcaagtggcagaaacacacatttctatagaatatattgtgtctttgtactgttcttgggtttttgtacttggtgacttgcgcatactacacactcagtgaacatttgatgtgcgaatctttattaaggccatttcacttttcagttaatcatattgattactgtgtgccaaacatgatactggatgagggagaggcagcaacaaatgaagtaggagaagggcccctgatcaaaagactgcatgagatggtgcatgtataaggcagcaaaatactctactgaagattaatggagtatagaatgattatgtcagctctcaggcagggaggtatagaggggctggattttgagaaagttgatggatatgcattgattgataaaggagaaaaaaatccctgttttttaaaaaaaggaatgttgtattgcagggtgacaactgagaataaacaaattgttctatggaaagaaagcaaaattaaattggtgttagtggaagtttgtgtagaagatagtaagaaactaggttatgtagctaaccgaggtgtcatacaaaatcgaggggaaatacaaaagattttgagctttggtctgaaaagaggtacacttctgaatgccttttatgttaaaagatagacaaagttaaagaattttatattcacaaagcaagttatatgagcgctaacttattgtaagttgaactatgaagcaaattaaaccactgagtgttactgagtttgggtataatttgcaaaatgaaaacccattttttgttgacatttggaaagtgcttacagaataagtcagtgtacaaaataagtgaatttgcatgttatgactggctacataaagaaaagttaaaggtatttaaaaaattatataataatgctaactgaagcttgagtagggctgaatttcatatatttttattttgtttcaggttgctgcttttgctcagaggacatccatgaccctaatggtctttttgttcaagataaagtgattttttgcctttgttgattaactggacaaattcaggttagtgtattttgtggacagcacttccctgttctaattatatgttaatattttgagaaatagataattttgtggttaaagctacatgttatgtaccagtaaagcagaaaggccaagtcagtctaaactctgttgaattgtgtattagttaagaaacattttcttactgcctactatatacaatattcactgcataaattgaaaaaaatttacttccttttaaatagttttgtactttaaattatggggctggataaaacaagttgtggttgaatgcggtacactgaacttttggcatcgttgtgtggcatatttggtgctaaaaataagcaactcatcttaaacatttctgacatttttagtagctggcttttaaaggtattcttgtccagatttcagtcctacattaacatttttatttatttttagtgttcattctattaattttgacaaatatatatcaccacaattaaaacattctctaaaccttccaaatttgctcgtgttgcctatttgtagttaacctctccttatacctcaatccctagcaatcactgatctgctttctatccctgtaatttgccttttccaatgttatttaattggaatcatctaagatgtagtttttaaatcctggctttcacttagaataatatatttgaggtttattcatgttgctgtgtgcatcagtagttgtgtatcagtagtttgtccttttttattgctgagtagtgttccattttatggatataccataattagtttattcatatacctgtttatggatatttaggctgtttttagtttttgatgatcataaaactgctgcaatcatacattaaaaaaatgtgactctatgttctttaaaaaatttggtggggcatggtggctcaaacctgtaatcccagcactttgggaggctgaggcgggcggatcatgaggtcaagagatcaagaccatcctggccaacatgatgaaacctcatctctactaaaaatacaaaaattagttgggtgtggtggttcacgtctgtagtcccagctatttgggaggccgaggtaggagaatcgcttgaacccgggaggcagaggttgcagtgagccgagatcacaccattgcactctagtctggtgacagagtgagactctgtctcaaaaaaaaaaaaaaaatttttttttgcattgatgcatgttaggtgtacatacttatattcagggtacatgtgataatttgatacctttatgtaataaaatcagggtaattggaatatccgttaacttaaatattcattttttctttatattaagaaaatttgaattattctcttccctagctattttgaaatgtacagtcaactaagtaaggttaactataatcaccctattgatctattgaacaccaggtcttatttcttctaagtgtatgtttgtacccattagtcaacctttcttcatcccctgaccccatgtattttttactaatagaaattactttttgttgttgctactgttaaagcgctgtgatgatttaactattgccttttaggccatggttgcatttcttttttaaaatgttattaaaacataatgagaacacaatttaacagacattgtggctaggggaagaaacttgcaatttatggtcattttgagtatagaaagagaaatgatgtaaaattattagaaaggggatctattggaacttgtggtgttccctgattttggagatactaggtagccttcttgaatatagtggtagtgtagcaagacgagctgcagacaaaacctctcagacaccgagttatagaaggaagggctttattcagctgggagtatcggcaagctactgccttaaaatctcagctccctgagtgcacaatttctgtcccttttaagggctcacaacactaaagatttcacatgaaagggttgtgattgattggagcaagcagggggtacgtgacaggggctgcatgcactggtggtcagagtgaaacagaacagagcagggagtttcacaatacagtgcctgaaatctatgtgtaacatcgggttctaagtcatgagttgatttttaactactaggtttaggccaggcaggcccaggcctggttttgggcctggtgccgggctgcctgtctttgatttcacttccttgttttttttcttaaaacaggtactgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttaggaggctgaggcaggagaatggcgtgaacccaggaggcagagcttgcagtgagccgagatcctgccactgcactccagcctgggcgacagagcgagactccgtctcaaaaaaaaaaaaaacaaaaaaaacaggtactgagtgtaaaacaatataaaacaacatgagagggtctctcttccctcagtagaccagaaatatacaggtagattaataacgtcaagcctcatataggtagcttcaaaagtcatctagaaaagtcaagtaaattagaattctatattaaaaacatacttaaagagggtaaaggttgggcatggaaaagtcagtttaaactttcttgaatgaatatgtaggatgaaagtgatagaaactgtctttctgccttggggaaattaatgacctcaaaaagtagcttgaaaccctatttgaatatttataaggaaactgtagttcattatttgttatagaaataaaaaggtcttgagaaagtattatgctctgactcagaaaatgtaggatggtttagactctagcttctaagcctggacattaaaagacttactgcaactttaaattgttttcttgtttctgaacatttttagatgaattatgtaattttcatagtatctctgtagatacgtggcctgctgtattgtgttctcagaaaacatttctttaaaacctttttttcctttcctttcttttcttttctttcttttttttttttttttgagacaagaatctctctgccactcaggctggagtgcagtggctcaatttccgctcactgcaaccttcacttcctgggttcaaacagttctcatgcctcagactcccaaatagctgggattacagatgtgtgtcaccatgcccagctaatttttgtatttttagaagagatggggtttcaccatgttggctaggctggtctcaaacttcttggctcaagcggtctgcccacctcagcctcctgaagtgctgggattatagatgtgaggcactgtgcccggtcagagaacatttcttaaatagacaaaacattttaggcagagtcagagcattttagagctatttctgaaagagaatagttatctgttcaacgggcaaatacaacacagagtcaaagataatgctgtgctcagaagtcatgatttcttcaggattttagggtatttagattttaaaccacaattctaaggtcaatatttatgtaaagtatttatgaaaataaaagccatatttaaatttaaatttaatatgctttaattcacataaaatattttgaggttgttacaaaataaaaaaatttagatttttctagctatatattcaatatcagcatattttttgcatatttgaaaattgagattctgtcttgtaccgtttaaatggtagcctgtttaacttaaaattaactgcaaaagaaataaacaaaaactgagtttttgtaaataatattaaattgagtaatttaacttaatcccacccattaggttaagcaatgatcccaggataaagagagagagagaatgatgagtaaaatgaaccctacactgcaatgtctccagatagctgtatgagtaaaagcttaccatctcagctcttgggtctttattttcttattttaaaaaaaggcgttaaggtccacattaaagtcaggtataattggtaaagtttaaaactgctagtctcttttatttcacgaacactgccaggccttggaaattattgataaaacttgattcactgtgagaaacagtcaaaaaataataaaaaaaatagcattttattttaaagttaaagaataataaaataaaaataaaaacttgcttgagatacttttctagaaatggaacattttacaatgaaaataggatccaaacatataagtatttacttttggatatttgatagataggcttgttataagattgtgactcagctgaagtggttttagtttatacagatttttgagagaagaaagtacacctttttgctctatatgttttctctggaaacatctcattgtattgtaccaattttgtcttgattctctaagaatctttttagtcttttaggacaaaggaaataggtattgagagacatttctcttcaatccatggatctcttctgtttctgcacattcgctgagcagagtactgatagcttttgttgggggctatctttttcaaagaaatctgtttagcaaacagcctaggaagatagaaatagtgcttccattaggacagatggcacatttctttgctgtccaggataattaagataatctctctagggaaaaaggttgggcatatttgcttgtagctccttttaaagattggagtttcattaagctcaggttttcttgtcctgtaatgcaacccacagtatgtgcacttggttttcctttcattggcctttaggaattagagcttgaggaatcagtaaaaaatatggtactctgtctatgctattgttgtgagtagtaaactgttctttgtttctgatctaggagtgtcataacttctgccaggattatctgatgctagcttaccagctacactactaacacatcctattgataaaacaaagctgagttcattgcttattgtggtaagggagaacacctaaaaaaatctttggtagggtcttagagaggtcaaaatttgagaatttgaagtttgttttaagttggatctttcagtggtggcgatgaggcttgattaggattgggtaggtatcatgataaaacagtttaggtttggtggaaacagtaagattttgaaaactgccgaagagttgatgggtctttccagaaggtctgtaatgaacaatcacattatatttctgctgtctcctagaatagcagttatgctaattaagacagtggactggtaaagtcatgttaatgtacctagaaagctgtgtgtgtgtgtattagttttctagggctgctataacaaagcactgtaaactgggtggcttaatatagcagaaatttattctttcagttttggaggttagcagtctgaaatcaaggtgttggcagggccacactctctccgaaggctctaggtaagaatcctttccttcttcttttagcttatggtggatgccagaaatccttggtatttcttgacttttggtagcataactccaatctctacctcagtattcacatgacatcttccctctgtgtgtgtttgtgttcaaatgtccttcttataaggattccagtcatgtattagggtccatcctaatccagaatgacattatatcaacttgattatatctgcatagaccctatttctagccgttacacattttgggaggacacttatttaactcagtataggggacatgtagtttcagtcttcagtgcccaaactgtatgtaggtacagtgtttgctctcagtgtccatgaaactatggcagactgatgttagcttgcatgtagggtaaaatcttaggttcttcagagttcttgacaacagcatggtatagtagaaagaaaaccagtctggaagtcagagtaccttagttctgctctgttaataactagcttaagaaagttactgtcttctttagctattagtttgttactgatacaccaggagttcagtctaggtcctgctgcttgctgcatagaaagccaatcactgagacaatgagtattgccaaggaagaaggctttaatcaggggcggcagctgagaagatgggagcttggtctcaattccatctccctgactgactaaaaccagggtttatatagcagggaagacatagattttaacaatgtgtaagaaaacaggaacttgggaggaggggcgaggaagcaataatggtgaatgaggggtctggcatctggtagggtgatctggtttcagttctttgatactttttgtgccaaaagaacagtctgtgggactattgggtttgtttcaatttcctcatagataaaatttgaggcctgaggaagagaagagtaaaccaaatgatctttaagacatttctagttctcacattctgaagttttataatgttgagtggctgctacatactgtattaatattagtcttgttggagtcacaaaaagggaatagaaaatgctttaagtgctaatcagataggctctaacttgtgaatgtagcttgcgtaaattaatttgtttatttgggtgaagctaattaatgaagacattaggtaaacatgatgtttgccctgatctctctgacttaccattttgtttttcaacttgaatagtgtatttggaagaagagcattcttcaggtcacttaaagttagaaaaatgctgcactctcaggctgagttcataaaatgaaataacctttcctgaagtgaatatgagaatgtggttccccttcccccttcattgcccacgtttgtctgtcatgtcattcttgtggtcaagagattttagaaaaattcttactagagaatggtaatagtactgtgaggtggagcatggtgttagaattctaggtgtaagtgaatcatgtgctattgaattttctttgcgttttaaataggtcactgtagtatcgtatttgaattctttgtttgaatcatgttgaaagtatgtaataattactgcacagagatattgtgggcactgaaaaattctttggtactaccaaaaccccctgtggtcatgtatgtgcttgttctttgaagttacaaatgaacaatgactacatattgatgataagtataaatacaggttgaaccaatgtttttagatctggacaaaagttactgaagtaggagaaaggacggatttttattaattccatatggaagaaattcaaaaccatataccagggggagataggattgtctcaccacttaacttaaggatcttcctgtatgtagcccttccatcacacacaaattgtactaagtgttttcatagtggatatttgggcaattcagagactctcactacatgttgtaacaatggtaatgtatttaattaattttagaagatacattagaatatagaattagcagtaacactccagcaatacctgaaataaaatgtgttaaaacagacagaatatagaaattaaatagacataattacaataataaaaagatatacctctatcatatttctattcacatttctattctagtcaattaaaagagtaggagaattttttatctttctttattaatttttttgagacagggcctcactctattgcccaggctggagtgcactggcgcagtcacggctcactgcagccttgacctccttggctcaggtgattctcccacatcagcctcctgagttgctgcgattgcaggtgcacaccaccatgcctggctaattttttgcattttttgtagagatggagttttgccatgttgcccaggctgatcttgaactcctgtgctcaagcagttccccacctcagcctcccaaagtgctgggattacaggagtcagccaccgtgcctggctaatatattttcttagtgttaaagaaaagaatgttaaggagttactcagaaagtaacttgaacttttggtgtgggctgttttgatgattgttgggaagattttctttttttcttcattcctggggccatggtggctgatcatccaagcttggattaaactctgttccttgtacttttccttctcattttaggttttggagtcagtatacttatattaccaagaaaataaggttcctccaacttgtaagaaatattttctagtttcagagaattatgaattggtaaagattgaaaaagatggtatggatgtgtttgaattattcacttttatggtgtatagtcttcactttccatgttgtgttttgttggactcaaagatgcttgagaagttagagagattctccctggctcccccagccacccctgcagccccactggggaaaaaaggaaacaaaggaggaaaaccgtgttgaacacatattttttcttaagcacctatactggattaatgtattactgtgaaagttgtttaattggagtttttttaaaatagatttttatttcttagggcagttttaggtttacagagaaattgtaatttcttacagagagttcccaaatatctcccccttttatcttacaatctgtagtaattgcttattatttccaggagtttgttggtcagtactttgggttttttttttttttttttttacatagatgatcatgtcatctgcaaatagagagttttatttctttcttctcaatttgtgtaccttttatgtccttttcttgttttactgcattagctaggatgtccagtatgatgttgaataggagtggtaagaagggaagtccttgccttgttcctgatcctacggggaaaggatctggtttcttaccattaggtatggtgtttgctgtaagttttttgtaaattttatttatcaagtggaggaaatcctcctctatttctagtttgctgagaacatgtaattattaactgatgtagaattttatcaaatacttttattgcatctattgatatgatctgattgtatgattttttttttctgtttcctggattacattaattgacttttagatgttgaacctaccttgcatacttggaatatactctacttggtcgtggtgtataatgtgatttgctgagatttttgagaacatttgcctctgtgttcatgaaagatattgttctgtaattttcctttcttgtaaggctgttgcctgggcttatgatcggggtaatgttggcctctgagaatgagttagaagtgctcactctgcttctacagattgtagaatattggtatcatctgttccttaaatatttgatagaattcacgaatgaattatcttgagtgtggtgctttctgttttggaagattattaattatttattcaggttttaaaaattgatttaggcttattcagattatttgtttcttcttgtgtgaattttggtagattgtgtcttttaagggattggtccatttcacctaagttatcaaatttaagggcatagaaccagctttgagtcttgttgattttctttgttttcctgttttcaattttgctctgatttttgttgttttcttctgcttcctttggatttaatttgttcattttctggtttcctaaattaaaagcttagatgattaattttacctttcttcttttttaacatatacattcaatgctaaaaattaatctcttagtcctgctttgctgcatcccacatttatttacttacttacttacttatttatgaaatggggtctcattatgttgcccaggctggtctagagctcctagcctcaagtgatcctcctgccttagcctcccaaagtgctgggattacatgtatgagccactgtgcccggccataaattttggtgttttattttcatgtacacttagtttaaaatattttataatttctcaagactatttttttgatctacgagttatttgtaagtgagctgtttaaacatctccaaatattttgagattttccagctatgtttttgtttaactagtttaattccattgtggtgtgtctatttgtatggtgtctattctttaaaatttgttaaggtatattttgtagtctctctttgtgaaatgttccctgtggatttgagaagagtgtgtatactgctgttgctggatgaagtgttctataaatgtcagttagatctagttgattgatggtgtcatcagttctatgataccttcctgattttctgcttctgtcaattaccgatagagggttgttgaagctccaactatgatattgaattcatgtgtttctccttgtagttctatcagtttttattataccttatgtattttgacactctgtagttaggtacatacatataaagatgattatgtcttcttggtgaataataacagattgaccatctgttattaggtaatgcccctctatcactgataatttttcttggccttaagcttgctctttctgaaatttttatagccattccaggtttcttttgattaggtttagcatagcctatctttctccatccctttacttttaatctgtcttcatctttatatttagagtgggatttttgtagacatcatatagtagggtcttgtcgtttgatttgctctcgacagcatgtgtcttttaactggtgtatttagaccacagatgtttaaagtaattattgatatagttggattaatgtctactgtatttataactgttttctactcattgtccttgttctttcttttttcgtctttcactttgtctctgccttcttcattgtaattcagcattttatataattccattttgtctcctgttttaaaatataaattatacttaatttaaaattatcttttaggctgaggatggttgctcatgcctgtaatcccagcactttgggaggccaaggcgggtggatcacctgaggtcaggagttcgagactagcctggccaacatggtgaaaccctgtctctactaaaaatacaaaagttagccaggtgtgctggcgcacgcctgtaatcccagctactcagggggctgaggcaggagaatttcttgaacccaggaggtggaggttgcagtgagccaagatcgcactactgcaccctagtctgggcgacagagcaagactgtctcaaaaaaaaaaagaataaaatgaaattattttttagttgttgccccacagtttgcaataattacacagttaaactgatccaagttcactttttaaataacactttaccacttcatgggtagtgcaaataccttacaacttagtattgtcagttcctttttcccattccttataacattacttttatttgttttacttttccataatttacagtcactaaatatattgttgctattattattttgaacaagttgttatctgttagatgaattaaggatcagaaaaacaaaagatttagttttacctttatttttttcctctacactcttcctttctttttgtaatccatatttctgatctatataattttccttctttctgaataacttctgttaacatttcttgcaagtcatgtttattgggtttcatttctcccagtttttatttcagaaagtctttatttcttcacttttggaggatacttttgctgggattctataggcattctagtttggtattttattttattttttttaacagcccagaggtcttattttattttatttttttgagatggagtctcattctgttactcaggctggagtgcagtggcacgatcttggctcactgcaaccactgcctcccgggttcaagcgattctcctgcctcagcctcctaagtagctgggactacaggtgcgcaccaccacacctggctaattttttgtatttcttttcttttttatttttgagacagagtctcacactgtcgcccgggctggagtgcagtggtgtgatcttggctcactgcaacctccacctcctgggttcaagcgatcctcctgcctcagcctcctgagtagctggaattagaggcgcccatcaccacgcccagctaattttttgtatttttagtagagagggtttcactatgttggccaggctggtctcgaactcctgacctcatggtctgcccgcctcagcctcccaaagtgctgggattacaggtgtgagccaccgtgcccagccagtctagaggtcttttattttttttaacacctgttatgctatgaattcacagggaataggttccagcagctcaggctccttcccactggttctcacaaagtgtgcttctctggatggagcaggctggtgcttcagtagaacccgggtacctttctctttggcttctttctttttccgatcattttcctttacgtgtttcaggaagctattttggctcttagagtgctgaatgtgctcaatacgcacattaattctcttggcaagaatcttgcccttaacttgtttgttgacaagttgtttacaataccaacagcatgctgagtaacgtgtttgtttacaacttgcttacagtgccaacagcatgttgggtaacactgcagactcttccagttttgccatgataacactcgcggagcattcctttttgaatagtacccattcccttgatgtctacaatatcacctttcttatagattcgcatacatgtggccaaaggaacaactccatgtttactaaaaggcctagagaacatatatcgggtgcctctcttctttccctttgtgttcgtccttttggcgaattactggaagatggtggttccggccgaaaggttggatttttttttttttttttttaacactaaatatttcacttcactctttttgcttgcatggtttctgaagagaaagtttgatctaattctttatttctctgtggataagatgttttctgtgtgtgttgatttttttctttacctcttgcttctttcgagatatcttattggtcttaaagttaataaggaaaaaactaaagttttgcttttgatttagttttctctttgtcttattttctgcagcttcactatcatttgcctatgtaaatattttggtatttatcttgcttggtgttctctgaacttccaggtttggtgtttcttactaaagacattctttcctgttacagtgttattgatttgtacactccccttcctcgcctcccctcttcactgttttttccttctctttactcttcctttctttccacaggatctcactctgtcaccctggctggagtgcagtagtggcgtgatcataactcgctgcagtcttgaactcctaggctcaagtgattctccctcctcagcttctcaagtagccaggactacaggtgtgtgccaccatgcctggcgattaaaaaaaaaatcgtagaaacagggtctccaatgttgcccaggccggtcttagaaaaaaggacttagctgggcatggtggtggcatgcacctgtagtcctacctgcttgggaagctgtggcaggaagattgtttgtgcctaggagttcaaggctacagtgcgctgtgaatcaccactgtactccagactgggtaacagtgagaccctgtctcaaaacatatatataaaaaaaaattcctggtgataatttgataattcctggtaaaaatttctgccacatccgagtctgtttccgaggcttgctttgtttcttcagattgtattttttgcctttatagtgcctcataattttttttcatagccagacagaatgtatcaggtaaaaggaactgaggtaaataggcctttagtgtgaggttttatgtttatctgtttagaagtcaggctgtgtttagtgtttgttctggctgtggtatcggaggcaaatgttacgggatctttaaggtgttgcttttctgtctagaaacctctgtggccagtggcgcctttgcccgagttcttgtcctgtgtccaggaagaattatgtatgcagacaagtggagggtgagcaagacaaagagaagctttactgagtgttagaacagctcagaggagagctgcagagggcagcccctctctataggcaggttgtctcatccagtgttcagctctcagcagagaggaggccctggagtgagtggctcctctctgcaggcaggtccccattgacttcccagctctcagcagagacgatagctcctctctgcagctagtcatctggctgtctctctggcctctgccctgctctggctgatctcggggcttttatggacctcagtggggaggaagtgtgtcaattggtacatcggtggccatgggtgggctggaaaaggcaccacaagcccccactgcagtctgcgggactggcagcccggtccccaacgttcaggccctccctggcctgaaggtggggtctatctggggacgtgcccccttccacccaggagcctgtctgcttcctgccactttccatggctcccaggctgcttgtgccaaggggcacctgcctgccagcatggagcagctctccacctcagcttcctcagagggggcctaggcggcagggcctgagcatgcgcatatcctgttgggctgtgatgatatccaggcttggctccaaccccactctgagaacctgccacattggagccggtgcgggaagtggcagcgggaacaggcatttccgagcctgcaaaggcaaggggggccttcctgagcccccaagagcacacggaggcctgggtccacaaccctgacttgggtagctgcagctgtatggggttgggggacagggctcctgcctgtttccagtccccaagagcacatggaggcctgggtctaccacccaggcttgggtggcttgggctgctgcctgctcctggctcccactggcactgtggagcatgcagccctggctccgccccctttcagcctgagacaggggctccagatccttgctggacctgggctgggatccggggcaggggtgacatcgccgggagctaccccagttgccctggcgcttcagtggcccaggcagagcagataactgtccggcctggctgttgggagtggcaggctcagcagtcgcctgatgtggggtggaccctggggatgtagccccgggcagccctgcacagagcctcctcctgaggcccaggaacctggcaccctcagtggggtgggcgcagtggctgtgtcactggctggtccctgaagtgggcaccgctcccacttcctgcctcaggcccctgaagctcagcctcagctctgcatcggtctgctctctgcttgactgtgctgcacagagggcggcgggctgttgagggagggggtctgtccgcctctccctgtgccgtccatgtaccagaaagccaccgccatcactattagaggctaaaatttcttctactgtccttgcttttatctgccctgttgtctttgggtttttgtaaagaatccttaaatggggtctgaggcttgcaggtttttaagttgtaatcctgtgttgtacaagagctgtactgatgtggtggtaagggtagagggatgagggggaaagttctatagtcctgtaattagatctcaggactatagaactttccccctcatccctctgccctctaccaactgtgagcctgagttgagtaactgtctctttttctcggtcaaaggatagatggggctggagttgggtatttcccttccctccggttggttaggcactgtaaaaccgtagtaggttaggcaatctaaaagccagttggttaggttctggtaaaatagtttccttttctggaataccttttaagagaaataaagttcctggcgtatttcaaaatggtttttcttcttcccctgctgcaagcaggaggggttttttttcagatctttaccatgagaacctggtagggctcctggaggtaaaactcaggaaagtatggggacccctgtaagactggtccccttacagtttttaactctcaagctagtccacaattactgtttcaagtgttcctactgatgctggcttcagttgagagcttgtattcctggacttctgcttcctgcacactgtgattctctatctgcctgtcttgtctctccaggttttagagcagcagtttgccctctgacctcaattctctgatggctctaagaagagttggattatcagtttttttttttttacccccagctttttttcttgtcgtgaggttgggagtgatgaattacaagctctttacaactgtacttaaggttattttttgaccatttttgatgcttttgtaactagtcaaaagacttattacagtatcctttatctcatttggcagtattgttcattaagaattttatctctttctgacatcaggtctgcacattttggggataatatattctaatttgcaagaaagattaaaaaacttctccagagggaagttgatcataggactgattcttattattgatgaattgactgccttgtcttgttttgtgttgctatgtaggaatacctgaggctaggtaatttataaagagtttgatttaccgcacagttctgcaggctgtacaagaagtatggcaccaggatcggcttgtagtgagggccttaggctacttccactgatagcagaaggcaaagaggtgccagcttgtgcacaaaatgagagaggagaaaagggtgggaggaggggccctggctctttttaacaaccagctcttgggggaacaaatagagtgagacctcaagcatgcctgaggaagagcattaatttattcttgagggttctgacccctccccaccatgcccaacaacatctcccattaggccccacccccaacattgagatcaaatttcaacaggagggacaatcatctaagtgatagcatagactcaggctatttactattctgttttcaagtatagattgagggcaacagcagcctttgttttctatgttgatggccaaaggtttatttttatattcttatactgtaaaaaaaaaaacaactttatttttatagcctttttgggtgtagggtcatgtcaggctttactaattgcacttctgataagtatactgatgatgctgaggatggttattaaagccctatgctgatactttggatttatggaaccaattaatttgatgactcatttacattgaatttcttaattagtagattgcccactaattatttttatgagcacagaataaggtaatgtttattcttattttttttgtgatatggtaaaaaacttagttcatataatgaatttagtgctcaaatatcttagtagaaattgaagtagaaaaagacattgttgtaaattaaatgtaagatataattttattttctttagaaaactttacattgaaaagatcacattatagataatttagacaacttatttataacttttatttattattattattgaatgtaaaagaattacatgcagtcccatgatcttaacataactgtggttaccatgttggtatatgtgccttttagtcctttttcatacacaattttttttacaaagttataataataatttcttttcaaatttgtgccttatttcagttaacagtgtaaatgtttcccatttctaacaatgttttctcattgagtgaggtactgttaggttggtcagactgatagtttattgtacgtattgctgtaatatctttgtacatttagcttttccatgtttgtaccatatctttgggttttcagaagtctgtctctctctctgtttctctttttgtctgtcttttctatctctcaccttcatttggggagcattttgtgttctctttcacaggactaattaagttttattggatcttgaaaaacgggattagaaattttttcttacttatataattagaaaacaatgcttttggacttacattgccacggcagtttacacagttttattcccaaaaattgtagttttgtgactaggtgataaaaatgatctcctatatgtgccaaacttggtattctagacactcatacttaggatgtaaattgactgtagtccaataatttaatatgttgtgtttaattcttgtaatattttactcacaaattgaacttttccttaccaatttaatgtttgtaggcttaatttggcatctttgtcaggattattagacttctctgcattcttctgacttctccctaaactaatgtttagaactgaattgggtccagcaatttaagtggaaaatcagtatgactagagacttctagaaacttctggtgtcactgagatggtgaatttgatgattctgaccctacttgctcatctgtaaaagctattagaggattgttttaagcatttctattctatacaggtatatgtacaccatgtaataccactcagccataaagaagaatgaaataacatttttgcagcaatttgggtggagctgtaggccattattctaagtgaagtaactcaggaatacaaaactgaataccatatgttctcacaagcgggagctaagtcatgggtacgcaaaggcatacagaatagtaaaatagactttggagactgagacgcggggagaataggaagaagataagggataaaaaacgatatattgggtacaatgtatgctactttggtgatgggtgtagtaaaatctcagacttcaccactatacatttcatccatgtaacccaaaaccacttgtactccaaaagctattgaaataaaaaagatatttaaaaaaaaagaggccaggcaggttggttcacgcctgtaatcccagcactttgggaggctgaggcgggcggatcacttgaggtcaggagttcgggaccagcctgaccaacatggtgaaaacctgtctctactgaaaaaaaaaaaaaaaagccaggcgtgctggctcccacctgtaatcccagctactcatggggctgggcgaatcgcttgaacctgggaggcagaggttgcagtgagccgagattgtgccactgcactctaagagcaaaactctgtctcaaaaataaataaataaataaaaaattaaaaaagatcttctgttgtacctaatcttctagccttattatttcttagagattttataaatccatgtggcttttttactcttgtcatcttcaagttatttgccaagattgaaaaataaccatctttctcctaataccttggtgagcctgagagaagaaaatactacacagttcattttattgtaaaagtagtgaaatttctcaactgatattcatccttcatttttgtggatttgttcagggaagataagatttattgtttatttttattttgctgtattgccaggctggtctggaacttctgagctcaagcagtcctcctgcctcggccttccaaagtgttgggattataggtgtgagccaccgcacctggctggaagacaggatttttttgggaaagtaaatatcacttgagaatatctactagtatggaatctaaagttatgcatacaaggatgatctcatatttctttgtatcttgttcccagtctttcccccaatcttgtctcgctttttcctcaacaagcgtagttaacaactactatgaatttggaatacaaaatgataacgaccctgcctttaggaaactgacaatttagaaggtcaactagaaatataagttaataattacagtacaggaagtcccctgatttcctctataataacatgtctcccaaaatgtgattgaaaataaaaattccacatgtcataggcgtaggaggtatttgggtgtttgtatggagagtcatttcacagagctaaaatttattattataaaatactcaattctagttcctgggcatgttatctcctttggaattagaaatcttagttgctgcataacattaaaagtgtcaggatgatgcctgtaatcccagcacttttgaaggtagaggcagagcattgcttgaggccaggattttgagaccagcctgggcaacatagtgagaccctgtctctaccaaaaaatttaaaaaaattagccaagcatggtggtgtgtgcatgtagtcctaggtacttaggaggctgaggcagaggatcgcttgagctcaggtatttgaggctgcagtgaggctgcagtgaggctgagctctaccatatagagctcaggctctatatggtagagccactgcaatccagcctccgcaacagagtgagaccttgtcttggggggcaaaaagtgtaaggatgggatttctaggcatatttggggctgaggaaatcagtcttgggcccaacctccttgtagggggtgaggtggcaacctctggaatttgaggcctgctactgggattgtaggtataggaagttgagagggaaagggtctttctcaccctgctgtggtagtaagagcttggtgcttaatgggtgccttttagttgtttgatcacctaggatttctgcttagaacccagcaatacttgtaggcctgcacagtcccaagagagaaatcagagacttggtgataagtcaagggtaagagatgagataagagagcacctacactataggatattagaactacaactccaattactccttcactctcatctttttccctctcccagctgccaagtatatgtgactagtggtttgtccagagcaggactggaggatggggtaggaagaattattattttttcatcatagatcaggatagtgtcatgtccccctaaacttcagggaggcctggcttcatacctcttcttccaatttcctagcattgtgcaatgacaaagcttcatgcagtaactcaaaatcattgttaataaggtgatatctaaaagattgaatttgatgttctgaagttagtgtgaggatgtcagtctgttaatgtgtgaaatgttttgagctgtgtgaaactcaattttgcttagtgtgttaagtacaactgaagtaggtgtaaaagtcagtagtagcacacagaaaggagtaatgaattgtgtctagagggtcaggaaaggtctcacaaaggagaggatccttgaattctttgttcaagtggtagagttaaagaagtagattttttttttttttttttttttttttttttttttggcgacagggttttgctgtaggtctcccaggctggagtacagtggcgctatcatagctcactgcaatctctaaacttctgggctcaagcatagaaatagatctgatagtggaagtctctgcccagtaatactgagatcttggaaccttactcatttcagaaatggctctggtctgaatacattatatgggactaagctcttctaaatatctttatcccttaattctttatgcataaacttcagcaacttctaagctaccattaggaaattttcactgtaaattatatactggatgattgaatttttagaattagatttattccaaatgtaagtcaacctaaatgtaaagtttttctctacttaaatataagcttttttggcactcttgaagattctgagtatttctgtggacagttatggccatcagggtgtttgtttgaattctggaattgccctagagagcacataagctgtggagtaaagcaggtgtgtggtctgactcctgacttggtcacttaagatctgtgcaaccttgaatagtaacttcgatgctaattttccacatctgtaaaatatggataaaaaatgcagagtctttagcacagttcctggcatgaagtaatggctcaataaatgttaattattactattgttaactaaataagagttccctaggtctctgacttcaaacatatagttgttggagactatgaataccttggggccaccttgagctaagactagatgctcaggagcacctttttgattagtcatttattcattgagcatatatttttgcattgtttaaactttagcaaaatacctaagtcagtcaattctatttttatacagatatttctatatagaggagatttcctataggatgacctgttctgggtgtgtctatctgacctgcagctaatcaagtgactacagctttgctaattttttttttgaaaaaccctaatattgttaaacagtagtacagaggaaataagctgttggtcagcttctaaattctggcacgggttagatttgcctaagagcaaatcatatagcaagagttgatgagagaacttttctcatatcttctagcctgggtaagtttgtctcatttggtgtcaagtcagaggaatctgaactatagaaccaaattgtagggaaagatgactaagggtttgtgatgtctttttttttttttacccccctcaaaggagttctaggtgtaaaaagcatcatggtttaaacgttacgaggcatcagtgaaggcagcagaaaagtcagaaactaatatagccaagtctagattgtatctgttataaactctttaatcagaagattctagcttctagaaccaggtctgtaaaatgttgagagccctctaagtaaactccattatagtcatttaattgatttttctttgtctttcttcttggacatactcttctttaaagagagcgttcccccctctaccccagatagtatctatctttgaggttttgagaacaatagtattcttgttctttaggttctgagttgctgacttgagggaatttgatacacaggagtccccaaggccccccagtggatacctgaaaccatggatagtactgaaccctatatatacaggtcaggcatcccaaatctgaaatccaaaacgttccaaaatctgaaaccgacgtgacactctgaagaaatgctcactggagcattttggatttgtggatttgagatgctcaactggtaagtataacacaaatatccccaataggaaaaactccctattcccattagtttttacttgatattctgaattcttaagtgtgatttttttttctaatttggggatagctcctatttttgtgagagaaattaatgggaaattttgagatggtaactagaaattgtctttgcagtgttaaatttttagttgggaggctactaggctgggtggctctagctgtttaagttcctgtctaagcaaaccaaagcccaacttagaaagtaaaaggaaactagatattttgccaactagaaaccacctaagtaatctctaactagtgtctttccactctgaccaatgagatatgttttctttgtcttccgtgttcagcctataaagcttacagcccacactgctgtgaatgaagctcttcaaaccttttatggttcagagtgctgcctaattgatgaatcattctttgcacagataaactcttttgtctgtttttgctttaaacaacaaaggaacataaattctgttaattgattgtatgaatataacagtgaaaattccctgttaggctttggttatcagtattttaggaatactttttaaaacatcccctttagcttttaatgtgttttggttagacaagatgatgtatgtgtcagtataatgccaggctcacaaaagttgctaactaaatgttagttccttcaatacatacattcattccctgggacatggttccaaaagtagattatcataagaattctgtgagaagctttgaaaaaactacagatgtctatggcatatattaatacatggcgtctatatccatacatgtatgtaaatgtatgcaaacaatttaatctactttttccttaacattaactccttcagatagaatggttggcccaaatgatttaattattttttaggttgttgattcatagaaacaaatcccctgcagaaaggttgtaccaatttacacggttacctttcttcacattttctctaacactgggtattcttgagcttttagtatttctcagttggtggaaaggatctcttagtttgttgggatctctttgattatgagtgagattcagcattttccataatttactgatgtctgcatttcttcctccctccttccctttcttctttcctttctccttctcctacttccactttctcccgtcctgtcctccctttcccctgctctccctctttcttccccttctatccccctcccctcctgtttttccttctttgcttgtttttgatctctgttcttccacatatgaagattctattttgaccagcaataagttgaattatggggctagaagataaggactaaaaacaagaattggtgtccagaaaggtggggtaattttgattactatgcctgttgcaaacatgagcaagatgttaaatgtatcatagatctgcaaggtttttttaattcatattttttatctattgtctcattaatgttatctttgagaaatggttcttttcagtttgagaatgggggaattggatttaaaattttcttacatgaagaaaccaaatattttgctgctatcctttggaaacttcttactatgattggttctgggtggcattggaatcagtttgaaatgatgccattaatgaccacatgtttggatttcttgactatgggtaaatgtgattagaacagaaatcccttaataatagggattctttatctttgtgtccctagtgcctcatagtatctggccctaattaggagctttagaagtgcttattgactgattgcttttttatctgaatcggccctttctatcccatcattatgataacatccatcttggtagtagtaaaactgttgcaaactgcagaaatgaactgtgattttttttttttttttttttttttttaaagacagggtctcactctgtcacccaggctggagtgcagtggcatgaacatcttaatagctcactgcagcctcaacctccccaggcttaggtgatcctcccacctcagccaccagagtagctggaactacaggtacactccatcatgcccagctaatttttgtattttttgtagagacaggtttcatcatgttgcccaggctggtttcaatctcctgggctcaagggatctgcctaccttggcctcccaaagtattgggattacaggtgtcagccacggtgcctggcacaaataactttttcagacaccacttttgattcttctgggtatgtatccagaagtggaatcactggtatcatactgtaattctattttttttttttaaatggagtctcactcactcaggctggagcgtagtggtactatctcggctcactgcaaccactgccttctgggttcaaatgattctcctacctcagccttccaagtagctgggactacaggcgtgtaccaccacactggctaatttttttttgtatttttagtagagatggggtttcaccatgttggctaggctggtctcgaactgctaacctcaagtgatctgcctgccttggcctcccaaagtgctagaattataggcatgaccatcgttttcagcctctttaattcttttttcaattttttgaggagacatcatactgttttccacagtggctacaccattttacatttccatcagcactgcacagggttctaatttcagcacattcttaccaacacttattttctgctggtttttttttataatcatcatcatcttaatgggtgtgaagtggtatctcattgtggttttgatttgcatttttgaaatgataagtgatgttgagcatcttttcttatgcttactgttcatttgcatattttctttggagaaatacctatttaagtcctttgcccactgttgagtcagattttttgttgttgagttttagggatactttttaaagatgctaatcacgtgaactcctttttaagtgatttataattccgtaacatatacttttttttttctgatcgatttccttatagtttgtattctagtgggttaatggagtgtgatttttttttaaaacagctttgctgaggtgtgattggcataaaaaatactgcacacatctgaaatgaacaatttgattagttttgacatatgtatacatctgtgaatccatactcattacctccacagatttcttcttgcccccttgtaatcttttcccccactactacccatccttccttgtctccaggaaaatcctgaattgcttttggtcactataaatttagtgccttttctaaagtttttttttaaaatggaacttctagtatatacttttgggcaggggctgtccattcctgtgtttatttatcctttgtatattttctttggtaaaatatctgttcaaatattttggccattatttaaattgggttgtttgttttcttattattgagttttgagagcggtttatattcttgatcaaagttgtttataagatacgtgcttcgcagatgtatttttcctggactgttgcttgtcttttctttctcttaatagtgtcttttgaagagcacacattttaaattatgatgaaatttgtttgttctcatatggattgtgtttatctatcagtttgttctcatatggattctatttttgtttatgtatctaagatatatttgcctaatccaagggcatagaagttctctcctggaagttttatggttttgtatttagacctatgatgcattttgagttaatttttttatatgggataaaaattggatagaaattcttttttggggggtagagacatgcagttatttcagcatcatttactgaagtggtttgtgtccttttgatttttgtcaaaaatcatttgactgtatacgcgtgggtttatttctgactcttattttgttccactgacctctttgtctttcttttttttttgtctctcataccagctcagttttaattttaaagtgacaaatgtacaggtggaataaaattttaagcaacaccctccaaattcctcttacatgacaagaagaagctgaatgtaattttgctctataaccaactaaacagtagctcaggatagacataaagccaacttttccaattaagcctttgtgaaaatcaatttctaaatggatcacaactccaggatattgtttctgtgctgtgatttctttgtctttcttgatgccactaccatgctgactattatggctttataagtcatgaaatcgggtcacgttaacccatacaactgcttgttccttttcagagcaattttggctattgtgctggttaccaatctgttgcctctcagctccaaatgcatcctttttgcctgctctgtgaaaatagatcaggccctttaaatatttttcttttgtcagctgacaatgttaagttttgccagtacagagtgctggagaaacactgcagagaagttttgcttgttcgtttctgtgtacttgcttagtggactgtagcaacacactcagcttctccagtgtcaacccacattggctttcccactctacagtttctgtaggatgcatgttttcaccattatcaggcttctgcagtgctcagagggcagcaatacccagcaaccagtgacccgaggccagcaacttcttttacttccccctcagttggatttgtaacagagtatctttggtgggacacttctgtgtgaagagattttactagcaccctaaagaatggatttctggcaagttccacaaggtagacttccagtaagttctgctggtgcagcactacagcaacttccgtgctattcagtgagaggactgtgttctctccaacaaggtctggatctcagccctgggatggtttagggtcggaggaagctcttgccttggtgttctgtgtcagcctagggagcattggctactcttaagagttctctttatttctcattagttaattagctgtttctccaaccccatgttaaatagttagtgatcctttttattaagctttcacttttcaaattactgtgtggcttttctctccggaatggctttacatttccatatgaatttaagaaacagtatgtaaatatttgattggaattgcatcgaatctatagatgaatttgagggacagttgacatcttaacgatatcaagtcttctgactcatgaataaaatgtctccatttatttggatgtttaatttctttcagcagtattttattgttttcaatgtactgatcttacccatattttattaggttgatctttaagtattttatattttttgatgcttttataaatatttaaataacatatcaattttttttttttgagacagagttattggccaagtgtggtcagtaactgtcacccaggctggagtgtggtggcatgatatcagctcactgcaaccttcaccttctggtttcaagtgattcttctgactcagcctcctgagtagctgagattgctcagctaccacacccagctaatttttgtatttttaatagggatgggatttcaccatcttggccaggctggtctcgaactcctgacctcaagtatctgccctcctcggcctcccaaagtgctgggattaaaggcgtgagccaccacacccggccaataacatacaatttttaattgttcattactaatgtataagaatgcaattgatttttgtatagtggcattgtatcctgaaaacctgctgtactcattctggtagctttttttgtagattacattggcttttctgcatagacaaagcatgtcttttgtgaataaagagagctttatttcttccattctaataaaaagacaatccttttatttctttttcttgcctgatttcactggctaaaacctctgatataatgttgaatagaaaaagagcagacatcttagtcttgtttctaatcttagggggaaagcatctattctctcacaattaagtatgatgttgtagatttttcaggatgcactttactgggctgaggaagtttttttccattcctagtttgggtaaagtgtaaaagaaaattaggaatggattttgaattttgtcagttttttttaatgtgttgaaatgatcccatgtttgttttttttaaagttttttattagccagacatggtggcacacacctgtagtcccagttactcgggaggctgaggtgcaaagattgcttgaacttgggtggtagaggcttcagggagccaagatcatgccactgcactccagcctgggtgacagggtgaggccctgtctcaaaaaaataaaaaaatttgttaatatggtggattacattgcttgatttttaaaggttaatccaactgtatgtttctgaaataagcccacttggttatgatgtatatttggcttcttgatgttgccccacagttcactgatgctctttatattctttttgtgttcttttctctttttgtgttgtatttttggatcgtctttattggtatttttccaagttcatggatttttttcttctacggtgtctaatctgttaattctatgtagttttttatgttagatattatagttttcatctttagagttttgatttagatcttttttatatcttccatgtctcttaatgttttggctatatgaaatgcatttagaataacttttagactaggcgtggtggctcatgcctgtaattccagcactttgggagtctgaggtgggagaattgcttgagcccaggtattcaggactaccctggccaacatagtaatacttcgtctctattaaaaaaaataataataatttttaatgtccttgtttgctaacatctgggttggtttcagtcaattgattgctttattcatgttttcatgcctctttgcatatctggtaatcttcagctgacagacattgtgaattttaccttttttgagtgttagatattcttttattattagaaatactgttgaattttgttccggatatgtagttatttagagataatttgaggcttgcttttatgatttttttaagaggcctggagcaatgctcaatccagggctagttattcctcactactgaggcaagaccttcttaagcactccactcaatgtcctctgtgaattaagagctttaccagtttggctggtagtaacaggcaatattcctaagtctgcatgattatccatcactattctctcaaattctttcagatgtttttttccccagcctccagtagttgtctcacactttgagctaatcagtactgtgctgaatatttgagaggccctgctgcagatttctgggttttgttctctgcgtagccaccctgctactttcccggggctagctacctttgtcttcatggactctaagctcttctgtttcatcaactcaagttagtttatccacgcacctagctccccttggatttctttctcttccctgggccttagcctgaaaagtctccaaaggttgtaagctgggacaattgaagggtattgcttgtttcctgtctctctagaatcgctgttctttgttgcttaatgtccagtttcttgaaaaatgttgttttctatattatgtccgtttttcttttaagtgagaggacaaacctggttgttactgcatcctgacctccatatatagcatatttttaaccccattattttccattttttaaaactttttttcccattattttctgtagtaaaaataattctggtttgaaaattacaatttctttatgttttagcactagctaatgcaagtatctattatatacaaattgtattggcaattttctttctaaaaaatccccccaattattctgcatatataataatacctacgttttaaaaggtatttttttccaatattattttcagttggttaaaataaactacagtacatactagtggagtctgattgaactgatgtgaagaatacagaaaaatacttagaaatgtttagagaacgcattgtgatgaaatctgttaggagtacaattgttttaactgtaaagcttggcattactggatgggagacagctatagaatacttaagccttattggtgaacatataggaagaggtggaaataagagatgaattacatgaagaagtctttaagtcatggaggcttactgaaatattgaaaaaagcaaataagtagacctaacaagatagagggggctcagaagaatgcatttgtttcttatagatggtagctggagctagggcagtgtagcttatggctttgcttgaatagaaagagttgatttgggataattggatttaaatcctctatttaccacttgctaactgggtaagttttttaaactaaatttctgattttgcatgtgtaaaatgaggataagcatatttatcccgagggttgtagtgagccttaaatagaatcaattacatagaagtatatagcagtatgtttgtgtgcttaataagtgtttgtctttattattttaaagaaatgaccagagaaagctttacttttctattgcatatttccctagtgattatatggacatagaagcagtgcttacagttaccttggaacccatcaaggaaaaatgaagcaaattcctgccctgttgcccttctggaacattacatagtttagatgaaaatcagccagagcacagttagactctattagcataagattatgttagaaaatagtgggcatgataaggccctgaaggagagttctaacttggagaaggatggtggaatttttttatagggctttgacagtaggggtcaggcaaagttcagtttgaggagtagttagtcaaggatagctctcagaggaggggagaattgatcatgtacattagcaattattgggcaatttgaattttattaagaatgttggggctgggcatggtggctcacgcctgtaatcccagcactttgggaggccaggcaggcagatcacttgagatcaggagttcgagatcagcctggccaacatggtgagaccccgtctctactaaaaatacaaaaattagccaggtgaggtggtgggtgcctgtaatccaagctactcgggaggctgaggcaggagaatcacttgaacccgggaggcagaggttgcagtgagcagagattgtgccactgcacactccagcatgagcagcagagtgagactccgtctcaaaaaaaaaaaaaaaaaaaaactcagtttttagtgtcttcacagtagatttttttgtcattggctcttgcggcctttcttcttgtctcccccagttccagccccccaaaatagaagggcccattatcttgctcatgattttagattcccagctcttgattttggaaggcgctgtctttgtgaaatttcagagatcaaggagttagtgttttgtggtgtgggaaatttctctcagtctttgctccttgcattctttgtgcagttttttctttgtttatttcagagacagggtcttgctctgttgcccaggctggagtacagtggtgtgatcataactcactgcagccttgaatttctgagctcaagtgatcttcctgtctaagcctcctgagtagctaggactacaagtgtgtgccaccacgtctggctaaaaattttttttagacatgggtcttgctatgttgcccagactggtctgaaactcctggcctcaagcagtcctcccacctctgcctcccaaagtgctgagattaggggcgtgagctacctcacccagcctgcagtgtgtcttggatcctgttatgtaggtgctctgtagtagaggaaacagtaatatatgataatgaaaagcttcaaagtagacatatggctgaaagggagatttgaatagggttttgcagcagctattttagttgatgacacatcttcaacttaaattgcaattgccttttttcatttcgcttcatccttctgtgatgatcctagtagaagtcaaatgagatcatttttgatagttggtttgcaggcttcggtgtatgcacccaacctttcaaagactgcctgtgcttttcagggagctcagttttgtgactgaaaggatcagctattctcttctacctttttaatgcactactggtttctagcagctgctgcttaacgctgttcattcttgagtttggtgaattgttttctgtgctccatgtgatttctttgtctttatgaggtacattttgactacaggtgagccaatttcctgtgaatataatctatgctttgaaattaaattatctttatcctctttaaatatgtaaatcttcttagtatctgctagtttgcctcttgctttgtggctccttgtgttcctcttgtaatgcttgcttagcttttaatttaaataccagactgtgttggttagcatccatagaagacataggcctattcaggaaagtgtgaatatttggccaccatatttaggattattggggcatttctttccaatttttcagagtacagaaaaagaggtgagtttcctattccttcctaatcaagttcaccatcgaccttgtactttttgaaccaacttgaatagaaaaaaaacaacctgaagaataatatgtttactatttctacatggatatactgactataactatggaaaatatatttgattagttacatgaggctctcatggtaaatgtgtcagatatagtcaatattttagtattgtcatgtagtattaagtatttttccatcaatgattagaaagttatgattttttgttgttcagcaaattatcatgaaaaattcaataatgttgctttttctttttgatagccagaggaagttagagaacagatttatctaacactaaacggtcactggcaagaaccttttctttgtaacatgttactttgttccctaacctcattctcctccacctgtaacaatggtgaatatgaagcaagtgttcagtatcctagctttctctaattttctgggacgtatctcttttagtctccgtatattaaatcttagggaacctgaaaggcttctttattagccttttttatttctccctaaaagtattgatgtttttataggaatctctgctatccagggataaaacataacatgcaattaaaaaaatttcagccattgagaatgtttttataaatggacagatcagttacttaaaaagttctatagatttgtgattaaaaaaatagttccctatttgaataattgtccaggaaattagctgttgatcatatttaaaatataacataaaaatgagtcttaaaatatgtatagcttcatttgtgttgattgatgttgtaactttttttgagtaaaatgcatcattagaaaatgtatttggaattacattaaaaaggattctatgttttgtttattggtatcacacacgtgtcatgtgggtcatagacttgtttcatagtaaaacagatggcatggcaagggagaagaaacttacatgcaagtttttgcacaaatatcaaagaaattcagtgtactttcttttcaaaaaaacattaaaaactccaaaacccaaggaagaaaaagcttcttgcatttatataacaattcttaatctattagttgcagggcaaaaataataaaatattaattatatagtcaaaaatagcttttaactatgaagaagtcttcctatcaaattcttctgttcattaaacctacttttggttattatttaaatgtaattgggcagttccaagaaaagcttcagaacagctgtaattacagctgcagatttagtcaaaataggggctgtaagaggctgtttactctccttttgcatctctttcacccccaccccaaataacccaaatttagttgtaaaagtttttggtaagctcaggatttctgaaactggagtctatgtatttaactgcatgcagatgtgatgattacatgtgacttttaaggttcccataaccttttagttcttgtattgctctatgcacagttaagtgatttttgtcagctgtgtctgtattgaattttacagatacacatatattttaaacacagtttagtgatttttatcaaggcccaggcatctgctcaaactactgagaagggtaatagttttcaatctaaatttgagctaatgttgacattattacaagttgactggaaacatttacaaaagcctgtatctgtgttaaaaaaatatatttcttcaaattttactctactaggaaattgcctttgacttcatctgaaaacaaatttggcaaatgtcttaatttttagagaaagacctactatgataaatcaaaaactaaatacacatctatgtcacatccctccctcctcccagagctttgatctggggagttgatggcattctaaggtctggtttttagttaatcagtcagagattatatataagggttatggaagactgtggcaaaaagcaaggtttagagcctttttccctttccgagttaattaccatttcttttgcagatggcagttatgctgaatattgatcataagatacaataacatatcttggattctcaccacagttttacagtgttacctactcagaatctggttcaaaattgtagtgacttgttgaattgcacatagggaaatttgaagagccttctgctaaagccaacaatttaacacttttagttagaagaccaagtgaaacttgcctgtatttgcattggaccatattaaaactggtaagggtataaaattatataggacatggttcttacctcaaagtacagtgggtagacaaggtgcaaatatatgcattaaaataatacatcaatgattagggtaaataaacttacttttaaatccccagactcaacaactctttaaatcttgaattctaaagatcgagaccaactttcttacagatgaggaaacatattcagagaagtgcagtgaattgtcattaatcaaagggggtttataggtcattctaaatatgagctcagtaatgacaataggtagcaagttaactttgctttttaaatcttgaatgtcagctaatgttgactgattgcttgtttcaagtatttttacagagaaacttctggtccttttctcatgtgagtccagtgggaatatcagcagcatggggacaataggttattttcagactggataaaattgaacagaagccatttcagagaatactggagaactgaaaagaataataaaacacattcattaaggcaaaataagggaactatatttataaaatcacataatttttaaagcacgaattgatttataggtatgaggaaaggtagcaggtaaaatgtgatatggaatataattttgatgattaagtataacttaataattatgtgaggaaaaaggaattaacagaaaatcttttaggaaggtaaatagaactttgagactttagtaagataggaaaagtgaaatgtgaaaaacaagttaattttatatagggaggctatagatttaactcattgttaaaaacttgtcatcatcacaatctttttgtgccttcttccttaccccactggttctctcttaagagaagctctggtgtcatgtgttgtgatgtaatatagtgctgtaaagttctgattttgtcacttacagccagcctggtcttggaataaaattttgcttatgaagacattaaaaaaatgaataattttgaattagttacttggacttgtgagcttcagttacttagcaaaaaatgagattatgtcttcaatgtgcctaattatacaattgttgggacaatcaagtgaaatcacatgaaagtgttttaaaaaccaaaggtaagtaatatttttttcatattaaaactgtagattcaatccaacatgacagatatttataagcatgttaaatcaagtttagccgaaagctgccttcttacttcagtttagcctaaaggtttttgagctataacaagtggaggcatattgtgagctataacaagtggaggcagaaacagactgtagccacacttgtgccagtcactaagttttggccaatcaaatgtagtcaactgttcaaactgtgttcaaataaggcaaacaccaacctgtaaccagtccagctgtttttgtacgtcacttcctttttctgtatgtcacttcctttttctgtacatcactttcctttttctgtccttaaatcttccaccatgtggctgtgctggagtctcagcgcctactctggcttaggagcgtgcctgatttgcagattgttcattgttcagttaaactcctttaaatttaattctgctgaagtttttcttttatcaagtacctaatatgtcagacgcagtgttgtagactttagatttcaggagaaggaagagaaaggaaataaaacataatgtaaatgtctataatatatgacagaatatgaaaagggtaataagagattcagcttacctatattttggcttaggcaaagagttacccacctgaatctgctctaagtccatgaggcttgtttaccacaagtggcaaagtaggaattttgaccatttcgtgtctctgtctctccctccccacctgcttcccttctctcctcccctttatctccccactccctctctgtctccccatctctctccctgccataaggtgaaagtttaaacttgggctctccaatagttgcagataggagcttgttgatttttttgtgtacaagcgtgaatcagtggccaagtcaaagtgccataaggaatgtacaatttttagactttggtgagtattgccaatgatatagcgtctagattttaatatctgcattgtatacctttccagggcatagaggattaaagggggactttagaaacaactatttcagtcatctgtgaagatactttttacagaatcccagacttagcttgacggctttttatagtgaggaatctttctatcatgtaatgcagaccactttattatgggctccagtatttggagttcttagtcccaaatgaccaccttctccctctgttattctgtattcttttcattttgttagatatattttggcttgactgaagagagaacctgttgatggggaagctaggaatagaaagagaagggataggttcaggaagcttgacaaaaaaggaaataatggtagtaataatggttaataattcttagcactgaagtctcaggtactgtgctaaatgcttttcttatattataacctatagaattgatgttttaatattaaatattaattaaatgaaagattagtttgatagtaaataatagtatttaccctctgttacagaaaagaaactgagctacaataatttgcccagcaaaaggtagagttcttgctgggctattgattctagagaccaaacctttaacattgccatgtattgtctcttagggataaccttggaggcctctttgggaaaaattttctccttttttttttctaagtatgatagtgtttggaaataaaagattaacatttcaaggctggtaatttgggtggaagtggggaggaggtgaataaaatttattcaatattttaaggttagatgaagagataaggaaaggaaggaacctggaagcagatgagtgaatgtaatatgctttgttagtcagggagaaaggaaattttggtttagctgttgtaatgactacattttataatactatataaacatgcaagtttgatctttgtatagtttagtaaaagctatggtcattagtttatagtccagtgctgtccaatagaaatgtagagtgaaccacacatgtaattttttaactttttgttagctacatttaaaaagcaaaaagaagcagttaaaattggtttcagttatttaacgtaatgtattcaaaatatttcaacaactaatcaatataaaaatatcaattagagttttacattcttttattcatattaagtctttgaaatccatgtgtattttacacttatagcacatctcagttcaaactaaccacatttcatatggctacatttggctactgaataccttaccagacagtgcatttacatactattagaagagaaaaggtttattgtagttgctatgttcataaaaagtttctgattgaattacaagtagatggcttattctccctctgtatgtaacaaacaaggagtgaagaggaatctggggctgcaaagcatcgctctccagttgtatccagagaatctactcaggaggggcaacgtatttttttattttttattttttaaattttactttaagttctgggatacatgtgcagaatgtgcaggttcgttgcataagtatacatgtgccatggtggtttgctgcacctatcaacccatcatctaggttttaagccccgcatgcattaggtatttgtctgaggaatgaaactataaacatattaaatcctataaaaagaaaaaaaagtaaggttctgaagggttccagaattcaggagacggaagagaaaggatattttttatacttaaggaagtggggaggaaggtttaccaaatgtttaggtttctgctgattgaggctttgttgtatagttagaaggacttccaagagactccagaatttctgctatcgtagttctgggctctggttttacctaaaaactcaatgctttttctctagatagagctctggaggagaggcacacagttcttacttagtgtgaaacatggtgtttgttggtttagggactttgtacctctttctggaacctttcagaacctttttttttctttttataggatttaatatgtttatagtttcattcctcaggcaggaattactgaagtttgcttttcccttaaaaaaaaaaaaaacccagtaaattaaataatcacatttaaaaaactatagcaaatcttttctaactatgaaagttaaaaaaagtcatgtattctttgtgaaaagttaggtaattgagatacctgtttttacatattaaatgaacaggtctcaagcagagttttcactttggctgctgcttcttgcactggggttccttgggcaggagcactctggtgaatcatcacctctggtttggatgtagtagtactggatattttgtttcttttaaggagagtgtgaacaaatgggagttatgtgttcctccggggtatggtccatttgtatattgctctttatctgtgtatcatattttatttggctaagagcctaattataatatatttaatttttaaaaatcttagctatttgtagggtttaaaaaactaaacaacagcaataggatttgtattgctaattgagagataccaggttaaaatacaagttttctatataatttagcagaataaaacacacttatcatttttccattttctgaatttgtaatatgctaatgttatcagtatataatattttttgctatgactaattgtgttatatttgttgtgaatgtagtcttggttcaagtaggggtaaggaggtattttggaaaccagtgcttaccattttggggataggtggtgggaatagacaagctagaaatacacttggaaggaagaaaaccatttagtaggaacttgagatgaggggagaaacagacatttttaggaaagtgtagtgttttaaaaaataaatttagacacaaaaaattaatcattaggaacataatcagattttagaaaaatttaagtagaaaaaaatcacgttaaatagataactttgaagtaaatactaattatgtttatattttgaggggaggaaataagtctcttagttggcccccttgaggctgcctagatgtggagaaccataagactgagtttgtaccatctttgagttaaaaagctaaccctgagtgattttggaatagattcctttaacatattttcagtcatattccttttagaattattattacatagatttcctaatttgtaattctcaagtgctgtgaaacattaaacatttttagcaacctcaacccatcatagtcctatgactgcccttctttcacttttagtcatataggaacatttataagagtatctgatatggttagactttgtctcctcacccaaatctcatcttgaattgtaatccccataatccccacgtgtcaagggagagacctggtgggaggtgactggatcatgggggtcgttcccccatgctgttctcatgttagtgagttctcatgagatctgatggttttatacgtgtctgacagttcctccttcacccactcgctctctcttgcctgccgccatgtaagacatgcctcttccccttctgccatgattgtaagtttcctgaggcctccccagccatgcagaactgtgagtcaattaaacctcttttctttataaattacccaattttgggcagttcttcatagcagtgtgagaatggactctggccatgattttcttggtatgactcaggaaaattcttctatggggtatggctgtggagtggttttgtgcttgctgttgttgccgtggtgcttcagaaagttagcctagattaaagagttcaggttttggagtcacatgggttgtcttgaattctgtctctgacccttaactacccctgtgacattgggcaagttactagacctcagtttcctcaactgcaaattggaaataatagcaaccacctcctagggttgtgatgaagtttaaggataaatgctgctctttttattgagcatttatttattccagccagacactgtgttacatacttcatatgcagtatataatttaatttgtatgtgtatattagagtatgtaaaagttcatttccaacggtaatatatgtccagtaaccggttgctattactttttctatatgttgattccttaatcagaagttgatgttcctaagatgaaagatgggaatgggcattttgatcagatctgaaggacttgtttggaagttgacagtggtttgaaggtgaaatatttactagagtgtggttcaaggataatctgcatggtaattaccttggaagcttgttaaaatgtagagttttgtgtttgtcatctgaaactctgagtctgaatcaggatctctggccgtggagcccagaccctgcagttttataagcttaatcataattcttattctctatgaagtttttgaatcatctttttaatttattcttcccgatgattaaaaaatgattctaatgatttttaaatatttttatttgatgtaatgagctttccattttattggtaatggaggtggtaaattttttccatttaaatgtttacatatatgtgatttttgtatgttataagagtttaatgggtggtgacattcattcagctaatgtttagtaaatattaaaatattaaaatttataaaatacaatttacttatttggagtattttaaaatgaatatatcattttattcagttattcaaacaaaatgattgttgagactatgagtaaaatagtctcaatttactataaaatatgtcatattttactcagtttatagtctccgaatagggtgggaaaggagagcagattgagaatgtgctgttatgaagctaggtggagaggggaagggagcgattttctgctgctaactagaagaaaagcataactacaaataatttatataactaataagatttcaaagcagatagaaattttcagggagttttggtcagagtcattttattagtcatattatttaatgaaagaataatcaggaatgctcagcctctgtgttttctactattgctttgctccctaagaacgctcttttagattttatctgtctattcttttgagttttatctttgccttcctgggaagtctcactcgactttttaggaaatcaagttgtatccccacagtgcttcacatgaccttattttttttagattcttcaagtaaaatcttactcaaaggaaccaataaattgcctcacgtcataattttaaacttaagtgtttggaagactaatttcagtgagtctttgcattggtatctttagcccacaaatctttttggctccagtatccactttaataattcttatgggttaagtaactgtatttttaatatctgtagttttgttcattatcagaaactaggtcaccagggtttgttgtgtcattgttaattaaaaaggtattgtatgctttttttttggaatgtgcttgtactgaatgaagccaaaatatgttagtaatgctctgctttaaatactcatagaatataattttgcatattttaaactcaatctatctgccagtacaacaatgttatttatctctgagaattttgactattctttcatgctatttagaattcaatgaattgttaaaacttctagtaggctttttactgacagtctctgtctgacttctcctttacaagttttcctcaatattttcagaagtaacatttgggtcttactgaaataggaatttttggttctatagtagcagatggaaacagtagacttttttagaggttggaagcagtgggatacagagaaggagaaaaatcagactaaatttatgtcatgcctctttcattgtgaaaaataattatagcctcatgtacattacttttctgagggttgtagtggtggtaatggttgtggaagtagtaatagttgtagggatgaattaaggaggcattgggtaagaacgtgtctcccaacataggatttcagttacttcccaaatataaataacagtggttattaccaaaaatttttcttcaagcgacagtgatctcactgtatgttgcccaggctggcctgaaactcctaggctcaagtgattctcctgcctcaacctcccaagttgctgggactacagacacacacacacaccaccatacctggctgaatttttttttaaccagagaagagcacactaattttttctttacccttatagcattttcattaccagttattatactttcattctgaatgatttcagaatgtttggggatggtgttgataaactagaattattttgtggttaagtagaggccctcaaacagagtacagctcaagtctcaggtttaccacttttttttttaagtagtacatggggcaaattatttaatatcttattttgccataactaattattaataaatatctactttataggtgtgttgatgattaaatcaatttgtaaagaataatgggctgggtgcagtggcttgtgcctgtaatcccaacactttgggaggccgaggtgggaggattacttgagcctaggagttcgagataattctgagcaacaagcgaggcctcatatgtataaaaaatgaaaaacttaggctggtgcggtggtgtgtgcctgtagtctcagctacatgggaggctgaggcaggaggattgcttgagtccatcgaggtctatccaggctgcagtgatctgtgattgtaccattgcactccagcctgagcaacacagcaagaccctgtctcaaaaaaaaaaaaaaaatgccagcaaatagtatgtgttgaatatttagttataagtattattcactctctaaaatagtcttcttagtaaactctaattgaccttagggtaaaaaaatttttatatttaaaagctcagaaaaattcagcttagttatttttaggctggtgtttggtctcacatacacacttaacgcccctttcaaactgttatggaacaatgtttttcaaactttaatgtgcatatgggattgtgtagggatcataataacatgtagattcttattcagtagttttggaataggatgagatgttacctttccaacaagctcctgttggtaatctggatgtagctcattcttataacacactttgagtagcacagttatgcagtgttccattaagtggttctcattcctgctttcagtatattataaacacttagatattttttgttctttatgccttggctctgtgtcataccagttaaattagagctttgcctttggggttctgggcatcatcgtcgtcatcattgtcgtcatcatcatcatcattttttctttcggtaaaaatatcctggatcattctcttgtgaaactagcattaagagccaccactttagttatctgaaggagagtcataagctaagaagctacattttaggtcttctcttactttgttgtcttccattttaagctcatttcctctgtagagatgatggtggacagctggttagaactcttaaactggaaggcagttaatatgttggcctgaagttttcttttcgctagactaaaaggtttgactgttgaacctttctttatggatcctatttcctatcccttttcatcatttgtatagtcttctttggactttccctaatttctcaatagtctccttaaagtgtaataacccaaactagatacaaaactgctgtaacaaaactgaacaatggcagaggcagaagaatatagatctaaaaatctgtggttttcattagcgttgaaaacttgtatttgcttcagactttttattggccttttctttatgtttttcagggttaaaatgtgttttatgccatgatatttgtttcaatatattcctttcttaggttatgcttcttctttcttcctcaactgtgcttcttgtatccatttcccatcttgcacctattttggaggagaggcagtaaatattttcttatggacttaccatgtttgggaagaccgttttccaaagcgatcaagatcatgttaaattttattccatctagccatgatggctcagttaggatcaggtcaggaaaacagtccacactaaatactcgaggcaggaggatttcttgagaccaggagtttgagaccagcctgggtaacatagtaagacctgtctctacagaattacaaacaaaaacaaaaaatttcagcccagaaaatttaatacagggaagggattatacaggtattggagggctgaaaaagcaaacagggaacactggggtaacacagagacaatatttgcaggaattagccactattcatatggttgagggggaaataagaacttggagttgggacctcatagaattggggttcaaaacctctggagggggtacttcctgacagctgttggtatgtctgaggggaatttctgagagtgccagaaaaagctggtggttatcactgctactgctggggtggaggatctatgctgggcaatgctgactggaaaaagcatgtactgcattctccctctagtgtccttattggcagtgtgaggaagctagctgcagaagagaaaagtagttttcagagttttattttcagtattacaaagatgagtattaaagggtagatttggatctgagagaaaatagctgaataaccagtatatatagccttctcttctggtcaaaggaggccataggcctttggtctcttggtctcttttcctagctacttggaccccagacccagatattcttaatgctgagggtttggaaggaaagttgttattattatttaaaaaattaatttgtttagttaatgtgatgggggagggggcatgagacgggtctactttgtcttttcttttctttcttttttttttttgagacagtgtcttgctctgatgcccaggctggaatatagtggtgtaatcttggctctctgtagtcccgagctcccaaactcaagcagtcctctcacctcagccacccaagtagctgggactacaggcacctgccaccacacccagctaatttttgtattttttgtagagacgaggttttgctatgttggccaggctggtctcgaactcctggcctcgagtgattcacccatgttggcctccaagtggtctgggattacaggtgtgagccaccatgcctggctgggtccacttatttattgttatttttttttttgagacagaatctcactctgtcactcaggctggggtgcagtggtgggatctcagctcactgcaatctccaccccccaggttcaagtgattctcctgcctcagcctcccgagtagctgggattataggcacccaccaccatgcctggctaatttttgtctttttagtagagacagggtttcaccatgttgcccaggctggtctcgaactccagacctcaagtgatctgtccgccttaggctcccatagtgctgggattacaggtgtgagccaccgtgcccggcccgggtccacttattctgagataattctgttacagctttttttggtaacttacatttaatcattagatactccttctttgcctcttgaggtatttctgttttttaaaagcccttatttaaaatgtaaaataaataatggtaaaagtaatgatgttacccataaacaaagttttaaaattggttgcttattagccaaacagtggtctgcagtggtaaccaacctctgaaaagattatgccttttttactcattcaaaaattccccctcctgcagagcttcttcaattttaatgtgtatatgaatcagttgaggatcttggtaaaatactgattctgattcaatatgtccctgggtaaggcctgagattgtgcatttctaacaagctcccaggggaggctggagctactggtccctagaccagacttttttaactcccttccctcccttgagaactactggtttggcttagatccagtgttggacttggatggttgagtggtgagtgatcataaagtaagagtttctattgtaagcctgcccgtctagaaatattttgagcaattttagtagagctatttatagctgtttctttccaggtaggatcagagaaatatatgcttctgaataggttaaattttcttccataatataatgctgccctgaatgcagaaatgtgcctatcacttgtaattttcctggaaggcgtgagactgcttggtaattgtgtacatatttaagggaaactgagtaatggaggacagaatagaacaattaacaaattcatgcatcagataacttgctttcattaaagccattgttactcttatttattgattgttcctgatgataggacatctgcagatttcaaaaagtgtgtttagtgtgaatttcatactgatggcatttctctgcttttgacagtttcatatacttaaacttgtcattaaaacacagcatcttgccttgagccaaatgaaactttgaatagagcccaaatttatgaaattgttaatttctctttacatctagattttactttcagtaatttctatctgctaacacaaatagaaaggtaatctttcatttggttgccatccttcaagagcctctctctgcccttccctccctgccttcctggatctttccttttgtctttacagacctagattttgaaaggttctaggttccttttgtctgttgatactatgtgaatgttatccttaagtttttaattcaggctacaactagacagataatgtgtctcacaattagctggggtgagagagttaaaatggaagttaaggattcaggggattcctacagatgggtgaagaaaaaagctcaatgttaggatccttaacaaagcattttgattggcatatggagacctttgcgtgaacacaaatgttcatatttgaatatttatagaagataatctgtcaaaattactgttattttaatttgccaagcttggctgattgccgcagttggatgttagttgaattcaagttgaagagttgtaaatatgttctggtgtgggacatgctttttgtccttgaagctgtttgaatttcttacttctcccacctacacccccttctttaaaactgcgaggcttttttgtattagttgaactttcatgttcttttttaggaaaaaatattaaagtaggatgttaactgtatggattaaaaattttttttaactaaatttgttgacatttggtgatcaggaattgtttaaataattttaactatttgtccaatctttgcttcaaaggacctgttcctggagactcaaatgtagggatatatatcttatttgaatggttttgtgtgggatatgtttcacattaacagcaaagaaaatgtagacttctagataattgatgtttcccctttcttttatctcacttgaacagctaataattttagtgacccagattcaagcaataatacctgtcttcataattgtcatgtggttttgtcagcttcttatattctaggggaaggaagataagacttttttaaatatattgaaataacttggttaataaatactttttttctctttttagaagccaggaacctgttctctttccatagtgtctcctcactcagaaaacgttgtgttctcctgcctcagcctcctgaatagctagggttacaggcgcccgccaccatgcccggctaatttttttttgtatatttagtagagacggggtttcaccttgttggccaggctggtctcaaactcctgacatcaggtgatctgcccgccttggcctcccacagtgctgggattataggtgtgagccactgtgcaggagaatggcttgaacccaggaggcagaggttgcagtgagctgagattgtgccattgcacgccgggctgggcaacaagagtgaaactccgtctcagaaaaagaaagaaagggaaaaaaaccccaacacactgtattaattattgatgcagtatcactattcttactgagactacattattttagctttagagatgatatagtggctttcttaaagttatatgacatttttttgggagcagggctgtattctgtgccccatgtactaagctatcttgtctcatttaactagccactgttatctgaatagttgagttttacatgcgtaaccacttgacctgattagtcttaatttttttcctgatgtttttatttctttatctcttagaaaatgacataattgaatcagttttgttggttattactttagctagaaactatgtcaagtactacatttcagttttttttttttttttttttttttgagacagagtctcgctctgtcacccaggctggagtgcagtggtgcaatctcggctcactgcaagctcctcctcccaggttcacgccattctcctgcctcagcctcccaagtagctgggactacaggtgcccgccaccatgcctggctaattttttgtatttttagtagagacggggtttcaccatgttagccaggatggtctcgatctcatgacctcatgatctgcccgccttagcctcccaaagtgctgggattacaggagtgagctaccgtgcccggcctacatctcagttttatttagactttgttttggagtttcaggaatttgaggtttcaggaatgtattttgtatttagaaaattaagagtggaacttttatagtattttctgtctttcacaatcatccatcttcattctcatttgacttttttttgctatattttttttctagaagattttatataatcttttcctgttactacttttgcccattctttttgtgaccatctccaagtcatttcccttgtatctcaccgtcattccttattatcttcctaggaaaacttatttgtccaactctgtagctatcctctggctggataacaaaattattaataattccttaagatgttaccctagctactaattttgtaatagtccaccatgtgttcactgtgtaaagggttcagaggtgactgttgtacctaatgcaccacagatgtggaagtaataataaaatttacatatatgtaaggtgaaaatattgctaatacgttcccttgggtctggccattctgatatgcttgctaagtttggaggcttattttgtaatggttctttcggatttcttaaggtgaattagacattatgtttaccttgaattttaattggtatacttttggttaagtaggttaaaagtcaatggaataaaagttaagccagaaatataaaaagtaataagccatttttcagtgtgatttgaaaaacaatttagctgtatttcttgctataaaaaaagaagtaaagaacactatacagtggactaagattttctaagtaaactaattttgataaaggttaattccatggtgatagcagatgttggggattggcatccatatgtcagatttcacataaaaatttagctttctactgttttttatttccttaggaagaactataaaacttaaatttgtatagaaggtatgataatgctattttaataaacagaatttgttattttgaaaattgggtagtaaggacaaccagtgaattgtactacttattgatttttttaaaaaaatgtatttttaattttcgcgggtacatagtaggtatatgtatttatgggatacatgagatgttttgacacaggcgtgcaatgtgtaaaaatcacatcatggacaatgcagtatccctcccctcaagcatttatcctttgtgttacagacaatccaaatacactcttagttatttaaaaatgtacaattaaattattgattgcggcagcacccctcacacaggggcaccagctgccggggtctgcccatagaccctgacccggccacggatgaataaagtacactgacacacagatattctgttttgccagtccagctgagggtgtctcagctgtttacagactccctggagggttctgtaaacagttgtgaccatgacctcgatcagcaagtgagacttgcatttatgcggtaagattaattaacaaaggcttgagtcaacaccattagaggtaattgacattgtggactttccaagtaaaaagcccttaatcacccatggcacatcaaaggttagtcttaagattatatgagtaaacaagctagctaggtaaactactctgccttcctttattactagtttaatttgtttaaaggtaaagatcaggttgccttcaaccatgtctattactgaagttatgcaaactctcggccttccaagaagatttgtgtctgtctctataactatcttcaatatttttcccaccagcctgattgaaccccagtaattgattatagtcaccctgttgtgctgtcaaatactaggtcttattcattcatcctgtttttttgtacccattaaccatccccacctctccctcatcccaccactacctttcccagcctctagtaaccatccttctttttccatgggttcagttgttttgatttttagatcccacaaataagtgagaacatgagatgcttgtcattctttgcctggcttatttcacttaacgcagtgacctctggttccatccatgttgcacatgacaggatctcattctcttttatggctgaatagtactccactgtgtatatgtaccacattttctttgttcattcgtctgctaatggacacttagcttgctttcaaatcttggctattgtgaacagtgctacagtaaacatgggagtgcagatatctctttgatacactgatttccttttttggggctatatacctagcagtgggattgctagatcatatggtagctaaatttttagtttttttaaggaacgtccaaactcttcttcatagcagttgtactaatttacattcccaccaacagtgtatgagggttctcttttttccacatctttgccagcattgattattgcttgtctttcggataaaagccattttaactggagtaagatgatatctcattgtagttttgatttgcatttctctgatgatcagtgatgttaaacacttttttttttttttttttgagatggagtcttgctctgttggccaggctggagtgcagtagcatgatcttggctcactgcatcctccacttcctagattcaagcaattctcctgcctcagcctcccgagtagctgggactacaggcacacaccgctatgcctggctaattttttgtttttgtattttagtagagacagggtttcaccatgttgccgaggctggtctcaaactcctgagctcaatctgcctgcctcaacctcccaaagtgctaggattacaggcgtgagccactgtgcccggccgaacactttttcatacgtgtgtttgctagttgtatgtctgttttttttttgaaaatgtctgttcagaacttttgcctgtttttaaattggattattaattttttcctgtagagttgtttgagttttttttttttttttttttttttttgagatggagtttcgctcttgttgcctaggctggagtgcaatggcataatctcggctcactacaacctccacctcccgggttcaagcaattctgttgcctcagcctccgaagtagctgggattacaggtgcctgccaccacgcccagctaattttttgtatttttagtagagacggagtttcaccatgttggccaggctggtcttgaactcctgacctcaggtaatccacccgcttccgcctcccaaagtgctgggattacaggcctgagccaccgtgcttggcctagcttcttttatattctggttattaatcctttgtcagatgggtagtttgcaaatattttcttccattctgtgggttgtttgtttgttgcttgtttactttgctgtggagaagctttttaatttgatgtgatcccgtttgtccagttttgctttggttgcctgtgcttgtggggtattacttaagaaatcattgcccagaccgataccctggagagtttccccagtgttttattttagtcatttcatagtttgaggtcttagatttttgtctttaatcaatattttgatttgagttttgtatatggtgagagataggagtctagtttcattcttctgcatatatatatccagtttccaagcaccatttattgaagaaactgtcttttctgccatgtatgtttttggcacctttgtcaaaaatgagttcactgtaggcgtgtggatttttttctgggttctcggttctattgttctgtgtgcctgtttttatgccagtaccatgttgttttgtttattatagctctgtaatataatttgaagtcagttaatgtgattcttctagtttggttctttctgcttaggatggctttggttattctgagtcttttgtggttccctataaattttagggttttttttatatctctgttaagagtgtcattggtattttgatagggattgcattgaatctgtagattgctttgggtagtatggacgttttaacaatattgattcttccaacccataaacatggaatatctttccattttttggtatcctcttcaatttctttcatcaatatagtatagtttctgttacagagatctttcacttctttggttaattcctaggtatgtatttatttatttattttggtggctattgtaaatgggactgctttttaaatttctttttcaatttgttcacatttcacatatagaaatgctacttatttttgtatgttgattttgtatcttgcaactttactgaattagtcagttcttaatagtatcaattctaatagttttttggtggattttttatgtttttccaaatatatgatcatatcatctgcaaacaaggataagttgacttctcctttacaattcggatgccctttatatctttctcttgtctaattgctctagctaggactcccagtactataatgaataatagtggtgaaagtgggcatccttgttatgtttcagatcgtaaaagacaggctttcagtttttccccattcagtgtgatactagttgtgggtcttttgtatatggcttttattatgttgatgtgtgtttcttctatactcatgtttttgagggtttttattagaagggatgttgaattttatcagtgttttttcagcattaattgaaatggtcatatggtttttgtccttcatttgttgatacgatatatggtgattgatttgtatatgttgaaccattctggtgtcccagggataaatctcacttggtcatgatgaatgatctttttaatgtgttgttgagttcaatttggtagtatttcgttatggatttttgtatgaatattcatcagggatattggtccttagttttcttcttttgatgtgtctttttatggttttggtactagggtaatactggccttgcaggatgagtttggaagtattccccctcctctatttttcggaatagtttcagtaggattggtattagttcttctttaaatgtttggtagaattcaacagtgtaaccattgggtcatggcttttctttactgtcagacttttaattatggcttcaatttcattatttattattggtctgtttgggttttggatttcttcatgtttcaatcttggtaggttgtatgtgtctaggaatttgtctatttcttctaagttttccaatttattggcatatatttgctagtagtagccactaatgattcttcggatttctgtgatatcggttgtactgtctcctttgttacctctgatttatttggatcttcttttttccttagtctggcttaaggtttgtccgttttaacttttccagcaaccaactttttgattcatcttttgtattttctttatttcaatttcctgtatttctgctctcatctttattatttattttcttctactacttttgagtttgttttcctcttgcttttttagtccttaaaatgcattgttagcttgtatatttaaagtttttcttcctttttttgatgtaggcacttgtagctataaaattccctcttagtacagcttttgctgtattccataggttttggtatattatgtttccattatcatttgtttcaaggaagttttcaattttcttcttaatttcttcattgacccacttgtcattcaggggcaaatcatttaatttacatatatttgtatagtttccaaaattccccttgctattgatttctagttttattttattgtggtcggagaagatgtttgacactatgtgggtttttttttctttaaatgttttaagacttgttttgtgacctaacatatggtctatccttgagaatgatccatatgctaaagaaaagaatgtatattctgtagctgttggaagaaatattctttaaatatctattagatccgtttggtctatttctttgttgattctctgcctggaagatctgttcagtgctgaaagtgggatgttgaaatctccagctattattgtattggagtctttctctctttagctctaataatatttgctttatatatctgggtgctccactgttgggtgcatatatattaaagtacttttttatatcctcttgctgaactgacctctttattattatatagtgaccttctttgtctcttcttacagtttttgtcttgaaatctattttgtctgatacaaatatagcttctcctactctgttttggtttccattggcatggaatatcttttccatttctttattttcaatctgtgtgtgtctttataggtgaagtgtgtttcttgtaggcaacagattaatgggtcttctttttttaaatccattcagctatcccgagtcttgtgattggtgagtttagtccatttacactcagtgttattattgacaaacaaggacttattcctgccattttgtaatttgttttctggatgttttgtggtcttcccttacgtctttctttccttcctgtcttcctggatgttacagcctactacccacctggggtatatggtatagcctattgcttctaggctacaagcctgtacagcatgttactgtactgaatattgtaggcaattgtaacacagtagtaagtatttgtgtacctaaacgtagaaaaggtacagtaaaattatggtatttataatctttatttttgtagacagagtcttgctcggttgcccagggtggagtgcggtggcgcgatctcggcttactgcaacctgcgcctcctggttcaagcaattctcgtgcctcagcctcccaggtagtagctgggattacagatgtgcaccaccatgcccagctaagttttgtaattttagtagagacgaggtttcaccatattgtccaggcaggtcttgaactcctagcctcaagagatcccctgccttggcctcccaaagtgctggaattataggcataagccttcgtgcctggctgggtatttatgatcttatgggaccactcatatatgcagttcgttgttgattaaaaccatcattatgtggtgcatgactttactttgtatgacaagttactgaacgttctaaaggagatatgaaagtaacttaggtttgatttttgtttgaaattgtgatatttttgccggctgtggtggctcatgcctgtaatcccagcactttgggaggccgaggcgggtggatcatgaggtcaagagttcaacagcagcctggccaagatggtgaaaccccgtctctattaaaaatacaaaaattagccgggcatggtggcgggcgcctgtaatcctagctactcaggaggctgaggaagagaattgcttgaacctgtgaggcggaggttgcagtgagccgacatcacgccactgcactccagcctgggcgacagagtgagactctgtctcaaaaaaaaaaaaaaaaaagaaaaagaaattgtgatgtttctttcccattccaagaccatccttttcttagtactctttctttcctttagagctaggctagtggggagcagaatcatgagcttaaattagtggaatatgtggacattgggtagcatggggagaagtgtttcagcttctttctctaaactttaatttccattctttggtgcttaaagtggtgttttaatcacttgcatctggttcaagagggtgtctgattctttgcaaagctattctatcgacaaaaagcattcacagtgttttcctagtggattaatattgggttgacatctatttgcatgttaagtgctgtattgttatcatttggcatttattaactagccttgatatactgtgcattagttggcatttatacatgttttagtccctgctctagagaaaatatcctaaaagggagctaattgtgggaaatagagccttttctcacatatccagctgcctgggagctttcctctaaagacctttaagcattggaaagtcattcttcaagtagttaagataggaaatgacagtcgtgtaaaatagggccttaaaaacaactaccaggtagactcatgatagtgaccctacagggaattaacaacatagatatgattttctcaaggagttgggaatcttcttattaaaattagagcagtgaaattgttcccttctctgtagaatataaaaacaaaatcaaaaacaaaacaaaaaatcgatcaaacttctctccgtgtgttaacaaaacgaccatgagatctgtggaggaaggaaaaaggagaaaactttattttcagagtaacaatctgcagataagggaaagtaacctctggtggaactgtaagcacgtgcttcaccgaaggggagtgaacagtagtatttaagccttctagggtttgttttacatgcatatccatcatgtaatatgaattgtttgaggaatgtctatgaatatatatggggaagtctagtgcatgcacagtgagttaacatataagtaacatacatcccatcttcgcttcagggcacaattttagcattaaaatgaggtggaattcagctctttatgtcaacaggtgaactatagagcacaaagatattttgtatgcagtctctataagctggctaaaactggcttagggtctgtagcattttagcaggaaagaatgtttgtaggactggcctcctgtcctatcagtgctgttggtaggaccctcaaggcagggttgtcccagttgtctttatcaggcagtttaccaagatcggttgggcagtttctctagaacagatttctgcctaatagaagaggaaaacttcatggcagttaataagaaagaatgtttgtaagaatggcctcctgtcctatcagtgctgctggcaggaccctcaaggcagggttgtcccagttgtctttatcaggcagtctaccaagattggttgggcagtgtgtctctagaacagatttctgccgaatacaagaggaaaacttcatggcagttaacaaaccctttggtagttaacaatgtacgtatgtatgaccaaacccttgttcctgctatggccatttaattttctctcttgagggtcttatcttagctacagaaagtccatcttatctatcattgttgacctttggatcacagctagtagtggtttgaggacagaatgtatcaatgtatcaatagtttctgtcttgtcttcaccgctgagtaggtatacaaaacttagtcaagtcaaatcacttctttttttttttttaaatttatttttttatgatactttaagttttagggtacatgtgcacatagtgcaggttagttacatatgtatacatgtgccaagctggtgcgctgcacccactaactggtcatcaaatcacttctttacctcagttttctcctcttcaaaatggagataatgcctaccttacaaattgatggtgagaattaaatgaggaaatgtgtgtaaaaatgtgttgtatgcctggtacctctttggcatgcaactttgtgttttcctccttcctttgacattagtaatatttggatttcactctttgaattcagtggttacttggttgtggaatcaaattattttgtctttccaaacctcatttttctctaacataaaatcagtaatacacactttatgaagtagtggttgaaattcagttcctagtgtagtctaggaagattttcttgaatctgaatgtcaaattgctaaaaacttgtataaatttgtgagttttgctgtgtagatcttttggacatgaaaatacaatatctttttaagaattaaacagtaggagaaatatactaagggaaagtaagtctctagaatgttttttgggggactctacaatagcttactgcattacagttactgtaattcatcaagataatagggaaattatgcatccaaaggatttatttacttgaaatagcacctctagaagggatattcatagagcagtaatataagaagtgagacacttgaacatacctttttctttgctttttttttttaatcttaggtaacttcagattttaataagatttcactatataatgttttgtgggcagatattgtaaaatctactgaaaatttcccagtttagtaattaccaaagaaataataaaccaatattaaagttcagttacaaaattaaagtcaggactcacaaacaaatcatgttaaatgagttatgaattaaattagtgttattgttgagtttaactgtgtgtcaaatcaatataatttctttgacataatcacagaatagaaatcaatgtatgtgtggtacattgtattgaagggttacaaagtgatgaactagtgagtatgtatttttaaggatgttatagacctatgaatttcaattatatttgtttaaatgtgaatcacttttataagcagcagcaaaatatcattgcctttgtattttgtagcaggtgatttagcttttgtgtatattcagataaatataaattttaatttattttattttgactaaagtttaagagataatttagcatattgtttgctaatcacttttaagtaatctcagtttagctggttgtggtaatgtgtgcctgtagtcccaactactctggaggctgaggtgggaggatcccttgagcctaggaatttgaggatgttgtgtgctattgttgtgcttgtgaataaccacagcatggtactctagcctaggcaacatagcaagaccttgtctcttataaaaagaaaaggaaaaaaaaaagaaatttcagttaataattttatttgacatgttacagctccttatttgaccctgaaaatgttgcagtgagaatagcctttgcatgcatagtccttaaccctgaagaaaaggataaaagaaaataaaatcaaaacttagttgaaaatcaggaagtgcggacaagcttctgtcgagaaaatggaggtgaatttatgtgtaaatgttaaagacatatggatatgttgattatagccatctttaagtgtttgtgttataggcagacggtttgcagagttagagtaaatggattaaagatattgctaaaattaaaataactttatttttcaagtttttttggtattatgtttgttttttcaggaaaccagatacttaaatataaaactcggtaattatttttgtaactattttattaataatttaatgttaactactagaagtctataattttacattgaatatacaaaatattatttgggcaaatgattattaaaataatatcatagtaatatacatcccccctttttgttatggtaaaatgtacataacacaattcaccatttaatcatttttaagtatacagttcattgttatgcaaccatcatcactatctccagaacgctttcatcatcctgaaatgaaactgtgtgcccgttacataataattccccgttacttattatctcccctttaatcactattctactttctctctctctgattttgactattctaagtatctcgtatgagtggaaccacacaaaatatgtccttctaggactggctcattgtatttagcataatgtcttcaaggttcatccatattgtagcatgtatcagaatttcagttctatttcacgatgattaatattccgttatatgtgtataccacattttgcttatccatttatctatcagtggacatttacattgtttctacttttggctattgtgaataattctgccatgaactttggtatgcaagtatctgtttgagtgtgttaatatattttctatatattttaacagaaatttgttagtttacatatttttacttaaacgagctaaatatctgaattttcagtgttatcagtgaatatttattgaataccttgtatattgtaagtattgtgggggtataaagagttacaatatcatgaaactattgttttaaagaatttacagtctaataacagtaatagggtgtgtttataaagacacagaacctggtagcatatgctttttgaagctgaagagatatctgagctctgatgcaaaccagcatcgtttcttgccaaaatttttgtttgttatcctgagcagttaggaggcagatacatggccacagtcaacatatgcatattccattcaagcatagcatttaaccttcaaggatgaattttggggtgatcatatcaacatggaaattagatcatgacatatctttaaagtcttctccatggaccttatctttaggtgagttactttccttctaccaaactgccaccttaactctgacctcatctcctatcccctactcccaccttgcactgggtaattttttgttgtggatacatttcttatgtatgtaaactggcttaagtgtaaacaaggtaaaagtcataaggaggaactacatatatgtttcaaggttctttccagctttatgattctaatttaatccctgtggtacctgtgtgttgccagtgaaagaaaacagagttagcatgcttagaggtttcacagcagagctgctttgtggtgatttttaaaggctaaaactttgaaataaaaacagtttggtatgtttcagtggtctctttttcttctctttcagagtacttttcctggaaaagcagaataagtcttttatgaatttagtcataactttgcagtttaattggacttttagggtttttctatgtgtgcaagctggaccttttgaagtttaacactggaatactagcatgagagtgttcctactcttaatttccactgagttagaccaaaggaaaacatatattttagattcatattttctttgaatgatgttttggagctcaagatgaactttaaaaaacacagctaagcagagcttctaaaaggtaatactgtagtagtatttttttcctccatgttaatctacttggctccccatagtgagcttgaactgtgagtggtaaagactcattactttgtagggtgtcctggccctaaaaataaaacttctttctcatagcctacagcctatgaatgtgattattctgtaagcctctgtaagtcactgtaagaacagtgactgtggcttcatttttatttattttatttttcttatttatttatgagacagtctcactctgtcgcccaggctagagtgtagtggcttgatcttggctcactgcaatctctcctcctgggttcaagtgaatctcgtgcctccaccacccaaatagctgggattacaggtgtgcgccaccatgccaggctaatttttgtattttttttgtagagatggtgtttcgccatgggcctgtctcaaactcctcctctcaagtgattcacctgctttggcctcccaaagttctgggattataggcatgaactactgtgccaggcttgtggtttcatttttgtaaaacgtttagtagagttggtgccttgcacataataaaatgtatcttctgaggttatgattccacataaaaaatgaaaactttaggagataattacagaagtgaagaaagatgaatgaacaaggatggccatctattcattcaacacataatgaggtctactatgtatcagacacaccactaagtactggaaatacagcaatgataaattagataaattagggaatttaggttgtctagaacagtgaatggcatgtaataggcgcttaaaaatatttgaatacatgaaggtctgttttgtagaaaatgatttatggtatggaacattttagtgaggaagtggaacgtgtcccatcgtattagggacacgttcattcattaaaaaaatggaaacaaactgtttattaatatggagactacttaagtcggttatggtaatacatagaatgtagtacagaaaagcccttaaaaaatgagatatttattggctgacacagaaagatgttctaatttacctaatgttgaattaaacaaagtaagctgttgaataggatgtatggaatgattcctttaatgtaaggttatttatatttctataaaatgtcacaaggtatggtggagaaatgataacaatgaatgattctaacaggaggtaagtttttcgctgatctttgctgtattctttatgcacttctgtgattgttttaccatgatcatgtgctactgtttaaaaataataaagctgcttaaaaatgtttctggataaatttttttaaacttaatattctatctataaatagtgttactggttgatggtccgttgtcctgtaaatgtaaaagtgttattaaagaattctgcattttctttctaaagaaatatagttaaccagagttcactttgatactcaacatttacctttaatgtttattatttattattcattttttaatatatttttttgagacagggtcttcctctttcactgaggctggagtgcagtggcatgatcttggctcactccagcctccattttctgggctcaagtgatcctcccacttcagccttccaagtagctggggctacaggagcgtgccactacacctggctaatttttgtaatttttgtagaggccgggttttgccgtgttgcccaggctggtctcagactcctgggctcaagcagtctggctgccttggcctcctaaagtgctggaattacaggcatgagccaccatgcccagcctacctttaacatttaacaacatttacctgtaacactcatagagtgtagttttaaaatgaataatagcatttacaaatgtgtagtagcaggaatatatttaataataattttaattttgttttggaggtactttgagggaggtatgtctacataattaaatggcaaagaacggaagtttttaagtttttttgtatacttataaatttaatttggatttagttattaataaatattaggttgaactgcacttttaatctaaagatttattttggcactcatttttgcttattatgacttctcattttcttaattagaggagagaagacatgttctttgggcgtcctggttatgtctagtcaatagtcttagttttcacaggatagtacggaatgttaaattattactacctattttcttaatttatttcaataacttgctgtttttatcaggaaaaattaatgaactaatcaaaatgttccattctatacatagtttgctcataacaaactcatttttttagaaatgttatagcaaccttattttttttttatcctccacaagatcattttagtgtagttactggagtttcaaatcatacgtaattcagtttgaaaactatgtctatggttctgtttagtaacattttagatgatattatttaaaaaggttaacattgcttagttaaaagttatcattattcttttaaaacaagttttatttttcagaccacacagtcctttgaattctgatgcatcaagtttcaaacagttttttgtttttggggatacttacctatgagatctccagaaattgtatatttagctatgaaaatcttcagaaactgtgagcatattaagcacacatataagactgtaaaccttagaggatgattttagatttctttctcttttttactttttatttttgaaaaaaataagcccattccagtttaatgaatatgataatttgaaatccaggtagaataatgtatctcattttcgccctcatattttaaagtgagatagtttataaaatggagaataagtcatgttgttagatgttgactcttatagtataaaagtatgaatcttatatagtgatattctattttaaatgctttatatgtttaaataatttagaagaagggaattatagaaaaactgaaacaaaatgcttgaattaatactataaacatgatgttagcatttataattgatattttaaattgttacataaaaatgtatgagtatggataaaaacatatatattagtctaaatgaaattaatggcttcttttatacactcacaatatttatacttttctttaagtatatcagatgttgataagtgttctagagaaaagtaagtacattagggatggtaataaggaatgttggaattgggaagatgccatttttatatagaatggtcagggaagatttcactaagaaggtgatagttgagtgatgctctgaatttggtgagggacatagctgtggggatattcggataagtgtgtttcagacaagatcaaaagccctgtgttgagtgcaggctctgcatatttagaaacataagaaatttaactgtgcatggcacaaggtggtcttatatgttaaaaaaatacatttttttggtttcatttttgctttcctggtacattctaagatatgctgaaattgagatttacttgtcttgcttattgtatcttgggcacccactacagtgccaaacacatggcaggcaatttgttgtggatgatgagaaagaattttggaggaatcttcttctttttttttttttttaaattcatactaccaaattatttcaagctacagaggtctttagagatcatttagataactcttttggatgttatgcatgagaagacatgtcattaaatagaatgacttccaaaagtcaccattaattagtagcaatcttgagttggcaaagatttttggtctcttagtctaactttagtccattgatggggtgatccttttgtttcagttgtctcatctatgcatgggaagatacttgctatggaaaacctccttgctgtggaagaactccttgcatctagaatcagattgcttggttgaaattcctgtttgacagtactagctttgtgattttctccctctcccgacttttccttttggtgccctggttttcttgtctgttagacagatattgttattctcattccagtattctttacaccataaacattttctcattaatcttctaatttaccaactcagagtgttatttcctttttttttaaagggatttatgatgaagagaataggagtttgaaattaggtgttcttgggttctataaaaatttaattcttaaggttatttgttagtatgtatcaaactcttatttaatgaatgaggaaaacatcagcaagacaaaagaactgctttcaagagtatttgagcatcaggagttcatgtattcatttaggaaaggaatgtcaaaataaaattttttaaaaattatactttaagttccagggtacatgtgcgcgacgtgcaggtttgttacatatgtatacatgtgccatgttggtgtgctgcacccattaactcgtcatttatattaggtgtatctcctaatgctatccctcccccctccccccaccccgcaacaggccccggtgtgtgatgttccccctcctgtgtccaagtgttcgcattgttcggtttccaccaatgagtgagaacatgtggtatttggtttactgtccttgcgatagtttgctcagaatgatggtttccagcttcatccacatccctacaaaggacatgaactcatccttttttatggctgcatagtattccatggtgtatatgtgccacattttctcaatccagtctatcattgatggacgtttgggttggttccaagtctttgctattgttaatagtgtcgcaataaacgtaacgtgtgcatgtgtctttatagcagcatgatttataatcctttgggtatatacccagtaatgggatggctgggtcaaatggtatttctagttctagatccttgaggaatcaccacgctgtcttccacaatggttgaactagtttacagtcccaccaacagtgtaaaagtgttcctgtttctccacatcctctccagcacctgttgtttcctgactttttaatgaccgccattctaactggtgtgagatggtatctcattgtggttttgatttgcatttctctgatggccagtgatgatgagcattttttcatgtgtctgttggctgcataaatgtcttcttatgagaagtgtctattcatatccttcgcccattttttgatgaggttgtttgtttttttcttgtaaatttgtttaagttctttgtagattctggatattagccctttgtcagatgggtagattgcaaaaattttctcccattctgtaggttgcctgttcactctgatggtagtttcttttgctgtgcagaagctctttagcttaattagatcccatttgtcaattttggcttttgttgccattgcttttggtgtttcagaatgaagtatttgcccatgcctatatcctaaatggtatcgcctaggttttcttctggagtttttatggttttaggtctaacatttaggtctttaatccatcttgaattaatttttgtataaggtgtaaggaagggatccagtttcagctttctccatatggctagccagttttcccagcaccatttattaaatagggaatcctttccccattgcttgtttttgtcaggtttgtcaagatcagatggttgtagatgtgtggtattatttctgagggctctgtcctgttccattgatctatatctctgttttggtaccagtaccatgctgttttggttactgtagccttgtagtatagtttgatgtcaggtagtgtgatgcctccagctttgttcttttggcttaggattgacttggcaatgcgggctcttttttggttccatatgaactttaaagtagttttttccaattctgtgaagaaagtcattcgtagtttgatggggatggcattgaatctataaattcccttgggcagtatggccattttcacgatattgattcttcctatccgtgagcatggaatgttcttccatttgtttatgtcctcttttatttcattgagcagtggtttgtagttcttcttgaagaggtctttcacatcccttgtaagttggattcctaggtattttattctctttgtagcaattgtgaatgggagttcacccatgatttggctctctgtttgtctgttattggtgtgtaagaatgcttgtgatttttgcacattgattttgtatcctgagactttgctgaagttgcttatcaggttaaggagattttgggctgagacaatggggttttctaaatatacaatcatgtcatctgcaaacagggacaatttgacttcctcttttctcaattgaatgccctttatttctttcacctgcccgattgccctggccagaacttccaacactatgttaaataggagtggtgagcgagggcatccctgtcttgtgccagttttcaaagggaatgcttcccgtttttgcccattcagtatgatgttggttgtgggtttgtcataaatagctcttagtattttgagataagtcccatcaatatctaatttattgagagtttttagcatgcagagttgttgaattttgtcaaaggccttttctgcatctattgagataatcatgtggtttttgtctttggttctgtttatatgctggattatgtttattgatttatgtatgttgaacgagccttgcatcccagggatgaagcccacttgatcatggtggataagctttttgatgtgctgctggattcggtttgccagtattttattgaggagttttgcatctatgttcatcagggatattctctttttttgttgtgtctctgccaggctttggtatcaggatgatgctggcctcataaaatgagttagggaggatttcctctttttctattgatgggaatagtttcagaaggaatggtactagctcctccttgtacctgtggtagaattcggttgtgaatccgtctggtcctggactttttttggttggtaggctattaatcattgcctcaatttcagagcctgtgattggtctattcagagattcaacttcttcctggtttagtcttgggagggtgtatgtgtctaggaatttatccatttcttctagattttctagtttatttgcatagaggtgtttatagtattctctgatggtagtttgtatttctgtgggattggtgatgatatcccctttatcattttttattgcgtccatttgattcttctctctttacttctttattagtcttgctagtggtctatcaattttgttgatgttttcaaaaaaccagctcctggattcattgattttttgaagggttttttgtgtctctatctctcagttctgctctgatcttagttatttcttgccttctgctagcttttgaatgtgtttgctcttgcttctctagttcttttaattctgatgttagggtgtcaatgttagatctttcctgctttctcttgtgggcatttagtgctataaatttccctctacagactgctttaaatgtgtcccagagattctggtatgttgtgtctttgttattactggtttcaaagaacatctttatttctgccttcatttcgttacgtacccagtagtcattcaggagcaggttgttcagtttccatgtagttgagcagttttgagtgagcttcttaatcctgagttctagtttgattgcactgtggtctgagagacagtttgttataatttctgttcttttacatttcctgaggtgtgctttacttccaattatgtggtcaattttggaataagtgcgatgtggtgttgagaagaatgtatattctgttgatttggggtggggagttctgtagatgtctattaggtctgcttggtgcagagctgagttcaattcctggatatccttgttaactttctgtctcattgatctgtctgatgttgacagtggggtgttaaagtctcccattattattgtgtgagagtctaagtctctttgtaggtctctaaggacttgctttatgaatctgggtgctcctgtattaggtgcaaatatatttagtatagttagctcttcttgttgaattggtacctttaccattatgtaatggccgtctttgtgtcttttgatctttgttggtttaaagtctgttttatcagagagtaggattgcaacccctgcctttttttgttttccatttgcttggtagatcttcctccatccctttattttgagcctacgtgtgtctcttcatgtgagacaggtctcctgaatacagcacactgatgggtcttgactctttatccaatttaccagtctgtgtcttttaattggagcatttagcccatttacatttaaggttaatattgttatgtgtgaatttgatcctgtcattatgatgttagctggttattttgcttgttagttgatgcagtttcttcctggtatcgatggtctttacaatttggcatgtttttgcagtggctggtactggttattcctttccatgtttagtgcttccttcaggagctcttgtagggcaggcctggtggtgacagaatctctcagcatttgcttgtctgtaaaggattttatttctccttcacttatgaagcttagtttggctggatatgaaattctgggttgaaaattcttttctttaagaattttgaatattggcccccactctcttctggcttgtagagtttctgctgagagatccactgttagtctgatgggcttcactttgtgggtaacccgacctttctctctggctgcccttaacattttttccttcatttcaactttggtgaatctgacaattatgtgtcttggagttgctcttctcaaggagtatctttgtggcgttctctgtatttcctgaatttgaatgttggcctgccttgctaggttggggaagttctcctggataatatcctgcagagtgttttccaacttggttccattctccctgtcactttcaggtatgccaatcagacgtagatttggtcttttcacatagtcccatgtttcttggaggctttgtttgtttctttttactctttttttgtctaaacttctcttctcacttcatttcattcatttgatcttcaatcactgataccctttcttccagttgattgaatcagctactgaagcttgtgcatgtgtcatgtagttctcatgccatggttttcagctccatcaggtcatttaaggacttctctacactggttattctagttaatccttcgtctaatcttttttcaaggtttttagcttctttgtgatgggtttgaacttcctcctttagcttggagaagtttgatcgtctgaagcctcttatctcaactcatcaaagtcattctccgtccagctttgttctgttgctggcctttggagggggagaggcgctctgatttttagaattttcaacttttctgctctgttttttccccatctttgtggttttatctacctttggtctttgatgatggtgacatacagatggggttctggagtggaagtcatttctgtttgttagttttctaactaacagtcaggaccctcagctgcaggtctgttggagtttgctggaggtccactgcagaccttgtttgcctgggtattagcagcagaggctgcagaacaatgcatattgctgaacagcagatgttgctgcctgattgttcctctggaagcttcatctcagaggggtacacggccatgtgaggtgtcagtctgcccctactggggggtgcctcccagttaggctactcgggggtcagtgacctacttgaggaggcagtgtgtccgttctcagatctccagctctgtgctgggagaaccactactctcttcaaagctgtcagatggggacatttaaatctgcagaagtttctgctgccttttgttcggctatgccctgtccacagaggtggagtctgcagaggcaggcaggcctccttgagctgcggtggactccacccagtttgagcttccaggcctctttatttacctacgcaagcctcagcaatggcaggtacccctcccccagcttcgctgccaccttgcagttcgatctcagactgctgtgctagcaatgagcaaggctccgtggacatgggaccctccgagccaggcgcgggatataatctcccggtgtgccatttgcttaagaccattggaaaagtgcagtatcagggtgggagtgacccgattttccagtgtcatctgtcacagcttcccttggctaggaaaggggatttcctgaccccttgagcttcccaggtgaagcgatgcctcaccctacttcagctcacgcttggtgggctgcacccactgtcctgcatccactgtctgacaatccccagtgagatgaacctggtacctcagttggaaatgcagaaatcacctgtcttctgcgtcgctcaggctgggagctatagactggagctgctcctatttggccatcttggaaccattgaggatcaaaataaaattgataagatacacagaagactggttaactttctgtatgacaatgaagccatataacttaagggaaactgaagttatatggcttcattggaaacttggatgtaaatctttgaatttaatttagatatcatcaagatctttatcatcatcttgagtatcataagatactggattttatcatctctaggaccaagtatattggttttattgattttagcagattctagaaacttgccatatgcctttagacttctagcttcatgtgcatggtattttaaaataacatcagatttgttatcctaatagtctcacagaccaaccagtataatgtctgaggtatttattcacttcttttttctcaattttcctctcatatgacataacctctttacaccatcaaagcacattgattctaatcatctgttttccttcattttgattacctactcttgtctatcccctttatataccaactctcctttttggggttcttatttttactcctgcctctatttttctttttctttttctttttttttgacacagagtttcactcttgttgcccaggctggagtgcagtggcacaattttggttcaccgcaacctctacctcatgggttcaagcgattctcctgcctcaccctctggaagagctgggattacaggtgcatgccaccacaccctgctaatagtttttatttttagtagagacggggtttcaccatgttagtcaggcttgtttcgaactgccgacatcaggtgatccatccatcttggccttccaaagtgctgggattacaggcgtgagccaccacgcccggcctcctgcatctgtttttacctcccttaccttactcttgggcatggcagcaatggcagccttacggtgtcctggactcctctctggtggttgtgttggctgtggtggctgctattttgaggggtgtgcatgaatatgtagtcccaggaggcttggtcacttagcgggggatgttttgcaaccaaggtctttagaggcatgctcagtggcagcaaatctttaacttcttttttcatcttttgttttttgtgctaacatttttaaggttttctagggcagtctagagtaacatttactcttgtgcattcttaccctcatttctaagatggacctctattgagtgactctctgttggatgtcccaaggattcattgaggactctgtcttgcctgtgagaacttaaatgattcctggccctttgtgagctctggaaattactcagcactaactacatcataatttttctttcctggaaattggttttgctctgtatcattggtttttaccctatgcacatgtagattagtattgatattcaggtaatttaaggatatcctttttttaaagaaaataggtctttctgtaactctctcacttcaggaactttcccccaaaattcttgttgtgttggcctttctgtattatgacctcttgtgttttttaactcagcaatggcactagattctattagggtttcacctcctacatactacagtcccaaaagtgctttcagagagaaatctcaggcaattatagggctcacctttttgtttgtttgtttcccttattacagaaatcagttttgagctgattttcaatgtcagatcatcagttgtgcaatgtcatatacattgtttgtccagttttctagttgtttacatttggagggtaattctcgatcctattactgctgcatgggtgaaggtagaggtctcctaatacttttaaaattgagaaaatccttagcaagtgatatgtctcacccatttcaaagtgagttcaaatgctattatatgtaaaatttcatttttaaatgttatttaaattaattttagtaacaacatttgtgttattctttcatacatagctgttaagtaaagcctgctttggctgcttttcatctaatattagttaccagtcaactgatgcgttaaattaaagttgatataactctaatgatttataagagttgaatctttttagtactttaatgccctactgaagatcactgcctgttttatggtgctcttgcgtgtatgctcttacgttctctctctcgctctttctctctctctctctctccctccctccccctctcttcctctctccatctctccccagaatttgatgtaacaacaccaaaaacctcatgactttaccatattttactgtatctcaacagatagaatataagaccaatttttttattggtaaaaagtatgggaactttttaccaataaaaaaattggtcttatattctatctgttgagatatagtaaaatatggtgtttaagtttactacttcttactctttcaaattccttcaagtagcttaaaagcattggaaattgtaagcagaatgctaatgtaaattggtgggaagtaattgggaatgtctcattaaatatgacattaaaaaaaggacgtttaaaaatttttttcgaaaggatatgaggtactcacgaaagatttaaattaatggctcttatgcttatgattgagtcatttggtgacattagcttcattctttattatttagtgcttacaatatttgagttcctgtactaggtgtgaagtgtaccatatctgattattatatgtctatgctattcttagaagaggaacttgaaaatcttaggggagtgtttgaagatgagccagttaattagcattgtgatttaggtgttgtgtgcccagggcatcagaattgtacattgtgagtcttaaaaaaaaatgaggaaatgtagagccataatttggatacctctgaagagatgagggtcagggttgtaattttaggtgagaaaactacaaatgcattaattctgacaaatggccacaaaatttgatttcattaccttttactatttttgaactattagtttaggttcagaggtatctgtacaggtttgttatatacgtaaacttgtgttatggggggtttgacatacagattatttcatcacccaggtactaagcctagtacccaatagttatgttttctgttcctctccctgcttccactctccaccctctggtaggctccattgtctattgttcctttcgttgtgtttatgtgttctcatcatttagctcccacttataagtgagaacatgtggtatttggttttctgttcctgcattagtttgctaaggataatggcctctacttctatccatgttactgcaaagtacatgatctcatttttttttatgactgcatagtgttctgttgtgtatatgtaccacattttctttatccagtctacccttgataggcatttaggttgatttcatgtctttgctattgcaaatagtgcttctgtgaacgtaggcatgcatgtgtctttatgatagaatgatttatgttcttttggttatatacccagtaatgggattcctggatcgaatggtagttcaatttttagctctttgagaaatggccacactgctttccacagtggttgaactaattttacactcccaccaacagtgtgtaagcattctctttcctctgcaaccttgccagcatctgattttttttactttttaataatagccattctgactaatgtgagatggtatatcattgtggttttgatttgcatttctttaatgattagtgatgttgagtgttgatcaatgttgggctttttttcatatacttgttggctgtatatatgtcttctttggaaaagtgatcacatcctttacccactttttaatgtgtttatttttttcttgtgaatttgcttaagttccttatagatgttggaaattagacctttgtcagattcatagacctttacagttgcaaaattttctgtcattctgtaggttgtttgttttctctgtcgatagtttcttttgctgtagagaagctctttagtttaatgagatcccatttgtcagtttttgcttttgttgcagttgctttttgtgtctttgtcatgaaatctttcccaggtcctatgttcagaatggtattgcctacgttgtattccaggctttttcatagttttgggttttaagtctttaatccgtcttgagttgatttttgtatgtagtctaagaatgtgtccagtttcaatcttctgcatacggctagccggttatcccagcatcattttattgaataggaaatcctttctccattgcttgtttttgtaggctttgttgaagatcagatggttgtagatatgcagtcttatttctgggctctttgttctgttccattggtctgtgtgtctgtgttttttgttttgttttgtttgtttaccagtaccatgctgttttggttactatagtcgcatgatatagttggaagttgggtagcatgatgcctcctgcattgttctttttgcttaggattaccttggctatttgggctgttttttggtttcatatgaattttaaaatagtttctctaattctgtaaaatgtcgttcgtagtttgataggaatagcattgaatttgtaaattgctctgggcagtatggcaattttaattttaatgacattgatttttcctgtccacgatcatggagtgttttcccatttgtgtcatctcttgatttctttgagcagtgttttgtaattctcattgtaaagatctttcacctctgtggttagcagtattcctaggtattttattctttttgtggcagttgcgaatgggactgttttcctaatttggctcttggcttggctgttgttgctgtataggaatggtagtgatttttgtacatttaatttgtattgtgaaactttgcttaagttgttcattagcttatggtgcttttgggctgagacattggggttttgtaggtatagaatcatgtcatctccaaacagtgatagtttgacttatgccctttatttttttttctcttgcctgattgctcttgaaaggacttccaatactatgttgaatagtaattggtgagagagggcatctttgtcttgtgccagtgttcagcttttgcccattcagtgtgatgttggctgtgggtttgtcataaatggcttttattattttgatgtatgttccttcaatacctagttcattgagagtttttaacatgaagggatggtgacttttgccgaaagtcttttctgtatgtattgagatgatcatgtggtttttgtctgtagttatagttgtgtgatgaatcatacttattgatttgcataagttgaaccaaccttgcatcccagggataagccctacttgatcatggtgaattagcttttcaatatgcttccggatttgtttcgctagtattttgttgaagatttttgcatcagtgttcatcaaggatattgacttgaagttttcttctcttttttttccttgagaaacaaaggtactttttttttgtctttgttttttgagccagggtctcactttgtcacccagcctggagtacagtgtgcaaacatgactcactgcagccttaacctcccagactcaagtgatcttcccacttcaacctcctgaatagctgagactataggcatgtgctaccatgcctggctaatttttattttattttattttttattttattttatttttagagatggagtttcaccatgtcgcccaggctggagttctctttctttgttgtatgtcttccaagttttagtatcatcatgatgctggccttatagaatcatttagggaggattcccttaccctcaatttttttgtaatagttttagtaggtatggtactagctcttctttgtacatctggtagaattaggctgttaatctgtctggttcagggctgtttttcttttttttttttttttggttggtaggctatttattactgattaaattttggagctcattattggtctgttcagggattcagtttcttcctggttcagtcatgggagggtgtatgtgttcaggaatttatccatttttttctagactttctagtttttgtgcctaaaggtgttcataattgtctggttatttgtatttctgtccaatctgtaataatatccccctttgttgtttttgattgtgtttatttggatcttctctttttttctttattagtctagctagtggtctatgaatcttgttaattttttcaaaaaacaaactcctgacttcattgatcttttggatgattttttgtgtgtgtgtttcagtctccttcagttcagctctgattttggttattctgctagctttgggattgatttgctcttgcatctctagttcttttagttgtgatattaggttgttaaattgagatctaatatatatgtatatatgttatatatacatatgtatataaatgctattttttaattttattttttattttttattttattttattttttttgagacagtctcgctctgttgcccaggctggaatgctatggcacgatcttggcccattgcagcctctgcctcccaggttcaagcgattctcatgcctcagcgtcatgagtagctaggattactgacgtacaccaccaagcccagccaattttttatatttttagtagagacggggtttcacaatgttggccagtctgatctcgaactcctggcctcaagtgatctgcctgccttggcctcccaaagtgctgggattacaggtgtgaggcactgtgcccagctctttctaactttttgatgagagtgtttagtgctatacatttctcccataacactgccttagctgtgtcccagagatgctgggtatgttgtatctttgttctcactaatgttaaagaacttctttggtttctgccttactcagaagtcattcagcagcaggttgttttatttccatgtaattatatggttgtgagtgattttcttagtcccaacttctatttttattatgctgtgttccgagagagtagttggtatgatttccgctcttttgcatttgctgagaattgttttttgtctgactgtgtggtcagttttagagtatgtgccatgtgcagatgagaagaatgtatattcttttgttttggggtagagttctatagatgtccatttggatctatttggcccagtgttgagttcagttcctaaatatctttgttaattttttatctcaatgatctgtctaatactgttggtgaggtgttgaagactcccactgttattgtgtgggagtctaagtctctttgaaggttcctaggaacttgatttatgaatctggatactcctgtgttgggtgcatatatatttaggatagttaggtcttcttgttgaattaaaccttttaccattatgtcatgcccttttttgtctgttttgatctttgttggcttaaaatctgtttttttctgctttccatttgcttggtagatttttctccatctctttattttttagcctacgggtgtcattgcacgtgagatgtgtctcttgaagacagcataccattgagttgtgcttctttatttagcttgccattctgtgccttttaattgggggcatttagaccatttacattcaaggctagtatggatatgtgtggatttgatcttgttattgtgttgttagctttttattatacctacttgtttgtgtggttgctttatagtgtcacttggtctgtgtacttcagtgtgtttttgtagtggttgctaatggtctttcctttccatatttagtgcttctttaaggggctcttgtaaggcaagtctggtggtaatgaattccctcagcatttgcttgtctgaaaaggatcttatttctccttcacttatgaagtttagtttggccagttatgaagttcttggttggaatatcatttcttcaagatattgaatatagacccccaatctcttctgacttatgaggtttcttctgagaggtctgttgttagtctgttgggcttccttttgtaggtggcctgttctatctctctagctgcctttaacatgttttctttcatttcagcctcatagaatctgatgattatgtatcttgggcataatcttcttgtaaagtattttgcaggggttctctgcatttcctgtgaatgttggcctctctctataggttcagaaagttctcatgatggtatcctgaaaagtgttttccaggttgcttccagtctccccatttctttcaaggatgccgatgagttgtagatttggtctctttacataatcccatatttcctggaggttttgctattcccttttgttcttcatcttcttcttcttttttttttttttttgctgactgtcttatttcagaaagccagtcttcaagttctatgattttttttcctcagcttggtctgttttgctgttaatacttgagattcttatagaggttttttcagctctatcagatcaattatgttttttctgtactggctattttgtctttcagctcttgtatcattttattgtgcttcttagcttgcttagattggcttttagtgttctcctgaatcttgatgctcttttttcttatccatattctgaattttatttgttgtttcagccatgtcagcccagttaagaacccttgctggagaactagtgtagtcattgggaggaaagaagacactctggttttttgagttgttggagtttttattattattactattattactatgattattattattattacttacatattttttttgacggaatcttgctctgttgcccaggatggagtgcagtggcgtgatctcagctcactgtaagctccgcctcccaggttcacgcctttctcctgtctcagcctcctgagtagctgggactacaggcacctgccaccacgcccggctaattttttgtatttttagtagagactgggtttcaccatgttagccaggatggtctcgatctcctgaccttgtgatccacccaccttggcctcccaaactgctggaattacaggcatgagccactgcacctggccgagttgttggagttcttgtgctggttctttctcatctttgtgggctaatgtttcttcagtctttgaagttgctgtcataagaatgggtgttttttcttttattctgtttgacgaccttggggctttgattgtggtataacatgggttctgtgaactgttgtgctggagtggccgaggtgccctcggactgctagtcacaacactttgataggtggtgccagccaaagcacttcatagggtgatggcaacgggatctatccttgttcgcatgtgccagcggcagtggcaatgtggcggggtgcatgttcattggctgtagcagggtgttagtgggtgctggcctccctgcaggcattcggagcagtgagttcaggtctgactctttagtcccctagggccaaagtctcctatgggagcaagtcgagcctagtgggttaggtgtccctggctgtgctccactacagatgctcccacaccaaaccctctgggctctatccttaccacttctcgaagcagctttccctgccaactcaagtgtccatggtgtttgaggggtctcctcctgctgggattccagaggcctgtggccagagtgggtcgctccttgcctgttcaactcaccctctccgctggagttgttggggaccaataatgagccttagtgtgtggtagctcctgaagggtttccagcttcctctctcttcacatcagcccctgttctttcagtgccttccctctgaagatctgctagaagtgtatcagtctccctgatgtcctggtccctcagttagagaggttcctcctggctgcatctggtcgaccatctatggctcctggagctgaggacatgaagcagtgaatacaggaccccaagctctggctggagtgagacaaagaccccaccatatccctggaagtcgctactgatatctttaaaaattgctgcttctaggccgggaatggtggctcacgcctgtaatcccagtagtttgggtggccgaggtaggtggattgcctgaggtcaggagttcgagaccagcctggccaacatgatgaaaccctgtctctactaaaaatacaaaagttaagtgggtgtggtggcatgcgcctgtaatcccagctactcaggaggctgaggcaggagaattgcttgaaccctggaggtggaggttggcagtgagccaagatcgcgccattgcactccagcttgggtgacagagcaagactctgtctcaaaaaacaaaacaaaacaaaacaaacacaaaaaaaacgctgcttctagataaatccattgagtttggtgtagcaaaaaattgttcccctttaattttctgctggccgatataaaatgaagacatttaattattcaagatcttttagatattagttgttactcatttgtgagaaaactcacatcgatacatggtagtcactacatacacttgccaaaactgcttttgtttttgttctattatggctaaaagagatgggtctacctgtagtgttacctaggcaatatggatgtacactgtatttcatcgtcctaaattgcttaccattgaaattcatatattatgtttgttactttggtagtgtgttcccttgtaactctgcccgtgaagagtaataatcccttggtcagccataccgtgtttctttgattcatttgaagttgagagcaagggcttcatcattaaataaatctttgctcttcctggttttgtgatcttaggcaaattaattaaccttttgtgttttacctgatattagcatagttcagtagttgagtggactctagagctagcttgtagggatttgaatcctggctctactacttaaaagtatgtacgactctgggcaagttactaaattttttgcttcttctttcttatctgtaaattaaggataatatgggtacttatttatgtactaatagagataatagagaatgtttattgagtgtttactatgtgccagatttaaacctgggtaaaaataacataatagggttgttgtgaggcctgaatgaataaaataagtaaaacactttgtacaggttcctagtacattttcagccaattatgtataaaatggggttgtgataattataatgaagcatatatgtctgtggaataagtatggatccaatatttgtggcagaaaaagaccacactgtgtaactccattgattggctaattggtggagacacacagaatgagtcccaacattcttttaggtaacttgtataaaacatattaacttttctctcccagatcatgtgcaagatatggtagatccaagaatcctatccaatgatacttcaaaattgtaaccttagtatacctgttgtgttaaaagtattgtttagaattggccacactcgacagatggccagggaagtaaaagcacttattggggatagctttgacaccagctgtattatattaaagatatgatataaaacttttctcaacatcagtagtgattctgaagctgtcagaaatagatagggagtcatgatgcccctaaagttcatttcccctttcctctatagtaatagaaccctgatttttgtttgtttgttttaactgggtacatggatgactagaagaaaagactatttcccagccatgtgattaaattctggcaaaaaagagatgaaagcagaagtattatgtgtgtacttctaaaagacagtggctcagctgggaaggcatacctttttaccattcagttttcttccactttattgaaagtgtaataactggagcattaacaatcattttgtaccatgaggcagtcttgaagatggaagccaggcatctagagtggtggaagagaaagctagaagcttgggtccctgaggactttgtgcaaccatcatctctacttcacctatctccagacttcttttacaaaagaaaaaaccaaatctcaatattgcttaagctattgctatgttgagatactctgtaatgttcagaattgtatccctataccaagaggaagaagtgtaaataatgaaacactgttgagatggaatggtttatgtacacaggagcatgtgttgtgtatggagagctggagagtagcataaataactaacgaagtgagaagattgtagatctactttaatcatgctagtgaaactggaatattgtattaaaggaaaatgtgaaactttggaaaaaaggaaatatgtaataattcaatgacatttgtacaactagttatcaggtcacattttgatggatattggggatggttaagaaagctaggcggcacagatcactctggtctttggaatatagattaatggtttttcatatgattctttgttatgccattgttaaatgaagtgtttataaccttatttttttctggtaaatcatattttattaatgagacttcaagtgtcttatctcaaaatgttggattggtaaatttgaaaaaaatgttagaaaacattagctatttcctgagggagaggttgagcctttacaacaaatgttgatattcttttacttgttaatataaagatgcgtaattgtcagggttgtctagagaaacagtaccaatagggtataaataaatagatacataagaggagatttatcatgggattatagtcattcaagatgtcccaccatatgccatctgcaggctggagaacaggaaagccagtggtgtgaattagtccaagctcaaaggccagaaaaccaggggaacccaaggtctaagtctcagttcaaggtggaaggccttcggaggggattgctgctgctggataagtcttggagtctgaaggcccaacaattagtagctctggtatttgagagcaggaggtgaaagtaccagctcaagaagagagtgagaattcacccatcctcaacctttttgtttaattcaggtggtcctcaaaggactgaatgatgcctgctcacattggtgagggcacatgttctttattcagtctactaattcaaatgctaatctcttctgggaacaccctcactgacacacccagaaatgatgttttaccagtgatctgggtatcccttaacccagtcacgttgacataaaaaattaaccattataagatattttggttttcattcacaaatcataaaaaatatttgtggttttcactcacgaatataaaaataattgtggggttgcctgtccttgtgttaaaagtatacatagaggagattttctagttttctcttgcaattcttaaagccagcatgttcttaataatagaaaaaagctgccattgattctggttctgctacttactggctttatgaccttggggaagttatttaaattcagcgtaccttaattttcttcactgtaaaatggggataataatacctacctacgtcgtaagggtattgagaggattaaatattatgatatctgtgaagcaattagtaaagggccttgcattcaggaaacactatataaatgtaatcgttattattatacttaatgagagaccagcgtaataggaattatgacggtcattttaaagacaaagtaatgcaggttcggatatgtcctgcttgattctttactgtcccatttctatattagcggtgccaggatttagaccttgttctgtctaaccttagagcctgtactttccaagatcttataccatcatccaacattatcagatccctctgtgtcctaactgttcacctaacatattatgtgtatttgtctttagcatatcaaactgagccatagtatcccacaatggttgtaccataatttatttgtttcccttattttgtgagatatatactctatgccactaatctggcctatgtgttagtgaattgaataccagccagtgataccattatgatattcttcatacatgcagtagtaaagattagcctttaaagggctttcatgtctcttgtatgaagagtgcatgtttactgcacttttgaatccctactattctgtagaaacagttttgaatgtgtttgaatttgcacctttgaatctattgttctttagaaactgttccctggaaagattgttaatgtttattcattatttgtgttgtatatgactaggaattttttatttttttttgagacggagttttgctcttgttgcccaggctggagtgcaatggcgcgatattggctcactgcaacctccgcttcctgggttcaagcgattatccagcctcagcctcctgagtagctggggttacaggcatgcgccaccatgcctggctaattttgtatttttagtagagatggggtttcaccatgttggtcaggctggtctcaaacccctgacctcaggtgatctgcccgcctcgacctcccaaagtgctgggattacaggcgtgagccaccgcgcctggccatgactaggaattttttttgcaatccatttatctctccttataactattaaatgttgtgtttaaggaccctgcagcttatcaagagttgatttgaatgcaagttatttcttcgaaattacatttggacctatttctgaacatctgcttttgacattttatgcacgtaaatataaatgagtaaacatatgaaaatgactttgaatcttagttctaattcttataaggcctgatttaatttttattttgcttgggattttgaatataggtattaaataaatataaatttggataatatgtatgggcttattcaacaaatactaataaagagcttgctctgttttaggtgctatgtatacttttagctcttgctctactgatacataccttttagtataggaaatagataaataagccaatttgtgttataatagagaataatggaagagggtgagtgtttttttaaaaaaaacatagagtgttgtatgtagcattcttgtagggtattgtagtcattctttcgttctttcttgtttttagggtcccagttttgttttggagcctaccctcagggataaattctgattagtctaagctggtaatgggaatctattccatttgtcagtgattgagtttacaagggacagatgactcaatcttggctaggaagatgtgcaggtcttcaggggagatgactgtcagtggtttcctctctcttaaaattaagagacagattcccagttgttcttttgcacataattgcatatggctggaattgaggcagctaacttgctaccaggaagaaagttagctagaggacaaaaacagatatgctaaggtagaatagaaagatgaaaagggatttttcacagtttcattgaaccccattgaattagcttttttgctgttgagaaactaaaattttcttatttttaaagtcaccttgagttgcaatttctcttgtatcctaatgtgtcgtaattgatactagttgtcaggggctgttttttggaaaagaagtataatataagtagagatctgaattataagaatgagccaaaggtggaaggaatagcaagaacaaaggctgcatgttgggtaagaacttggcatattccagaaactggcagaaggctgatctacttggtttctaagcaagggaaagataataactaatatttatagattgttttactgtgtacaaatcacttttatgcatattatcataatcttcacaattatgtgagtttctacgattatgactcctactttatagcagggtaaactgtccatatgtgattgatttgaaatggttgctctttctaatattaacacatcatggtgccaatcaagtatatattatttatgtgcacacacacacacaattggagaaaatggtgatatatatacacatttcatttgaatttactagtattaccatttttcagcagtattaatttatttagggctgaaggtacagatggcaagtccagatttctagacccatttgagtagttaattgtatcagtaaacacagcctggtgtgttattgtgtgtaattgttaaggtgagtgagatattcttgataagaaccttataaatgtgattatgtgtttgtactttataactaggaagattaatttctaagatattggctgatttcagtgaattagtattttgtattcatgtatttatgatgctggcattttaaattcatatgtatatactatgacactactgataagaaatatgaagtatgatagatgagtataagtaatgaatgaaaatcaaattttataatcttggtaggatttatatgaaaattttcttttctctgtcctgctctgccctcttttcctccctgtcttaccctcttcttctctcttttcatcctctcctcttccttcccctcctctcctctttcttcccctccctttcccccacctctctttttcgttgtcttcatttcagtttagttggttttaccaaatgcttttacataaagtaaaagtttatttcagctagcattaaaggacccttttaatttataatactatttttacttgttcctttctacttctttcttacattaataaacacattatttgtaaattacccttttcccgtatagggagcaaagcaataaaaaagattttaataaattctgtaacaatatttagttaaaaaatgaattgcgatcaaaggagaagatatttaaaaaatagagtcttgggcacatattaatcctgaataggattggattatgtatgtactatatatggctcttaaaatgtttgtacattataattgataattagcttttctttaaaagttttatttataattctctttatcaacttgaaaaatttttgttttctagtagattgttaatgaagaaaatgagtgtgaaatatgtcatgctcaatctgttaccttgtaacagtcattcgttaaatttgctaaataaatgacttcacttttctgttaaatttttcagtttattctattatgttgaattacttcaagaaacactttgtaataatgattttggtttttactcttttcagttgttaaaaaagtaaattgataactcttataactgcagtgtatattttaatttaggaaatcactattatttgaataatttatgatgattccttttattctgagaaaaggttaggttagtaagaatgttcagtacaatttctctggtttgttaattatattactagttatttaagttgattcttattgtctgaaatttgtgaaaaatatagttttcactttaacatttggaaagtttattacatctatataataaatgctgttgaaatttttttcattaaaagtaagaatgtactaggtgatgatttgctgaaaaaatctgtctcattgaaacttaaatgcaaggacataatttaggcatttaatgaaataacaactttcaattattgacattttcaattatagtcacaaaataggggtaatttaaactttctcttaaaatttttgtcaaccttattggaacataatttacatcagtgaacccatattaagtatacagttagatgatatttcttaaatctatatcctcatgtaactgtcatttcctttcttaatcagtcatcttcgtacttgctggcaagtactagtctgatttccatcactatctgttagtttctttgttgtagaacttcataattttatgaatttaagtttttaagtcattaggctattcaagtaatctattctttattgagcttcagtagtttgtttcttttagggaatctgtccatttcaggtatgacttcatatttattggccgaaaatagagtcatacagtgtgtattttttttgtccctggcattttttgtcaggcatgtttttgagatttaaccatattgtgtatactggtagttgttgtttttttaaactgatgaacagttttccattgtatgaatgtgccataatttgtttatccattcacctgcttgaagatgcctggattgttccaaatctttggctgttgtaaataaataaagttactatgaatactcatgtactagtctttgtatggacatacatcttaagttcctttgtaaatacctgaatagaattgttgaggtatacggtaagtatatatttgcaagaaattgacaagctgtttatttttctttttccattttctagaactctttgtgtagaattgttgttatatctaccatgttatgtaaatggtagaattcgcacataaagcaatatgggcctagagttttcttcatgggaagatttacaaatacgcattcaacttccttaagctttaagtttttaagtcattaggctattcaagtaatctattctttattgagcttcagtagtttgtttcttttaggaaatctgtccatttcaggtatgacttcgtatttattgaccgaaaattatttgtaatattttcttattactcttttgtagtatctctagtaatactacagatagtgcctcttacattcctaatattagcagcttatgttcttttttttttcagcttgtgtccttatgcccttgattagtccaactggaagatttttaattttattgatcacttcagggaacccattttttgttttcattgatttttctttgttgtttatcggttttatattacattcatagagcttacactgtgaaccttttacgtatttcaccaaactttcaaatacttttatacctcttgaggtataatatagggactttaaaacagtgtccttccttttttctgcttgctatgttttgtgtaagtattgtcatatattttactattgtgtgtgttgtaaaccccataatactttgttattattttagctttgagtcaaatttattttgaaagaaattagaaatgaggagggggcagggtggaaaaaagagaaattagaaatgagaaaaaattttatttgtatttacccatatatttaacatgtctgtttaaatccatcatttacattcaagtttctatccacaatcatttctttcagcctgaaaagtatccttttaaatatatcttgtagtatgtatcagctggcaacaagttctttccatttttttgttttccaaaaatatacttattttgcatttattttttaaaagctttttgtttcagaataattttagaattatagaaaattagcaaagagagtacagtcactgtatactctttgcccatgttcccctaatgttaacatcttacgtagccatggtacattcatctaaactaataaattaacagtagtgaaatactctaaactacagactacatttggatttcagcagtttttccatggtgtccctgccctgttccaagattcaattcaggataccacagtatatttagtcattatgtctccttagacttctctaatctatggcaatttctcagttgtttgtttttatgactttaatagttcaatacttttgaagagtactggttaggtattttgttgaatgtccccagatgaggatttgtctgatattttcttttattattagactggattcatggttttagaggatgagtactacagaattgatgggtccttttttagtatcatttagaatagtttcatcatataagttactcttgaagggactttataatcatcccctccttgtactttcaactcttgggaaccactgaactatttttcaacctatagtttttccctttctgtaatgtcatgtaaatgaagcacacaatatgtagtctttggttttgtcttccttcacttagcaacatacatttaagattcattttgttgagtaaatcaatggcttatttctttttattactaactagtattcctttgttttctatgtatcatgtttgttaatctgttcacctgttgaaggccatcttgattttttttttgcagttttttgtctgttatgaataaagctgctgcaaacatttgagattaattttttgtggaaaaatatgctttcatttttcttgggtggattaactttgaaacctcaaactaaaacttcttaaagaacccataggagaaaatatatgggactttgggtttagcattgaatttatagacatagtaccaaaaccacagtctataaaagaaaagaagtcagtatattgtattatatttaaaaaatttaaaaattttgctgtgtgcaagatactgttaaaagaataaaaagataagccacagactgggagaaaatatttgaaaatcatatatttgataaaagacttatgttcagaatatataaagaactcaagtctcagcagtaagaaaacaagcaatctaaaaaatgggcgaaagatctcaaaagatactttaccagagaagatatacggatacaaaataagcacatgaaaagatggccagatgttcagtgtcatttgttactagaaaagtacacattgcaaccacactttgataccactacacagctaccagaattgcctttaaacaaactgacaataccaaatgctagggagattgtggatcaacaggagttcttattcattgcttctgacaactcagaatggtgcagccactttggaatagagtttggcattttcttgtaaacatacatttttcatgtgacccagcaatcctactcctagctatttgacccaagttagctgaaagttcacattcacagaaaccttttatttttgaatatatttttactgaataacaaagtgtagttttgtcattttttttttttagcattttaaaaagatgttgtcccattgtcttactagattgtatttttttctgattagaagccccctgcatttctttgttaccatgtatggtttaccccccaatcttgtggctgttttaccctctaaattatggttttatttgtatttaaaaatagattggaaattctatatatacccatggttaaacatattttcaatgtacattacttcaaatttgatgataaattttgttctgagaagtccttttctgaagccaaactcaaaaatggggaagtgcttacagatttccaactggccccaaaacggatattgtaaatggctttttgcctaactaatgatgatggatgagtttcatttgccttttatcatttgaacggttttttgttcacaataatagttactgtaaggtgatgcagctgtggtgaagctgtaaaacactgtagtatctgacaataagtcctatcaacagtggctacctgtattagtctgtttttcattgctctgaaggaattcctgagactgggtactttataaagaaaagaggtttacacagtgaaaacctgtctctactaaaaacacaaaaaatcagttgggcatggtggcgcgtgcctgtagtcccagctacttgggaggctgaggcaggagaatcgcttgaacccaggagttggaggttgcagtgagccgagatctcgccactgcactccagcctgggtgacagagcgagactctgtctaaaaacaaaacaaaacaaaacaaaaaagtttacttggttcccagctttgcagtctgtaggagaagcataatgccagcatctgcttctgggtgagagcctcaggaaacttcctctcatggtagaaggcaaagggggagccagcgtatcacatggtgagaaggggtgcaagagagagaagggaggagataccaggctctttttaacaagatcattgtgtgttctgatgaacccatcataagttgaaagtatcatgagtcgcaatatgtttaatacacctaatctgaacatcatagcttagcctaccttaaatgtgcccagaacacttatattagcctacagttggacaaaatcatttaacacaaaactattttgtaatgaagtgttgaatattttgtaatttattgaatactttactgaaagtgaagaacaaaatggttgtagggttactcagagtggtttctactgaatatatattgcttttataccatcataaagttgaaaaattgttaagttgagccattgttaatttgaggaccatctatatgatattttttgttctacaagttatacatttttattgtagttttcttttttcaacattttcattttttcttttaaatcctagcacatatttcgatacttgtttcagcgctcttgtctgctgtcatcattgtcatttctgttttctggatctgtttaaatggactaattttctcctggttatgggttacattttccttcttgttggcatcatagtataaaatacatatttttggcaaagtaattaatactttattcaactgtacttctgttgatgggcaattacgttgtttttccagtttagtgctgttgcagacaatgatgtaaagagtatgtgaatgcattttgtttacatattaaaatgcatcttagcataaatttttgcatgtggaatttcttgtcaaagggcatgtgtatgtaaatatttgatatataatgccgtattaccctttgcatagggtacacatatttttattatttaaataagtgctgaattatttttgagtttaaaaggcaaccctcctttgacatggctcatagcacaacaggccaggcttttatcttcagcagattgtcgcatactcatcttctggcctcagcatcaaagtcaagctgcttgaatatgattcttggaaacatccttttcacacagtcatatgccaaatgtggccattgttcattttcttgttagacttaagaagtgtcagtttgatcgtattataaatggtactgcattttttgttatgtctaatggaataattgagctatatctatctttaggaaatgtaggagggggaaatgaggaattattagtcaaagggtacagagttttggttataaagataagtctcagaaatcttttgtacagcgtggtgcctatagttaacaatactgtattgtatggttaaaaatttcctaagaggatagatcttacgtaaagtattcttactacaaacacacaaattagtgatagtaaataagagagtgggagaaaactgttgcagatgatgaataggtttatggcatagattgtggtgatgagttcacaggtgtctactttgcaaactcatcaagttgtatatattatgtatagctttttgtatgtaaaacatgtttaaaagaatgttgaattttaaaaaagaaaaagacaacacatcctagcctgcttatatttttggggagttatgatgatggtaatggtcacaacaatgacaacacagttatcgtaatcattgtaaatttaatagagacttcgttctacttctgaaaatttttttcagtatggttggatcttacaaaggtgctaaatgtttgtgataaaatagcttagtttcagctctgcggtaaaatcttgacataatgatcatctgtttatatatataattttaaacattgtgtaatacataaggattttgaagattgcaacaataaattaccatgttttattctgacactgtacatatattttgattttcaaattatagtattataactgtggtatgcaggtggcagtgttcaattttatgcttaaaaataaaatgatagcaaaaaatgcaattatttgtggaatagtttatattcagtttctgttgagtcactcagaatgttagttgctgtaagaagaggctttttttcttttttggttgtttgttttagtggcattacttcactttgcaattagaacccactgtaatattacctattgaaggcagggatttgtgtctgtcttgttcactgctgcatcctcaatgcctgggatatgtaatgtattttatgtaatagaaattgaatgattagtttttgaacatatgagtgaatggatcatagtgttgtatagatttaggtagatttcttccagttgctttccattataaatgttgataagaaccatgctgcatatttaaaaaataaaatttacataacatgaatgactgcactaaatgaagtatattatttaggaggtcagttacttactgctgacatagtagaggatgcttccgaagtgatcatcctgaagaatggagactgcagctcattgtcatttcttttattaatacttcaaatgtgctcccttctctactgcagctgtgaaactttttctggtcttctcaagaactttctcttctctgttttttctctaatgaattatactttcattttttaattccattttatcttcaccactggctttttctttgctatacctttttattttatttaataaaaactacttgttgctctgggggaatgccatctgatgttggaaatgctctgtatctacaccattcgtaatggtaaccactagacacaggtagctattgagcaatcaaaatgtggcctactgtgcctgaggaaatacgttctttttttcccccagacagggtcttgctctgtcacccatcctggagtagaatggtgtgatcacggctctctgcagcctcaacctccagggctcaagtgatcctcccacctcagcctcccaaggagctgggactataggcgtgcaccaccagttttaatttatttatagagacagggtctcactatgttgctcaggctggggaaataaatttttaattttaattctaatttaaatagttgcatgtagctattaaagcagtgtagctctggatctttatatatatgtatatgtatatataaaattattagtctactttcaaataatatagcagttcatgtgtagtgagacaacttgacttttgtgcacttccatttcctccgtctcatcttttaaatattctgtcatatgttttacatctacatatattataaacccagtgatacattattgccatttttgagtttaacagctttttatcttttaatgtggttaaattaagggaaaatagctctgattttttagatttcatcatttctggtgctatttttgtgtgtgcagatctgcatttttatctggtatcatactcctccttgaaaaatttcatttaacattttttatagtacaattttgccggcacagaatattttttaactttttttttctggaagagttttgattttgcctttatttgcctttgttttgccttcattttatccagtgaaaggtattatctagaatgctcagttgccgtttttccccccttggtattttaaagatgatgctccattgttttttgactggccttctttattacatgtagtgtgttctcatttttttttctctgtatgtaatatttcttttttcctagttacctgaaagatttttctctttcagtttgttttttagcagctttttgtctacattttaattttgccctactagcaattctctgcatttctttgacctgtggtgttttatcatttttttactttggaaaattcccagctaacatctctttaaatgtattttcttctctgttcttgttttcttcacattattaaactccagttacacctgcactagatcattggatattatactacagctttaaaattcctattctgttttttaaaaatttcaatctgtttcttctctttgcgtttcattttgaataatatctatttacctctcttcaagctcactgagtttttagctttgtctaatcttctgataattctgttgaagattttctgatatagtccatttagcatttcttctttgccgaatcccttatctgtttttgtattttgttcatatttaccatgagatcctttaatatatcaattacaattattctcttttctgtctgatagttcaaatatctgattcatttagaagtctggttttggtgtttgctttgtcttttgactatggtttgggttttttttttaactatatatctatatatatattatatatatatatttatatctatagatctatatctcatggtttttttgttgcatgccagacattttaggtaaaaggcaacaaagattgaggtgaatagtatttatgcccagaaacgggtacccttcttctttgatgatgttggtgtatatgtggattgggatggggcagagattgagtcagtccaacagtggtttgagttggatttgtttttttgttgtgattgtaatagttaaattcactgaatcagaaacttgaaattcctgcagtagtggactgcttgctgcttcttcattcttggtttggagcctcggtgctggagtctttcctctgtgttccagctccatccttagcttttagcaggtctttggatgcctgcatcacagcatgacctctgttcatattctttgtaacttttgataaaatgcaccttctagttttgattgtctgtattttcttatctttctttgaagattgttgagttttattttgacaggcagataatttacttttggattacactgatccttttgtagcttgtttttaagctttgttagggctcttgttggcatagcttttattctataactggagtcagtagactttggtttatgagccaaatctggtccacagcccatttttgtatagctcatgagctaagaatggatttttcatttttaaagggttataaagaaacaaaaataaaaattaagaagtatatgtgacagtgactatatatgcctcacatagcctaagatatttatcttgccctttacagaaaacattttctgatcctgcttgcttaattttaatttctaaggtgttttatttcttggatttttaccgaatgctgcaggttttctctgtggtatttttattgtacctggttggaactcacaggtctgtcaactttgcctaatctttgagatgtgttcagcttttagctacccagtatttaatttttctatttctgataattgtcctttgcaagcctcatgagttcttactataacttagtttcctgccaaagacttaaaggatctcctatgcaaattttggagctttctgagtatctacctcctctttagtataatgacctgcaaattccacctaccttaaattccctgaactttggtctttgtcttctcacctgaggaagatggctgtgttttgtttgggttcttcctttctgtgctggtgttcagcaaatgcttctaggcagaaggctaaagtgatcatagggcttacttttattgttaattttctctcagacattacagtcttctttgacctttgcccaatatctgaaaacagtttttctaaatatgttttttaaagttttctagtttatatgtgaggctaatctagtagttattctttcatggttggagatggaactctgtttagcagctattaataaatgtgcttttttacctctggtattagtataaaaccaataattgtaattgtatctgttaaatctcttatttgctgtaaattgagttttgttttatggtatgtataagaggtattagcagaatacataaggaaatgtgattaagactcagttctgtcctgcaacttgaatgcctattctgtgcccagggctttctataacttgctagagacagaaaataacacatgaagtgaagatcaggcttttaacctactagaggaggtagtcatatgtattaattatttattgctatgtaacacattacctttagactaagtggtttaaagcaacaatttattatctgttggtcagaatttagggatggtttagctggatcctctggctaagctccatctcctaggtgagggtctttaaaaagcctgcattcaagatgtggaccaaagctacagctgtcttgaggcttgactggtgatggtgcatttctaagcttgctcacgttcactggtcattggcgggattcaacaaccttgtgaggtgcttgtggtcttaggactgagcactttaaatcttcgttggctgttgtctgaaggctgccctcagctcctttccacatgggcctctcagcatgatggctgacagtatggtagcttgtatcatcagaataagcaagcagggacaatgtgagcaagacacagaagctccagtcttttgtaaccttatcttggaaatgaaattctgtcacttttactgtattctatttaagaaacaagtcactaggtgcagccaacactcaagaggaggagatgatacaagggcatgaatagtggacgcagagatagttggcaaccattttagaagctgcctacaacagcatgtggcatattaattatataaagaattgtaaatgggtctataaaataatgtaacaacgtcaatatataccacataataatttgctgcatggtatgctgaggtgcctcaccactgatgattattttatttaagccttttccagtattctctgggagaggtggtatttattatctccagtttacagattgatgttcagtgaggttacctagctatgatgtagcagaactgagactccagtctagacactgctgattctagcacccatacttttaatttctatgtcttgtcagcattaaaataaaattactttttttggagcacttcttctgtgccaagcattatgataagtggtttatatatgttaaccttatttaaggctcgtggcaactctattaagtctccttatcttactgatattacactcgagcttccagattcagaaaaagtactttgaaaaatcaaatatgtttattgttccagagacattaaacaaatattacccaaagaatctctgtaaatactgaaagaaatgaatcatttaaataccttagtaccttaaaaaggtgatatcaatctagcctaggcaacatgccgagattttgtctctctctccccttttttttttttttgagacagagccttgctctgtcgcccaggctggagtgtggtgttgtgatctcggctcactgcaacctccaccttccaggttcaaggaattctctgcctcagcctcctaagtagctgggattataggcacccaccaccatgcctggctcatttttgtatttttagtagaggcgggggtttcaccatcttggccaggctggtcttgaactcctgaccttgtgatccacccgcctcagcctcccaaagtgctgggattacaggtgtgagtcactgtgcccagccaattttgtctcttaaaaaaaaaaaaagtgatatcactaattaaataaatttgcagaaagaatcctggcacatttcagtacatttagtatatttagtattttgcagaagggtactttgtgagtcttaagtagtaataaatttataaattcttgaaagcccactctgagaagaaatctcaacaaacactgctatataaattttagtcagaaattagctgatatatgtaatttttaaatatttttacgaatttgaactatttttactaatactttcacaaataagttgagtggttgtcatatcaaaggctgaacatactttcttcagttatatcgttgtctttgcaaagtgaatcttctaaatgaagaaaataagatacattattttttcatggttaaaaggtaaaccataagactctcttggctgggtgtggtggctcacatctgtaatccctacactttgggaggctgaggcaggtggatcacttgaggtcaggagttcaagaccagcctggccaacatggtgaaatcccatctctactaaaaatataaaaaatgagccgggcgccacagcagacacctgtagtctcagctactcgggaggctgagacaagagaatctcttgaaccctggaggtggaagttgtagtgagccgagattgtgccactgcactccagcctgggcaacagagcgagactcaaaaaaaaaaaaaaaaagactctcttggtcttttaggccaattaaatttaatcaatcaaggaatgtctttataagatatatgttgacaataataaatatgaaagtttattaatgactttatttttgaaccatttccttataatagcattctctcactttctgcattaccatttgctgtcttaagtagggcataaatgcagtttaagctgtatttattagtgccaactaagtgccaaataccgttctgagtgcctgggatacatcagtgaacacaatgaacaaaaattatggcgtttgtattttagcaagcatggttcagacaataaacagtaaccataagtaagtaagcaagcattcattgtagttagtagatagggaaaaaattctgtacttgttcttttaaaccttgcagaggaaaattgcatagaaaactatttgtttttcagcttaacttggttttcttgaccccaaaactggggatttaaaaaatactggcaaagacaaaaaaaatcatgggaaacattctctccaaaaacatagttcaaatgatgctattaattagaaaatgaccatgttttgctcttataaaaatgtattgctttttaaaactcaagtattatcaatattgatatataatatagtaatttaatctcttagatatttttggtaatggtttataaaaaatggaaagtattttttgttgtacaaattttgttattcaaaatgtatgtttctgtaaacttttgttactattcaagttatgctggctttaaatattacgatttttatggtaatcccaaggaaaatgtttcagcatgtctttttattatttaaattactcttttaaagaaagctacctttgctttggttgtttatctcagttgtctgttttctgcgttacttttgcagtgaagggaaagaaaaaaattgtaatatctgatatatagtttaccctctgtagctgtagttttagtattcttgattcagccaactacagatcaaaatatttgccaaaaaatacccccaaaattgactatctacatagcatttacgttgtattaggtgttataagtaatctagagatgatttaaagtatttgggaggatgtgtgtaggttatatgtaaatactatgccattttatgtaagaaacccgaacatctgtggattttggtgtccgtggagggtactgagagacaactgtatatcttaatagcttagaattaactaggatatagtacagtttcagcatataagtatagtaacattttacagtgttgcatatgttgtctcaaaattactgttaattgaaatattaatacttatattttttggctgacgtaccgaattgaatcaatttcttatgccatcagaatgaattcacttcttatttggttttaaagtcacagagccctggatttctgtattttttttacataagatgaaaagtaggggatacctgagtttagaggagtggggattgagaaagagttttaagaaagggacaggataaacaatggagtcagtaaaaagagtgttcttgatagatttaagaatagttattaaaacaacagacaactttttacttggattattcctttttaatttggttttcaaacagttctcagcaagtacaattcttttcattctatgttttagccagtgtaaatcagtaacattaaggtaaatgttgtaggagtaaatgggaaggaagtagagtgtttctaggacagccctttgattttcttctctttgaatattggtgttttaaaaacaattgagatttaaggtgcaaacatagaaaaatagtggccctgtgctctgatttttgaagcctcttctccatcttttctgctcatctttttaccactgtttgatttgtggtcaagtgcccctcacattcagtctcgtatacagaaactatttcttgttttttctctcttctcttgtatatggaactctgtctagacatatgatttctcttctatagctttaaaattatcaaaacatttttaaaattaaagaaaaaaaaatttttatagagatggggtttcaccatcttgccagattggtctcaaactctgggttcaagcaattctcccgccttgtctccttctaaagtgcagggattacagatgtgagtcactgtggctggcctgtcaaaaggttttaaattatatttttgcctacaaattctctcctggggagaaaatagttttgtttccaagggaattctaagcctaatgatggagaaatgacaaatgatacttgtaaccaagcctggaaaagaatgtgcatttgtagtttaagatgcacagtaactaagatgtaactggtgctagacgtttgttgcaattgttggtatttttataaatttgaggaagcagtagtctagcctgatccatttgaacctttgcttctgatatttggaatgactgccagctggttaatggctatgataacctttacttggctaatatgcatgtcagttttagaatttatcctaaaagtgacaatttgcctgtcacctgcagagttaagtggtataatggcagctgaacaatgagggaggagagtggagttgagaactggtagaaatgaaatcactcatacagggaacatgttttttcttgagataatgaacatatagcccaaaatatgtggttgagtacattttgtttttgattgattgttcaaagatataatttttaagtcttcatatataagttaatgtataattatgcaagaaggaaaagaaagtgatgatggcactttgaggactttcaggcttagagctaattagtctgttatctggtagagcactaatgtacatggctgatttaatatacagattaacagatttaaagcttttaccctttacttgttattaggcagttaggttatcttccaacttgttggccagtcaacaccaatgtgtttcctccaagaatctcagtatatgctattttatataccttaaataatttaaatacatttcttactctttccacagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacaacagaatgaagacttgaggcgaatggccgaatctctccggtaggtcctaaaatactgaatgaagaatgatgaaatattgtactttgtttttaggtgtagggcttcattccgctaggaaaaatagttaattatttttataacctgctgtctttgccacaacttagcatgacagttttctatctctgtgtatttaatacagaacaagcttgtccaacccacagcccatgggccacaggtgacccagaacagctttgaatggggcccagcacaaatttgtaaactttcttaaaacattctgagatttttttatttttttttaagctcatcagctatcattagtgttagtgtactttatatgtgccccaagacaatttttcttccagtgtggcccagggaaaccctgatataatttctccatagtggcatcattattttgcatatgcattttaatgtagaaaaactatgccatttcatttatatacttacatttcatttacagttatgtatttaaaaaaattgatatattaaatccaaactatgttttaaactcatgtatattaaaaattttatatgaactgtaacaaagattataataactgggaggctgagttagtctaactagaacttattaaaatgcagaaacaaaagtttatcattaaacaactggatctggaatgcggagaatgattatcattgctatttctagtctgtaaaaaatgtgacatatatctattagaaggcatcaactgtttgaaaaccaaagtctcctatatattttcagggagcaagtaaacataatattacataggcgatctctgtatttttttccaaagttattgaggtaaaacattacctagtatcttatatgcgaagatgatcatgtagtactcactctctcaaactagagaagctagaaatgaagatttgagaatccttactccagaggtggtaattgaccctaagggaagtggtatagagaaagagctgaaagttcatttctctttgagaaacacataaattaaggagtagaaagtggaaacatccaattgtacagaaagcctttagaatagttggggaagaatagtgggacagagctgttacggaaactgaggaacattctgtgaaggaagaatgtagttggcagtgttaaattacccttgatgctatagagaggatgcccatggtgctctcattttctactctcactgcccttcactctttgtttagaactcggatttttccctttgtctagtttcataactttttcttcataatattatttgggtccttttatgtcctttgaaagacaatgctacgtgttaagacaaaaatgaatgaaacattattcttgtcatttgtaccattcaagaagatagcaagcagtcagggattagaaagtggacagaacttcttgaatttgtctattattttctttcctacttggggtactcagggaacatcatggaggaaggtgatctttcagtagagtcttattcattcattctaaagattgataatttaggggttagtaataatagctgtcatttattacatgccaggtactgtgccaaggactttgcatggatcatctcactgaatttcacactatctttatgagatgttagtaccatttttgtaaccattttacagattaacaattatagagatgttaagtaatttaatttgctgaaggtcacacttttcacaagtggtagagcctactttgaatcccagtagtatgactccacaacctaaactctgaataactgtattgccttcctgagcagaaaacagagaaatcagtgacctaaacatcttaggtatgagatcaccaagaatagctactattctagttgattttggagtttgctttgattgtaatcaaatctccttctatatcatgggaattttgctcctaaaaagatttttccccttaacaatttagacttataaataattgctcactttccttatggttccatcttcaatactgatatttcaatttgtttatttctgactgccaaatgtcttgtttttgttgcatgaagggaaagcttgctttagtatgggtttttctttctgcaaaataatctttaggtctattaagtcactttctttatattcttatatgttgaaattaatttctcaactacatttaaatgtagagactactttcaagagctgaatcacctaagtcatgtggtaataccatgtaattacagtctgaaaacagactaagcaaataggcccatgtttatataagggaatataatttcaggaaaatagtttatagttattttccctcaacctcattgggccctttcattgactttactgctggggccatttgtatttcttccaaagggatgtcgttttagagccctctggcatgaaaggaagagcaatggaggtgctactagcattgggatttttttccccttatagtaattaagttaatattttgtactcaatttgctatgtctttttcatataagaaaatgtgttcacaagtcagactacaaaagattaattcagatgtttataactaggtcgtttctttgagataaggcatatggattggagttggaaagcaacacaaaagcttgaaactacaattttttagattttctagattcaagtcaataatctgaaaagccattaacaaatctttcggctagaattttctgattttgttgatagttttagaaatttaggaaaataatttaaatatcgtatcttggagggatgcaaatgtagaagcacaatatataggaggttgcagtgtatttgtgtaaatctgatctattgatgagtaatgtctgtacataaaattcacttcctttatcgtagatgtctgtgagttttggcaaatacagtcacgtaaccatcacaaaaactatagatgaattctacctccctctagaattctgttgttccctcttatggtcaaattctgtcctgacctcctgtccctggcacttaactgatctgatttctgtcacacttttttcctgtttcagaatgtcatataaattgaattacatagtatgtagccttttgagtctgtcttttttcacttactataatgtttttgagtttcatcaatactattgtctgtattagtagttcattcttttttattgctgagtagtatttttattctttttaaatgttgagtagtattccgttatattgatgtgtcttagcccatttagcattgctatcacagaatacctgacactggatagtttatagagaaagaagttatttggctcatgattctggtggccagaaagtccaagattgaacagctgcatctggtgagggcctgaggctgcttcaattcatggtgggaagtggaaggagagtaagcgtgtataaagagatcacatgataagagaggaagcaagacagaaaccgaggaagccagacttttttaaacaacctgctcttttggtaactattccattcccatgagaaggagaactcagtcatctctgaaggaggagcattaatttattcatgagggatctagctccataacccaaatacctcccactaggtcccacctgccaatactgccatgttggggatcaaatttcaacgtgagttttgatgaggacaaaccacatccaaatcatagcaagatatatcacttttttttttttaatccattcaccaattgaagaatgtgaggttatttccattttggggcagttgtgaacaaagtcactattaacctttgtttcataaacttttgtatgaccatagtttttatttctcttgggcaaatacctaggagtggaactgctgggtcatatgttaactgcatatttaactttataagaagcaacccagttctttttctagagtacctgtaccgttttgaaattcctaccagaaattcttgagagttctacttgctctcctcctacccagcatttgctattgtcagttatctttattttagtcattgtaacagatatataatactatctcattgaggtttcaatttatatttctgtaatgaatgatattggccatttttttaatgtgttgatttgccattcatatgtcatctttggtgaagtgtttattcatttcaccaaagaatctgttgtctattttaaaaaatcaaactgttttcttttaataagttctttgaaaaaattatttttaaaaaacatataaacacaaaattatatttattagtaatataaaatatggtataatataataaaaaacaaaaacatggtggcataaaacaatcatttatttgctcttgatttttccaatttgggttaacttcagctaggctttttttctaattataaatagggtcactcatgtggctgcagtcatctggtggcttggttatggttgggcagtccaagatgacctcacttacatatttggcaattaggtcgaccattaactggctcacttccatatttcttttctggaaggatagcccagatttcttacatggtagtgttccaagaggaaaatagcaggaattgcatggcctcttgagactgagcatcagaagtaacacagtgtcaattctgccacattctgttcattgcaagtcaagaggcctacccatattcaaaaatggaagaaatagatactgcatcttggttgatggaactacaaagaatgtgtaaccgcatttaacctaccgttctcaccacagaagggaagttgaatagattggattaggtcaaatcatggtgggcttatatagccagagttatgtatagacccgattgatagataatagagaacaatagttggttttcagcagaggaatgacacagtgaaaatggttgaggaagatttagattttcaggtggatttggtgcatgtgccagattggagttaagatatttcttgggaaactcttaaagtattaatctagataagaggtaatgcaacttacactgaaattaatgattgaatcagttgactttgatgcttaggttttcaacatgcctgtatttagagtttcccagacatctctttctttcttgttcattggtatcatgttagaacacatgtagtgggcctttaaaaaatttagaaattatcactttctcagtccttttatgcttcatgttcgttttgtttcaagtttaataatgtgaaatagctatttgctcacagaatttttgctccttgggacttgaaccagccatgttgcttcctagagttgaaatttaccagaaaacacccagaaaattgttggtttgtgcagaaatccccttgagcagtgaacctcaacctggttggatgtcaatctcatggagttgtaaaatctaaaaagtgcttaattgacaactttccttttaacctaatccttgttattctagggacatttatttttgagaacagaacttaaaaaaattcaaatgtggcttttggccttttggccgattaatagtttttttgtttatttgtttggtctaggaaaggagaagagatttcttctagaatttagatgctagctgtaaaactgtaaatttaaaaaccacaaagaatgtatgattaatttccgattacctgtttttctgagctgtgtgtcatctgccaatacgggttacagacaaagcacaaatcttctggtggaaaaatttgtcccaggcaacagaagtatactgagttgggtagaaaggaaactgaagtggttcttcacaggtcatgttttactgttgtttgagaagattgtgttaaaaagtgggttgcctttgttctagttggttggttggaagattttgctctagaccgtcttctctataactcctagtctctcatataagaagtgtacatatattcttaaagccagtgagatagattggaatgtgtacagcacctgccatctaattataacctttcatgatatctgccttttgctttttcaatcttgtatccattattcctcatgttatcaagaatatcttatttttaagatataatgaaagatactccttccctgagaacattacagtgggaacaacattcctatcctgataggcctgattaagcagatattctctccctggaatttcttgtaactttttaacattttactggattaaatttgctaacattttgttttggattttttctatataaatgagctgtttatttatgatttttccttcttgtgatgtctttcaggttatcaaggtttatgcaggccaattctgttctctggaaaagtttatgtaaagttgatattcattttcttttaaatattataattctaccagtgaagttatctgggcctggagtctttttgtggggaagggtggtggcgaggaaggagaacatatgggaagattttagattctggatttcatctctttaatataaattggactgttcagctctttttttttctcatgtcaattttggtgagacgtgtttttcaaagcatgtgttcattttatcagcatgttcaaatgttctagcttaaaattgttcttagtgccattttattttcttctccatacttgtatatctatagtaatgtctcctttttcattcttaatattggttgtgttttctccttttatcttgctaacagtttatcaatttaatttgctttttcaaagaaccaacctctgtgctttttttttctttattgtatatctgttttctattttattttcttttatgtcctggaaagccttaaatttctctctaagcacagctttcagttgtattccataagttttgatattctatttttgtcattaatttaaaatactttaaaatttgtattgtgattttttttttctatgacccataggttatttagtagttgttacttaatttccaaattgggctattctgtttatctttcagattttgatttctagtttgttcttcaaccagatagaattatattctatatttcagttctttgaaatttatttaatggcttagcaaatgacttatgttgttgaatgcttaagaaatgtgtattctgttgctgagtctgatctagtatatatgtcatttaagttaggttggttaattaagttattcagatttattaatttttataaacactcatattcttttataattggccacatattttttctttctagtgttctttactccttcctgttattcagttctttcatgttgaatcatgttcttcagccttaataatatcctatagtatttatagtgcaggtttgatagcaataaattcagattctcttttttaaaaactttatctttcattttgttagatatttctattgagtgtagaatttactttagcagtaatttttaaaagcatttaaaacatgtcatttcattgattcctgcctttcatagtctctgagaagtctgcaattttaagaagcgtatctttctctttggctgagtttacttttttttttgtctttggtgttaagcacttgactatgagtgcctagatatggctttatttgtttttattcagcttgaagttcactgagctgcttaaatctgggagttgatgtattttatcaattttggaaaaccctcagctactatttcttcaaatactgcttctgaagccattattttttatttttttccttatggaattccaattatatgtattattaaacttatttttatggtatctcacatggctttatgtgtctttcatgatctaatttctctttgcactttattttgtattattttctattgaactggcttccaacttatttcacctgtcttctgttttgttcattgtgccgttaatcacacacagttagtaattttttatattttttgattctagaatactcacttgattctttttgataatttcaaatttctttggaaattctccatttttcatctgtcttgtccatgtttcttttaatttcttaaatagttattctaatataactattatattttctcctaatttctatttcatggatcaccttttggttgatttcttttgatatttattttgattgttagtcaaattttctgcctctttgcatgtctagtgattttaaatttaatatattgtgtataaaggcactgtggaggctacagaggcttttctctgttggagattgggcttaatatttcaatccagtacaatcagtgattgaacatggctgtgttttagttttagtaaaacctagcccactttgtttcttccttgttcctcaggtataattcttctaggctttttattgacaatttggtagatttctcttcagatttgaagtataggacatttcttctgcccttcagaggttttgagctttgctctttggtctcttgctccatgtagcatctaaatttgacatacattgaagagaagactagctgtgagtttaaggtagacctcaagcaggacttcatcctgtaaatttcgtaagactatgagaaatttcattctgtcttaaaattactgtctagccttggagccatagaatccagcaaatcaatcatggagaaaactggctatgtgtttactgctcttgcagtttccaaattttcacaccactcttctgtgtgatccctacccagaatcagcaaatgcttcccaagtaagaacatagctagttcagcctgctctggaattttagttaatttaatccctcacttccacagctctctaatgcctttaaaaggattatatttgcaagtttttttttttctgggagtggtggggagtgcttattgtcattattacagtgagaatgagaatagggtttgccatgttatactgtattctacttataactacatatactcctacatatactctacctgtattaaaagtggagttcatttatcccagtgttgctgacatacacgatttccattagttcctgtgcctagatctctggagacttcttggttcttgctcttttaatgacctggttcttcaggctttcctttgattcccttttaaccttctattgtataccttaattgtgtggtaaaggaaaggaagagtttaagtggattcaaagtttgtcgtgttaaagtgaattaaatatggtctgagaaggactttgtactctatatttgagtcctagtggacgaactgtaacctaacttaataggtagacaagatcgaaaacctgacttaggagtatgcgcctgtaacaatagctgagtcttgcccaatcccagcagccatatttcaaccattcacacactgctgagcattcagactgtgttcaaataaggcaaatgctgagctgtaaccaatctagttgtttctgtacctcacttctgatttctgtatatcactcccccttttttgtctataaatcttcttccaccatgtggctgcactggagtctttctgaatctgctgtgattctgggtgctgctggattcgtgaatcgttcattgctcaattaaactcctttaaatttaatttggctgaagtttttattttaacagtaactgtcagtaatctttttcaatgactgatataatgaacctgttaggagaaagaccaggatgggatttaggtaggttgaacttgatgtgcttgctgaacctatccaaaagaaagttggaaagtgagtctagaactcaggaaaaaagcccaggtgagagagaaatatgactttgggaatcatgcacatagcagtgattgccagaaaatgtgtggcacaaagtaaaaatttctccatgcacttcagatgatccatagtttccctaaacactgtggacttgcagagaaggaagtgtgggaacagcatcaacatactcttacatacagggcctgcaagaatctcacgtggtaggaaaattcatttttcaaccactacacctgttctatgaatacagcaattggttatgtgtagagaagcatagcatcatatgtatttttacatactattgccattactaggttttattagggacagaaccttggtagaataaaagcacatttagaatataatgctactttcatcatcatttgttatattgtcttaatattcttcacacccaagacttgaatatatatatatatttacatggaagtaaagtttacatggaacaatgccaaggaaggggttttcaggcaacaaaagtattatatcagttgttctatttagaacactgtgttatagcattgttacctgttttttcttgtgtactgaaaagtataaccccacttaaactcaatatatgaaaatctaggtttacacagaagataaaaggtaaaatagtctttataaaatagcagactcttagtgaatttggattcaagatttaacaatccactttgcccatagtcttacaagttttttgtaaatctaggcctaccagtgtataggcacagtgaatggcttataatcctattcataggagagttgcagctcataatcataattttatgacacttttctcaaggtctcatgtggcaccctatcaactagatgttggattgcagtgggaaacaatgcaagaagagctgttagcttgtgcttttactcttagcatctcgattgtcctaacagtaacattagcagcaagcaggaacagcaagacaacaaaaacaacagctgttaatatgtgttactatgtatcaggtcacattctaagctttgtgtatgtatgaactcatttaatccctatagcagccctgtgagtaagtactcacattatccccattttgtagatgtagacagagaagtacagttaaatagcttgctgaaatgtatacaactgtgagtgatgaatgtggagttcatcttgcttcatattccacattcttaatcacgttggtatggtggctctaaaagtcactgctttttccacagaaaatgtgcaacaatccttttttgcctaacaccctttgcgtgttttgtatatgggtccagtagactagaccatagactataatgtacattctctttctaccagattcctttcttccccatttatcattaagcagacttagcaaggaaaattatcagcgataaagatgggtcattctgtagtgataaaggagtaatgaggacataacagtccttaacatgtatgcacataacaacaaagtgtgaaatacctgaggcaaaatatgtgagacaggagaaatagataaattcactattatagctagagacttcagcacctctcttacagtaattgaaagattaagcaggcagaaaatcagtaaagatatagctgatgtgaatagcattttcttcaatcagcttgacctaattgacatttacagaatactgttttcaacaatagcagaatacacatttaccattgaaaacctgtctgtcctgatggactctgatatttggattggggagtttcttgtaaaaggctgtcttgtcataatgaatagggaagtctgtgtatttggagttggctcagtggggagggatagagctgtagaaatttattcttatttatagtatcagctagaagtctatcatgtagagaaacatttcttttcccgttcatttcaagctttgcctgctccccacccacaacaaagatggttcagatggttcagtagaaactggttatgtggaatgtaaggtaagatcatgctttctcattaggagtcataatcactttcctcattcatattaatatattcatatataataccaaaatcaccaccaagaaaagaaaattagagtaaggtaactttcaatatttggaaaataatacatgtgcaagacttctggtgatagctatatgattttgaagagaaagtaaaattttttataaatcaaaaagtataaaccattaatattacaaataggagggaaattgcaaagcttagcgaaaggcactggatagattgtggcatacaaaagggggtccacgttggatgcagtggcacaagcctgtagtcctagctgctaggaaagctgaggcaagaggatcacttgagtccaggagttccaggctattgtacccaatgatcgtgcctgtgaatagccactgtactccagcctgggcaacacagtgagacccccatgtctaaaaaaaaaaaaaaaatagggcgtcaggtttagtgattcattcatttattcttttaattatttattttaggttcattagaactattagagaataaaatgcatctgattgtttatatcttgtctgttaaatggtatttagttatcttttgctgttcaacaaattaccaacctagtgctgtaaaacaacacaaacttactatcacacagtttctgtggattaggagttcttgcacagtttaggtggtgtctctgctttggggtccctcacaaaggtacaaaaggtgttgactgggtctgcagtttatttcaaggctcaattaaagaaggatacagttctaaaatcatgtggttgttggcagaattcacttccttgatattgtttggactaagggcctcagtttcttgctgtctgccagaggctgccctcagttcctttccaagtggacctctccagagggcagctcacaccatagcttgcttcatcaaaaccagcaaggaagagaatctgctagcaagataaagtttcagtctttttaaacacagtcatggaagatacattccatcatctttgcaatattctattgattagagcaaatcacaggtcccatttacacttggggaggcgattttccaaggtcttgaccaccagaagataaaaatcagtgggggcatcctacagtcaaccaccacagcagggatcatgtgtttttaacatgttttattgtgctcgataataacatcaaagttttcattgtgtaccaacactttacataaattatcttattcagaagttaagtgatttgcctcacaccacatagtaagtgctaaaaccagcaagagctcaaagagtctgactctaggtattatagaataatatatttttaattaaacatgaaaagctttaaatggtgcttcttgtctgttttaaaatgttctagaattgaggtgggtagcatttttacagcaataagaatgctaatctggttattaattgttaccacatgatttcagactaaacatttcaatcacagtgaacttcattgtttgtggcgcaatgtcttgcttcccttggttcctagtacaaagattaaaggggcaaataatgagcagattctgtgaaacatatcctctgaggaggaaccataagcatggcttgaaggcagggttgctgaacagatacttcatttatttcgttgatgttgcaggattaatattgtatactctttttgtggatgatggctttggttactggattccaaaggccagtattcttttctatgaaatgttttctaattcgtataaagcgaattctttttcctcttcattcctgtattttattttattttattattttatttattaatttattttattttatttcttataatagtctaggagtgcctctggacggctgtgtccaagggtataaatttgcaagtagtaaagaaatttaccattacttaaaaatcatttaccttcgttgtgaagttcctttcctctctctccctcctttcttccttccttttctttctctcttcttccaatttagagtgattacatatggcaagactttaaattattgtactcagggattattttgaacttgcctttaatttcatttatgtgtgactttttcctgtaattatatgtatacagtacatatgtaatctttcatacatgggcattaatttcatagctgtgagtacagaaaatcccattttgataggatatccaaataggatactttttggatagtctgaccttttgctcatttaatgacaagttggttacctctgttcacttagaaccaacctcccttcctccctcccttctttccttccttccttcttccttccttccttccttccttccttccttccttccttcctctttttttttttcccccacactcttgctctgtcccccagactggagtgcagcggcacattctctgcttactgcaacctccacctcccgggttcaagcaaatctcccacctcggcctcccgagtagctggaattacaggtgcgcgttgctgtggcctggctaatttttgtatttttagtaaagacgggtttttgccatgttggccaggctgatctcgaactcctggcttcaattgatctgcccgccttggcctccccaagtgctaagattacaagtgtgagccagaagcagatatttttgatgaatactttataattcagttttcaaaatatagataaaaatacaaatggaattagtcaacagttggccgcaagtaagtatagcttttatataaataatcacaactattcaaatgtaaattaaatttgactttctcctcactacaaatccttataatagctcacttgctgtgaatagttgtctgctttttttggtttgcttagctttaacaggggttgacaaactatggccgtgggacaagtctacctttctctgttttttgtttgtttgtttgtttctttttcaatggcttccaggctaagaatggttttacatttttaaatggttggatcaaaaacaaattcaaagcagaacatgtaagaggccatttgtagccacaaaacctacatagtttactctctgaccctttatagaaaaagttgactaacaaggtttgtgtgaaccaggatggtttcattattttcattattaagtcttgtcttttgtagtctctgaattgttaggcatgttacatgttgatatagacatgctctgaaataaaggtccaaatagtaatattattcttaggctcttgttttactgtacatcttttgtacttgtttccgtttttgtttttttttcccaagacagggtcttgctctgtctccaaggctggagtgtagtggtgcaatcatggctcactgcagcttcgatctgctgggctcaagcgatcctcctacttcagcctcccaagtagctgggaacacaggtgtgtgccatgatgcccagcttgctttttttttttttttttttttttttttttttttttttttttgagacagagtctagcttttgtcgccaggatggagtgtaatggcgcgatctcagctcactgcaacctccacctcccaggttcaagcgattctccttcctctgcctcctgagtagctgggattataggcacgcgtcgccatgcccagctaatttttgtacttttcatagagatggggtttttaccgtgttatctcctgacctcgtgatctgcccacctaggcctcccaaagtgctgggattacaggcatgagccaccacgcctggcctatgcccagctaattaaattttttttttgtagagatggggtctccctatgttgcccagggtggtctcgaactcctgggctctagcagtcctcctgcctcagccttccaaagtgctgggattacagatatgagccattgcgcctggtcttactataaatctttataagcttacattttacctcttatttcttcttgcttttattatatgttcagttattctaatgtgtttgtgtctctgcctcctaagaggcaccttgtatttagtgctgaagtggctcttaggtggaggagatctgatcggttatgcttagaaaggaacaatctagtgaaatgaaaggcctgggcttctcagatttggatttggatcccaagtcgaccacttactaacttagtgatcttaaaaaagtcgtgtaagggggctttttgatcttcagtttcttcactttaaaaatggcaataatatctattttgcaataagtttaaaatgagattaaaaaaatagaagatttttgtgtattagtaggtcctcaataaacagatttttagctgctaatggtagctgataatccaaaatgcatgattttacatagttttatagaactcagaatatgttttcattttttctaatgtaaaataattaacacaatggatgagataatttggaaaacttgcacattcttcagaatgattgctcaccctgagataaatcacttaacctctttgggtctaggatctacaattgtaggaaaagtagattggggtaggtgatcacattcaataaatgtatttattgaaacagaatagttaaatatatactaggttaaatagaagcatagaatgggctttatttctcataattcttctctcataactggacaatatgatttttaaaactgatgcttctaaatatgggaattataattgcccaccctgagctttatttagaatatagaaattttaattattcattatcactacccagacctctagggaagaacacaccattcttggagaaaggtgtcacatgaaaaaacatcttaaataactaaattgtaaaaatttaaactttgtatttgaatttttttctcccgtatataaatgctacataggcaaagtaaattttcattaaatattttatttaatataatgtatgaatagttgagctgagggacttgattaaacattctttatattttattcttttacccgactatactgagctgatgatgacttcaataacttcttgataattgaagataaataatagcaggaaatacagtcattgtggcatattgatttcagtatcacttgatttatagatgacacatctgctacaaagtctttagaaaaaaataccctgggctatttcttacgtttctttcaggcaaatttgtatttcagtatgaagatttattttgtttttgaaattgttatattgacgtcttttaattcatttagctcaagcttgtccaactcgcatgtggcccaggacagctttgaatgcagcccaacacaaattcgtaaactttcttaaaacgttatgagattttgttgcgatttgttttttaagcttatcagctattgttagtgtattttatgtgtggcccaagacaattcttcttcttctaatgtggcccagggaagccaaaagattggacacccctgatttagataacataatgaaataaaatggttgtttagtttggagatcagtattctaggcaaagctgtctgaaggagaacaaatataaatagatttcaatatatgtattagagctagcctgtgaattacaatggctacaaggaaatataatgtaaaatagcacactatgcttttcttgttattgttgcttgttcaaatagaatgaatttgattttaacatagtctttctgttcttttttaaaaaaatgtatgcaaaagctgttgcttggcgggggtattttacatcagaaatgcttaagagattgtaataaggttggtgaaaaactgaggtacatttaatgaatatggaatgctatatctgcaaataaagacaaaagggactttcaaaagtgtaatttaatgttaattctcagttttacttaatagcacttcagaaatattatctattttaccatttgttatgtgcagaagctaagagacttatttttctgcaggtcagtggcagaagaagaaataaaaatcttccaaagaattatgaagttgtatctgattttcagtgtactgccaacactgtcctcttttatacttttaagtttcccttccttttagaattaattcaggacagtatggtttattagcctatagataatgacagaatatccaattttatattacagttacttttggcatttgttttgtgtgatcagagatccccatgtaacagtattgaaaatggccacttgaatcattacatctttgttatatggatatatctgtataagcatatagagaccttgtttaatatttattgagattaaccataatgataggttagtgtcttataaataagtagaaatggcacattaaacacaagtttgctagattaggtaattgctgtatttcatgtgggtcatgggtctctgggaagaaaccacatactgtaagttaaaattaagtccccagtttatttgatcagtaatacaaaagcttattggacatggtaatgccatatggagtagaaatagatatagtatatctaaaaatagcttcctgtggtcctttagagtccccagtggggtcataaactgcctgtgcagttgtccacacaaggtaacatcttgccagatctaagctgatttcttgctatgccgtaatccttttatacctggagctgatgtcacctttctacaagaatatgcacaatttatgcacttccatttaaaggaatgtgtacaagcttctaggatctattagttcttaaaccaaacctgtgtcagtaataccctattctgatccttgagaagaaagcaaaagtcatttcaaggtatctcaataataaatacacctttggcttccctgcactatgggaagtgcatctcttcaaaatactgatagtgctatattttatatatatatatatatatagtcatgcattgcttaagggcgggattacattctgagaaatacgtcattaggtgatttttgtggctgtatgaacatcatagagtatacttacatcatagagtgtagtaggctagtgtgtactacatacctagggtatatgatataggctattgctcctaggctacaaacttgtacagcatgttgctgtactgaatactgtaggcagttgtaacatgatggttaagtatttgtgtaaacatatctaaacatagaaaaggtacagtaaaaatataatcttgtgggcctactgttatatatgcggtccattgttatgtggtgcatgactaaatatatatatatgtgtatataatactgtatataatacatatatatgtattttctatcttgtagaaaatacatgttatgtgtgcgtgtatataacacactatgtatacacagacacgcacatacaaacacacatggaagtttgttgaaaaccagcaagttggttgatcactcattattatttgattgtttttgataggtattggtagcttccaataactagaggtcagtgaaaaatataggcttcctcccccataattctgctaacatttaatatgttacagtgaagacaagactcaaaatggggaagttcatactctgtctttttaggtgttcctgcaatatcttatatgaaagattatcttgagaaagttgtgaccttattccaacaacaggatttgatcatccttctgttcaggcatcagataataatctgaatcagcccctagacacagtgtggattggaatctaagcctagagcatcattccaaagagtattggctactggatttactaaatacttacatattgttctcaaagttggtagtgcttctgtaatatttctaggtatttcacataagttaattttacccagcaaaatactatttctagagtccatttagcttacaataaacttgctggtttttataggaaataaagcttactgaacagcttgatattgctgctgcctttgggatgtaggtgtttgatgatgtaatagttaattaatcctgaagtgttaattcccagacctactgagtcataaactctggtgatgaggctcagtagtctgtattttaacaagctctcaatgtgcatctgatgcacactaaaatttgagaaccactgtcctaaagtacaataacattttgatatttaaattaccgacagagaaaattcataacagaataagaagactaacaatgagtcatctttgggattttattataaccagttagtctcaggtacctggtatttacccgtgaagtaaacatttattatatcttgtgtcctgttaagtatagcacataatgcattatgatgggactgaggttcagttcaaaaactattcagcaccttctatttattcattttaggatactgctgcttttgtaagacttaactcatttatacagccagagcttttagtcacagcaagagccttgaaagaagaatgtaaatagaatattgctatgcatgtttgtgtcaaaggatataaactgacacatgtaaattttaaatataatttactttatccattccagtcgtgtccagttaaaacctactggaatctttttttttcatagtttatccatgtatgatacgtgagtttgtatattttattattaatggatgtcaaccatttttaccttttttgttctacccataattttcttcctcgaatgatgccactattgccaaattagcaagaagatatttatgacttttctgttttctaagaggacttttgcatattcacatataaattgtggtttaagaaagatacacattgacattttgacagattttaattttcttaggcttggcaggatacaactactttgtctgttacatctggatgagaccattagaatcttgttgctataactgtaagtcatggtgttgaatttgcctttgcggtatagaaaatagagcagtgtacttgaatatactctgcagcatagagacatagcgtgaaaggagcataagtgtcacatgatgagttgagctagcattttcttcttccatccaattaaaataatatataaggtcatgaatatccagttatggttgtatatccatattctatttgtgatgaacacatgatttcttccattttaaatttatatattttttttcctggaagtgttatactattctgaaatattttgatataagaatatatttacttcattatttttagacaaatttataatgttggcgtttcgtgatctctgttcacctcattaatgtttactcttaatactttctaatttgcatcctaaacttaagcctttatgctgaacaacccactatgcttcatgtctgtgcctttacacattttactattttactgattcagccccatccccagctgtcctaagtatttttagtaagtgttggtggttctttaaaattcaacctaagcgtgtcttcttctgagaatcctttcttgacctcattcatctgaattaggtgccctttctatatgttcacccagcagccatggcctgctcctgtcattgtactctccacagtttgataacttttagtgcatttgtcttttagctgaatcttaagtgagtattttgatggaatggattatatcttattcatccttgtatcatagtgtttagaatctggcgtctttaataaagtgaattaaatgctcattgaatgaatgaatgaatgaatgagcccagttgatttggggaacattgtacctgattaaaaaatcattctttgtattctcaggagataacggtcatcttagacatgctgatctatgcctgttatatctttgatcccacttattacttagtccagtacctctggcatagtgaatgctgcatgaatggattggaattaagggctgtattttatataaatcataaacattttcttctgtagatttaattattttataattaaaacttaacatctttagatgccatctttttttagaaaaagattttattgatctgccttttaccactttgatcaaagtacaccttttgggtttcatggttttatttctttttcttttgtttttttctttttagacaagatctcactctgttacccaggctgagtgcagtggtgtaatcactagcatgctcactgcagcctcaaccacctgggctcaagtgatcctcttggttcagcctcccaagccagctgagaccacaggcacatgccatcaggcctggcaaatttttgggtttcattacatttgactttttgttgttgttgtccagccatagaattcttgtcaatattatatagtagtttcctctgaaattttgcattttcatgtcattgtgaaaggtattagagataatattttttgtaggtcaggccacaatcacagttatcactgtgataaaataaaaaaatgtacactgccattcataaccaacaggaagatctggtaaaactctgataagtaccttatgggctctaggcaacataagcgacatttaatttatttagattgctgaaaataataagcaaaaaaaaaaaagaatgctgagtcaaatgcaattaatttagcatctatagtaacttggttttagtgattttaatgattaattagaaagtgcatagaagctgtgaagctgtttgctcttcccaaccctatattttgatattaaggatctcatctttgttgtgtagaataggcaaatatttaggaagacagcaatttatttccattaaaatatccgaattagccagctaagagtctttgtttactttttttgtgagatggagtctcgctcattcacccaggctgaagtgcatgggtataatctcagctcactgcgagctctgcctctccggttcacaccattctcctgcctcagcttcccgagtagctgggactacaggcgcgtgctaccacgcctggctaattttttgtatttttagtagagatggggtttcaacagctaggaaggtctcaatctcctgaccttgtgatccgcccgcctctacctccacctcccaaagtgctgagattacaggtgggagccaccacgcccagccttttttttttttttttgagacagagtttcactcttgtcgcccaagctggagtgcagtggtgcgatcttggctcactgcaaactccgcctcccagattcaagcgattctcctgcctcagacccctgagtagctgggattataggcggccaccaccacacctagctaattttttgtatttttagtagagacggggtttcgccatgttggccaggctggtctcgaactcctgacctcaggtcatctgcccgcctcggcctcccaaagggctgggattacaagcatgagcctccgcgcccagtctgtttacttcttaacatcaaactttgaaactccttatttaaaagattaaagaaagtgaattactgtctatcactgttgctgtttgcttattagggatataaaaaatgggataaagatagaaatataatagatcaggtggtaacagaaggaagtagagaaattcaagagattgaagacatgtagattcagagtcaagttctaatattttaatgcatcttctgtgttaggatctaagtactttcacatatattacttgtaatttaatatcaagtgaaaattagtttgttttgccttaggttcttctttgtcatctttcagtacttaactccttagtttgtgtatgtttgtatttggcatccagtttgtaagacttcatccattcacgtagtccttcattcaggctttgtagtcagacagatctaatttatattctatattggctgtgacaatttcttaaaataagacaatagtacgtattgcattttggaaatatatataacctataattattttaacagatattcctaattgtttatacatttcttgattaaactaatttatttaaacagatctgtttcatttgcctcccaactcaactgttaggatgtttgctcctgcacgctttcatgggtttgcatttgccccctccccattttataattctctaacctacagaatgattgatttctatattatttatttattttaatttttaaattaagttttctttaaaggcagggtttcactctgctgtccaggctggaatgcagtggcatggacatggctcactgcagcctcctgggctcaagtgctcctcccacctcagcctcccaagcagctggaggacaggcattgagccaccatggctggctaatttttaaattttttgtacaggcaggatcttgccatgttgctcaggctggtctcaaagtgctagtctcaagcagtcctcccaacgtggcctcccagagttttgggattacaggtgtgagtcactgcacccagctggaatgattgatttgaaatgatagccagtgtaaagttctgtctatataaataatatgaaatgacaggaagtaacataaacatgtacttctaaaagtatggatattttaagctgtttgttcttttgatgcaactatgattacttgtgttttaaaatatacttttagacaaggaataaaaaaagtaaatataaatgctttttcataaattgttaaacaacagtgaagattggaaattggtgggcatgtctaattagcgtagtttccttcggaaatattggcgtttgatttcctcaaagctgacacaactcagcatgtggaagtcaggctgccttgccccagaaggaaacttgctgcatggtgccttgtaacataattactgaaacagtaagcaaagtagtagaaatagcaagggatggaaacagttcctaaaaattaaatattgagactgaagaaagacttgacataatcagagagaatatggacaagcaagagattaaaacatagagaaggaaatagatatggataaccagtaaagatctagcattaaaataattgcatagagaatagaaaatatggaagagaaaaattattcaaaataataaagacactttccctgaaaaggagaaacacatcctcaggtcaaaatgatattttgggtcctgtgaattttgattgcttgacatatctaggttaaatgataaaaccgatatttctccaggtatccagaaagaagaatatatcatttcaaagagggggaaatcaggctcttgctaaatttcttcctaggaacagtcagtgctggagatgaatgtagcaatctttttacatttctgaaataaagaaaatgtgatctaggaatgcagttcttagctaagacaccagccaagtatagattcaataggcaggcattcccaaataccctcagtctctcttgaaaaatatatcatttaattagggtattgagccatttaaaagataaattgataaaattggcagtaacatcatttaatatgaaatgctagacatttatgtaagttatgattttggaatctaatgtatttgatataaagtttaaccgtgaagaatagcatgccaacaaaatttggagttggaagtattttcatgtttctgttaataacatctaaaatttaaaatataaagacattagtccagtatattaatgtttttgacagttttttaaccttagatctttttaaaaatatccatttgaaattgaggaactcatgcattttcactgaatttgtgcttctatcaaataaaagtaaaattaaatgtactatattttaaaaggacaaataatttcctctaattttgtaaaagctttttaacctattttgacatatttgaggggttttcccccctacacgttttcatctctgtaattcttttaaagagtatgtgctgggcgctgtggctcacgcctgtaatcccagcactttgggaggccgaggcgggtggatcacgaggtcaggagatcgagaccatcctggctaacacggtgaaaccccatctctattaaaaatacaaaaaagtcagccgggcatggtggcagatgcctgtagtcccagctactcgggatgctgaggcaggggaatggtgtgaacccgggaggcggagcttgcaatgagctgaaatcgtgccactgcactccagcctgggcgacagagcgagactctgtctcaaaaaaaaaaaaaacaaaaaaaactaatttttacaaaaataggaaatatttgtatatttaggaaaacgttattcactgcaaaagaatttttatgtattcaggaaatagttatgatcctcacagatgagaaaaagtgaagttcagaaatgatatgacttaagtcaaatatttagttaattttataagcaggccaatagtccaagtcttttgaatctttggtaactgatctgttactgcgttacacaagtgataatatttaggaattaatatatttctagagcagtgccatatgtagccacagtgtgtcacaaagagaacaaatagtatgtgtgtgtataggctgaaaaattttaccaagacaaacgtctgtatagtacctgtgctattaatattttatgaataaaattatattgtctaggtaacttttaggcataaagatggcaacacagtggatctgtgagattcaggacactgaatctaaaagtccacttggactattaaaatattgctaaatatgaatatttctggggcttagagttgcacaattactttgaatgtatgcatgcctgattttataaaggcaaatgcatccatgtattagttgtgtggttggtagtcagtctgaattaatgacaaatgtgaattctgtaacatttgatgataaatacagctttattgctttcaggttcatgtaaaccaaagtaaatctttactgtttccaagttgacagcccactgaatctgatataattaatagatgatggtaattggtaaatagtgccatccatttttactgataattaatgtattcacttgtgttctgaagaaatttgtttttaaaacactgccaccaacctttaccccagcaaatatttacagaatttacttttaaaacaaacattattttagagtttaagaaaactgacactacctactgttctagcttaattttccactactcctccttccaccttaacctcccttttcatcttcatttcctgttctcccctgtaccctatgctctagccatataaaataagttcatttttactgaatgtggcatgctctttcacacttcttttcctttgcacatgctcttccttctgtttgaaatgtcttttccttcatcccccaacagacttttccttgacatggttcactatggctatccttttaaagttcttaattataccaggcattatttatctcttcttgctatggtctaaactctcataccaaattatcgctgttattacatgtgctgcaatttgtaatttgtgtctgacttttccacaaattatgaatctgacatttccagattgtaaaatatttgaggatagtggctgtgtttgtttcatgtttgtgtgcttaagtacttggcatgtaacaagtacttggcaattttttaaaaatgagttgtgactcttagtcctgcagagatcatattactgtggtcccctttatccatggttttgctttctgcagtttcagtatacacagtcaactgtggtctgaaaataagatattttgagagagagagaatgcaagagaaagaccacattcacctaacatttattacattatcttgttataattgttctattttattattattcttgttaatctcttagctgtgcctaatttataaagtaaacgttataataagtatatatgtctaggagaaaacagtgtatataggatttagtactatctgcaattcaggcatccactaggggtcttggaacagtatccccacaaataagagggaactactatgtcacattttccttttctttctcagcccctttatttcgctcctttttcttgtcgctctcaatctcttttactttcctcctctttcccctactccctccttttcaactttgttcttttcttcagtgttacacaaaagacagacatttttagaagtgtttgccaggaaaagagtgttataaaatccaccaatgggtactgcttctttgtttttacatgtaatctaggtagatttatttatgatgaaatatttagaaaaggaatcctgatttcagtagaaacttctcttttaaatgtcaaaatctacaatagcattatttaatgaaactcacatagaagaaataaaggatcatgggcctatgtaaacttgaaaataagaacttggcatagagacttagaattctatagagaacaccatggcacttcccagacctttgctttgatattcaccctttgcttgtcaagggccttgccttaaatcttttttttttttttttttttgagatggaatctcgctctgtcgcccaggctggagtgcagtggcgcaatttcagctaactgcaagctctgcctcccgggttcacaccattctcctgcctcagcctcccgagtagctgggactacaggcgcccgccaccacgcctggctaacttttttgtatttttagtagagacggggtttcaccgtgttagccaggatggtctcgatctcctgacctcgtgatctgcccgcctcggcctcccaaagtgctgggattacaggcctgagccaccatgcccagcttgtcttaaatgttttgactcagactggttcaacttcactcactcagtttaaagacctctcttctcatttctttctcttcacagtaataaacttactttaattaaatttttgacacaacaagagattttcattttttaaaagatgatgcatagacatggtaaaccatccaaagagtacaaaaggggtatacattggcatgatatttctgccacaaacccaacccctcagtttctctttctagaggtaacatcttctattagtttcttctgcttcctttcaaagatatcctccctatcttaggggaaagaaacagaaagatacgacataccaatgggtaacaccatctgttggagtaatttcctagcattttttttgttgagagctctgattacttgattttgtccttataagttaacattttttttcttcataaccttgcacaaaataagaatcatttgatgaccatgagttcatggcagaaaattgagtattttaataaccgtttgaaacaggaaaagcattgattggttctcagtctttggaattagaaactttgcaatgagtatgttttcacccagcatatccagttcatttatcacatggtataaaaagaaactcacatggaaggggatgagtttatgctgaaatccaaacatcttgacttaacctgcagaattgtttttatgtctttgcatcatggagtcaaagaataggtaccattggaaaaatcccttaagatgtctctctgtttctcctcttgaccaaactgggggggaataataataatgaaaaaggtttaattgcctagatgggagcctggtagaacccaatgtgtcattcatctgttacctaaatgtggattagtatctggaatacattaggtaagaatcacaatatagggtaattctcacctccatagaaaataaagggttctaaaacactaccacataacttaagggttcagtaactcagagaaatcctgcataaacgattgtttttctagtctcctggtatttgttggaaataggtttcatacttcaaggtgatacatgtctaagggcaaaggatagtagtattctttcaccttctggcactccatctccctggataaaattctccatggggaaaataggtggtggtatttctgtactttgggaattttagacatttgtcatttcattgttggggaaaaacaacatttctggttttgacttggcaaaatgttatggccttcagtttgtgttcttttacctatagtttatttgaaaaatacacatacacacataaaacatacatttttctacagtaatggaagaaaacagaaactactttgtcgacattttggaaacaaagcctagaagtatttgtgcaaaaggttaattcctccttcacacaaagaatagtgtgaatacatttaagttatttaaatgaatgtgaagttagtttaaaatttttccattttaatatggagaaactcggatttacttttggagttggtattaatggtctatatgggtttctcttggcctatcacttgtcattgttttcaataaaaggcaaaaagcagttgttcaggtttagactgaagtatttaagaacatgaaaggggcatgagattctacttctgaaagcttatgatacattatatctttgaaattcaactcccttgttctgacaagtatgttacacatcagccaggcagcaagataatatacaagaaaaatccaagtctttctttgaaaggattaaccttcagttggtaacttacctccctggggttttgtgtagcttaattagcattggcaaagcagcttgatactgttggatgaaaggcaggtaagttattagaggtaagatagagttatgattgtgattttgcaaacagataatcatttttttcattggtgacatgaggggaagctgaggaggatctttatcttgggtcttaatctcaggtagtatagtttgaagctagaatgctttatgaaggagctccatgtttaatatctcagctgaaaattagttgttgcctttctcttaaagtattgtggcatgtaaaccaagagaaatgtgcactattgaagcattgaagcaggctttttttttttttttggtgtatgtcatatataatctagtaacagcatactttacttatgtgattaacaccacaggcaagtcacatactgtaacaatttgcatgagttggttgtaactaaaaaacatgtaaactctattgcaagatacttaaaaaaaactgggaataaacaaaaggacattgcttctagatctcacctagttcttcagaaagtttcttattaactgagggattaattatgaagatttttctgcgactttgcatatgcagctgtatatacaattgtttttttgtcagcttcatttttaaaacaggcactaaatccctttggatatatatgagagctttcactttggttttgtgttataattgttcctctggtgtaaagtagttcatgaaaaaatggttgagtgcgacttgaaataaagtatatttaaattctagacaaaagaatgactagatttgagtggtgggggagaactgacctattatctattttttttccttcattcaagcataagtggcttcctatagaggaattaattgtgttctctcagagaatacctaagtggtgaggtctgcttgctagctagctagctacctacgtacctacctaccttcctatctatctgtattagatagatagatatattaaaggagctgttcaaacttcagcctttggtggaaggcaaaagaagactctaccagaggacctgatactaagcttacatttaagggattttattcttttgagtaaatagcctagttctgtctaatgatactaaaagatatttcattctgagtaggacagtttatcttctagaacatccttagaagttttcatgcatattcaatctccttttcccctttaaataatccctattgatctgcagtctgttgagttattgaaactttatttgaacctgaatgtgttgtcagcattgggaacaatgcatctcatgtatttctgtcttttgtggaagatactcctctcttctacttgttgggaaactagtatcttgagtcattctttaatgcatctttcattcaatagacatttcttggacactcactatatgtcagcatctgggctggaccaaggcatgttctatacatggtattggtatggttttggtaatctggtaatttcttttgcattttcttcacatcctctgagatcatgtaatgtatccagtttaatttctttctataatactagtctttaggcaattggtcagtccttctaggctctaatgatgtttataatccccaacataattctataggatttccagtgtaatcctagattattgattttaccttattttctgaattatttccttgaatcactgtaaaacataatcacttgcacctcactccttttttgaatctttatgtgtcaatacttgtatgccttttacttaaagtgataaagagtagtttaatagttgtaataaagaataatataacttaaatgaatattaaagttaagaggggaatctactgcattcattttgaaataggaaaaattgcaatagcaatcaaaccagattttcttttgttcttgaaatgttcaaaatttgtcatgaacattatagattctgtgtttcatagtgtatagatacagattaatattgtctgtagaatacccatgtaagggaatgtgatattaatacagaaattaaaatagccgtaaaatgatgagcttctctaaggtgcgctcttcttttttcttttcttttctttttttttttgagacagagttttgttctttttgcccaggctggagtgcaatggcactatctcggctcaccacaacctctgcctcctgggttcaagagattctcctgcctcagccttcccgagtagctgggattacaggcatgcgcctccacacccagctaattttgtatttttaatagagatggggtttctccatgttggtcaagctggtcttgaactcccaacctcaggtgatccacctgccttggcctcccaaagtgctgggattacaggcatgcaccaccacacctggctaattttgtatttttagtagagatgggattttgccctgttggtcaggctggtctcaaactcctgacctcaggtgatctgcccaccttggcctcccaaagtgctgggattacaggcatgagccactgctcccggcctaagatgtgctttctaacaaatttcacagtgccagatttgacttttagtaaatctgcattaaaactagtcagaaaataattagtgaaaaactgatgcaggatattttcttgacccctttgtggggtgtatgacaggggtgcctcgtttactcagcctgccccgcttaaccccttgtgggagggagagagtgtgcaaacgagtacaggaacccaactgcaggaactggccaggggcccggcagtttacttgggtaaacttactatttactttggtctgcctggctccacccctcgcaggagggagcatgcaagtgagtgagtgcagggactgccagctgcttcagcgatgacaggagtaaactcccttcaggccctgtggcagcatccaggtaggggtttctacgaccccaaggccccagggggtatgttgcaatgctgtcttagctccattgtctgcagacatcagtgtgttatcagctcagtgtgtcctttgcctcattgcattgggtggctgccctctgccagtgagggcagagggccagtatgacagactttttgggtaccggcatgtggtacatcccaaattcttgtctggtgcccaagagaaatgaggtcatgcagatgaactgaaggatggtgaatatagagaattttattgagtcgtgaaagcagttctcagtggagaggggagcgagaaagggagcgggaagggcaggttgctctcccctgaagtcaagccacctctctgcctctctcttctgaagtcaagttgcctcatccagccggtgtctctgaagttaagtcctctctctttgatatccagccacttctctcctctgccggctgagtctggggtctttataggcacagaatgggggttgggacgggccataggtagttttggaaaaggcagcattcgattggtaaaaagatattattgagaaacaaccaattgggagagagcgggcacacagggatggaagttttcactttgggccaccgatttcagacttttccactcgaagttgggattttgccagtgacttgcccctgtctgcctagagtgtctctgcctcctctgcctcctgttgctgtcaaaaccactttcaaatgtgtattcttaaagtttcatcttatgcattagaatatttaatctttgataatggcatttatctggcaccttatatttactgtatttattaattattgattcctgagtctcctgaaagtgtctggatatggttaatatgagaggatgtaataatcagaatgccgttaactagcataatttcaaaaatattttcttgaaccctgttgtgtctatttgactattttaatatgaactaaaaatgttagcatttcttatttgaggtgaaattataaagaaaatttgtttccagggtttacttcatcctccttaaaagtaaagtattttgtttcctcactctcatgttatatacctcagtctggattagaactaaaaccacttacttgattttgagaagaaagttcacttcgaattaagtagaattgacatatattccttatattctttatcaaataacttgacgatttatcttctacaccattctcttttttttttttttttttttttttgagacggagtctctctctgtcacccaggctggagtgcagtggtgggatctcggctcactgcaagctccgcctcccgggttcatgctgttctcctgcctcagcctccagagtagctggtattacaggcacccgccaccacccctggctaatttttttgtatttttagtagagacggggtttcaccgtgttagccaggatggtctcaatctcctgaccttgtgatctgcccacctcagcttcccaaagtgctgggattacaggcgtgagccaccacgcgcggcccacaccatcctcttatattatttctagcctaaaacattctgctgtggctgataaacagttactatgactacctttgtttttgaaagtatcaggataaatagtatcacctgggctaggaaatataaatttatctaataacagtagaaatgaagtttgtagaatgacctgacaaactggtaatctggattctaaaacctttggcagtagaattgaagattaatttttgtcctcttcaggctctgtggggtttttttacccttttggaatgattattttaactgggttagagaaagtatacacagagatgaacacatgcacatacatatgcaaaatgaaaagttgtaattttgatgtgttttgattttaaatatagatttgctataataaaaactacatctttttatttggatgtgagtgtgtatagtttgaagattaaacatacttattaatcattgctttgacagcagcaatattcacttagaactcttgatattatcatataattttatagtattctttccaaaattgttaattcatttatagcagttatccaaaccattgttctgtaggaggactgtcttcctttcttacatgatcagctattttaatgttactgaagtttttaagagccatctttctttcattcttcaggtttttgaaggagatgatggtatggatttgcagaatagttaggggagttacttattttttagataattttcaaccaatacctttagggtagcataagaagaaaccaaatatacaaatatccaacctcaagaatatcaactacagaattctttgatgatataacacttttttttttaaatgaaatcatagtttaaaatgcatggttgttttctctcataggacttgctatattctagtcttttgagttttccaagcatggtctatctaaacacttactgtgatatgtagaattttcttaaattttctctagactgtagacatcctagttagctcagcagcataattcgtaagaggaagctgttatcatattccttataatccttttaaaatttgagggctataccataaaattgtttaccagtaatctgtgctgttccacaatagaacacaataaataattttgataggtaacatttattgagcccctactgttttggaacatttagtcctcaaaataagtctttatggtactattgttattttcatagtacagataaggaaacagagcttagaaaggttaaataacttgcccagagtcacacagctaggaaaagttaagagtcacacggtaagactcttactaaagtctgtcttcctgtaaaaactatagtttaaatctctatattatttttctggataatgcagctaaccagcattttaaaaggcgctgatttgaatgagcttttcagtgatggtggtggattaatctgatttatccacactatcaggccgggtgcgatggctcacgcctgtaatcccagcactttgggaggccgaggcgggtggatcacgaggtcaggagatcgagaccatcctggctagtgaaaccccgtctctactaaaaatacaaaaaattagccgggcatggtggtgggcacctgtagtcctagctactcgggaggctgaggcaggagaatggtgtgaacccgggaggcggagtttgcagtgagccgagatcgcaccactgcactccagcctgggcgatagagcgagactctgtctaaaaaaaaaaaaaacataaataaaagaagaagaatggtgcatatcacagaatggcttgtcttggagtaaagtccatgatagtgtaacagaatttttttttggaggcttggaaactctaaacatctgttatacaacattgaggacagtagctctagtagcactgactaatatggacaactaaatcagtttaacattgagccaggtatttgtgactcaggccatctcacagtgaatttgttcttaatatgttttaatttaagctgttggccaggcgtggtggctcatgcctgtaatcccagcactttgggaggctgaggcgagaggattgcttgagcgcaggagttggaaaccagtctgggctacatagtgagaccttgtctctacagaaaataaaaaatacaattagctgggcatggtggcgtacacatgtagttcccagctactctggaagctgaggtaagaggacagcttgagcccaggaagtcaaggctacacagtaagctgtatttgcaccagcgtgggcaacggaaagagaccctgtctcaaaaattttattattctattatgtaacagtcatacagtttggctgtatttactaaaaaaaaattttttttttccgagacgggagtcttgctctgttgcccgggctggagtgtagtggcgtgatctcagctcactgcaacctctgccacccaggttcaagtgattctcctgcctcagcctcccaagtagctgggattacagatgcacgccaccacccccagctaagttttgtgtttttaatagagacggggtttcgccatattggccaggctggtctcgaactcctgaccttgtgatccacccgcctcggcctcccaaagtgctaggattgcaggcgtgagccactgcgcctggccacagtttttttattctgttaaataatagtgatgtggtttggctctatttactatgtatacatctatttactaatttagctttgagtgttttttgatagagatctttttctcatttctccagttcaacttcattttaattactgaattatggaggaaaataatgtgttttcatagtagtataattactattccaaaggctgaaatattattggaagatatattttatttagaagttaagtaaaaatttacaaatactttgatggttcttggaacatattttttttcccctgaggtcgagtctctgtctgttgccaggctggagtgcagtggcacaatcttggctcagtgcaacctctgtctctggggttcaagcgattcccctgcctcaccctcctcagtagctgggactacaggcatgcaccaccacgcctggctaattttttgtattttagtaaagatggggtttcaccacgtcagccaggatggtctcgatctcctgacctcgtgatctgcccaccttggcctcccaaagtgctgggattacaggtgtgagtcaccacgcctggcccagaacattttttaataagtctctgaacataaaatttaatttctgcctgagccttgtttcctaccttataaatgagaaataagcaaacacagactcagtcatcagctttaaagtaaacaaaaaaaatattttcagaatatggtatcagtatcaggcatataaataagataatcatttttctgaaaagaaagaggagaaaactaaaactcattgagcattaccatgtttccccccatctccctatacttctaacagtggttcacctcttcttcatctttattgtaaagcatttcttaaaaattgaagaagtgcttgaaaggaggcaaaagttcctttttgaaaattgatttatttcttggtttggttatgagtatttttagaaatattttaaattcttactcatgctagggaatggctggtacaggatgataggcaagctgctttagtttggacctatgtcatataaaggccttacagctctgtttcaggaagcccatacttagattccaggatacattcctgggccagacatctagagatactctttggtatgcaaggtttacaagtccgttttcaacattttgtcctaagtgttctgcttcacttcataaactagtaattgcagtgttattatcatttaccctacctttgaaccttatatttaaaagacttacagtagtgtgaattggcacataaccaaggtctttccatttcttaataaagccattaactactttctttatttggaaaaagagatttacaataatcgttaattttattaggtctgcttaatacatatgctctaacaaaaattcagtaatctgctgtaaatccagtgccataagatattttcaccaaagattcttgctcttttgagtacatgaagaaaattaaatgttactgttgagagaaatgtcattgtagtctagaaaattttttcagaaaaccgatagattttaatagtagagtaacttgataaacaggattagtattgtacactttagccaagtaaacgtagaataatgtgtctaaattccccacaacaatccatttctttctttaaagatactcatctcttaatgcaaaacctgtttgtaaaagatgtgtcaattggattttccatttacttgtatttcagtttacaaatgctctattttcacttcactgattactttagctggttatatgacagagctttgttattttgtcctgcctttaccacttcatacttctttttcctcctagctctaagtagtcagtgatttgtttgtgttacttcatttatgcaaaaaatattaatgaagcaactactatgtgtcgtgagaatgtgtcatgtgctaggtatagaatagtgccctcacagatttgaatgtagcgggatagagtgacaaataagcgcttacattaaataagtggttatagaaacaacttacatttaaatatcagtaggggatgggttaagagatgatgatgtctccatgggatgaatattttgcagctgttaaaatatataaaacatttgtaaaaaatatgcataagacgatatttgtagtaacatgggtttcatggggactagacttgttattatgtataatcttgtaccttaaaaaatttattcacatattttcagctaaactctaataagatttaaagaaaatttgcagcatatggaatgagcaaataagtaagcaattacatttccatttaaaaaatctggagataaaacattgaattattaatcactcattgccctgatttgtacattttctccaaattgccttcttttaacacatttgaagtgagcacagacaactattcgttctacattgttctgttgttggctgctggatgatgcaacagtagtctagtatacacttgtcaaagtaaatatggacacggatttccttggagaattgagccagaaacctttttaatgttgatatcatagtatcttagagctgaatttagatacagattatcatatgtgattattctgttaaaactgagattgtcgcttgtcccttttaccccttcttggtttgtgtgtgagtctgaaagttatagtaaattttgaaaattataaataaataaattcacacttttgcacattaggtaaaatggatatgtatagtcattagaagctgtttatttgaataaagtgatattttctttcaatagtggaactggcttctccatgtatcgaatttgacaaactcttataaagcttgacatttgaataaatacaattatttgttgtgcttttgctgggaatatttcagtcctatgggtgaccacttaaaattccaaccaaaacaaacaaaactgcatatctataatttactgagtataactctacctttcagccatattagtttatatttagaagtggtccgaattatgttaatcttagtagtttgttgatataatgccactattacagattttctttatagattgtttaaaaaattttttcttattatcatgtgaaacaaaatgatgttattttagcagctgaactactatgtaaccatgactaaaaatttagtaggtgataggcaacggtgttggttaatttcttctgaataaaagacatgctatataatatttttacagtaatattctaatagtgtattactatatgatgccagaagatcagaatcaaatatcattaatgatgagcaactacttattttttatctaattttattaacgcgtttctgctgttaaagagtacttcaaatatatatgtaaagctcagaaaataatataaccccatgtatttcactcagattgaacaagtattgatattttgccatatttgcttcagattgctagaataaaatacagatgtaaccttttttttatcttttgaagttttgatggtttttaaaaaaattttttttatatccgtaagtttttggaggacaggtggtattccgttatataagttcttcagtggtgatttgtgagattttgatacactcatcacccgagcagtatacgctgaacccaatttgtagtgttttatccctcacctccttcccaccatttcccccgagtccccaaagtccgtcgtatccttcctatgcctttgtatcctcatagcttagctcccacttatgagtgagaacataggatgtttggttttccatttctgagttacttcacttaggataatagtctccagttccatctaggatgctgcaaatgccattaaattcattcattttcatggccgagtagcgttccatctctcacacacacacacacacacacacacacacacacacacacacacacacacacacacacacagtttctttatccactcattgattgatgggcatttggttccacatttttgcaattgcgaattgtgctgctataaacatgcatgtgcaagtatctttttcgtataatgacttcttttcctctgagtaaataaccagtagtgggattgctggatcaaatggtagttctatttttagttctttaaggaatctccacactgttttccatagtggctgtactagtttacattcccaccagcattgtagaagtgttccttgatcaccacatccacgccaacatctattattttttgagtttttgacaatggccattcttgtgggagtaaggtggtatcacattgtggttttgatttgcatatccctgattattagtgatgttgaccatttcttcatatgtcttttggacatttgtgtatcttcttttgagaattgtcttattcatgtccttagcccactttttgatgcgattgttttttccttgctgtggattctgtatattagtcctttgtcagattcatagtttgcagagatttttttcccactctgtgggttgtgtttattctgctgactgttccttttgctgtgcaaaagctctttagtttaattaagtcccacctgtttgtttttgttacgtttgcttttgaagtcttcgcctaagccaatgtctagaaggattttttccgatgttattttctagatttttttatagtttcaggtcttagatttaagtccttgatccatcttgagttgatttttgtgtaaggtgagagatgaggttttattctgctacatgtggcttgccagttatcctggcatcatttgttgcataggatgtcctttccccactttatgtttttgtttgctttgtcgaagatcagttggctgtaagtatttgggtttttttctgggttctctattctgttcagttggtctttgtggctatttttataccactaccacactgtttcggtgacttacggccgtatagtatggtttgaaatcaggtagtgtgatgcctccagatttgttctttttgctcagtcttggctttggctttgtgggctcttttttggttccatgtgaattttagaattgtttttttctaattctgtaaagaatgatggcggtattttgatggggattgcattgaatttgtagatttggcggtatggcaattttcacaatgaccataagctcattttctaattgagcttctttggatcttctctcttcttttcttggttaatcttgctaatgctctatcaattttatttatcttttcaaaagaacaaaaatacactaaaaaaaaatccaaggtatacaggcaacagataggacgatgaatggaatagtacctcacatcttaatgttaatattgaatgtaagtggtctaagtgctccacttaaaaggtacagaattgcagaatggattcgaattcacaaaccaagcatctgctgccttcacctaaaacataaggattgacataaacttaaggtacaggggtggaaaaagacatttcatgcaaatggacacccaaagcgagcaggagtagctattcttacatcagacaaaacaaaaaacaacagcaactaaaaaagacaaaaggccttgtccaacaaggccttttacaatcctaaacatatacaaggccttgtaacaatcctaaacatatacacacctaacactagcgctcccaaatttataaaacaattactaccaaacctaagtaatgagatagacagcaacaaaataagtaataataataactccactgacagcactagacaggtcatcaagacagaaagtcaacaaagaaacaatggatttaaactctaccctggaacaaatgaacttaacagatatttatagaacattctacccagcaaccacagagtatacattctattcatcagcgcatggaactttctccaaggtagaccatttgataggccacaaaacaagtctcaataaatttaagaaaactgaaattatatcaagtactctcttagaccacagtgggataaaactggaaatcaactccaaaggaacctttaaaaccatgcaaatatatggaaattaaataacctgctcctgaatgatcattgggtcaacaatgaaatcaaacggaaactaaaaaattcctcaaactgaacaataatagtgatacagcctatcaaaacctctgggatacagcaaaggcagtgcaaagaggaaagttcttagccttaaatgcctacatcaaaaagtctgaaagagcacaagtagacaatctaaggtcacacctcaaggaactagagaaacaagaacaagaacaaaccagacccaaacccaacagaagaaaggaaatgaccaagattagagcagaactaaatgaaattgaaacaaaaacaatacaaaagataaatgaagtatatataacttcttaatcccactttccttcctcactttccagaggaatttttattctgagtgttgtgcatacctcctgtccacatttttattcttatattatgtaaataagtgtgcatgaaagcatgtttttatatctttttaaaatttgtaagaatgtatcatcctacatatatgtatgttttgcaacttttttcactcaacattgtgaaattcatgtaagattattcatgattgatacttgtaggtatactttgttcattttaactgtagattaaattaccatatatgaataaccacaatttactatttattctctattaatggacatctagtgtctccttgtggacatgtgctaaaatttctttagggtaatcttagaaggatacattctcagtcttattatatgtgcattttcaactttggagcaattcagcaatattttctaaacaaattattctaatattacgttcctacctttaatgtatatgggctacctttaatgtatgttacgggcttaattgcttcccccacccatccagattcatatgttgaagccctaaaccccagtccctcagatgtgattgtatttggagatagtccctttaaagagatgattaagttaaaaccaggtcattaaggtggaccctaatccaatgtgatggtgtccttataagaaggggtaatttgggcaaacaaaagaggggaggcttgcagacagaggaaagacatgttgaggatacagttgagaagaggcagacttctgcaacccaatgagtgagtcctcagaagaaaccaaacctgctgatgccttaatcatggacttctagcctccagaactgtgataaaataaatttctgttgtttaagccacccattttatggtattctgttatggcagcccttaaaaacaaattaatatgtgagatttccagtttctctgcatccttatctcactcagtatcacactttttaattgtcgccattttaatagaggagagagtatctctgtttcaatttaaatatcctggttaccaaaaatgctgatcatttctcaggattactgatgaatgaagtcctcttctatgaactgctagttcatatactttgtacatttttctattacattgccttgcctttttcttacagatttgaaggagttctttataaaatctatataataatcctacattaattatatattttccattctcttctctccacctgtgacttgtctattaattttattgcacaaaaattgttagtttttttttttttttttgagatggagtctcgctctgtcgcccaggctggagtgcagtggtgcgatctcagcttactgcaacctccgcctcccaggttcaagtgattctcctgcctcagcctcccgagtagttgggactacaggcgcctgccaccaaccctggctaatttttttttttgtatttttagtagagacggggtttcactgtgttagccaagatggtctcgatctcttgacctcatgatccacctgcctcagcctcccgaagtgctgggattacaggcataagccactgtgccctgcccaaaaatttttaagttttaaggcagtcagatttattagtctttctttttatggtttgggcttttaaaaaaaaatcttatttaagaaattcttttctctcccaagatcatgaagaatgcaaaatttcttctaaaatttttaagttttgtttgtaagattgtttgaattttctgtgaaaccatctcttattgaattatttttcctttccatattaatttagaatgatacctgtgtcatatgctaagatctctttctaggtgctttattctgttccattagtcttatctggctttgtgccaatactacactgtttccattagtaaaactttgttttgttttctgatggggggaaatcctattttttttcttattttgcaaaatgaactagcttattttggagattttgctttttcataagtattttaggatcactttgctaaatttaattaaaaaatccttttggaatttttattagaattgtatttaatttatagatcaatttgggaaacaactacttcttcagaaaatttataattttttaatgtatgaggtatgttgctgtttgttagatttattccttgaaagattatgattctgctgttactgttgtaaatgtgatattttaaaaaacacatttagtaatttgtggttgttgttgtatagagactttaatttctgtacattgatattgtatatagtgatgtccctgaactttattagtacgatttgtagattatcttggattttctgtattaaagtttatattatctgaataacatttgtttcttcattttctacacttgtaagtcttacttctttatcttattacctcagctaaggccttcagtacagtgatgaatagaagcatagatggcaggcctgtcttctattgttcttagatttaaaaggaatgctactgatgagttgatccatagaatgtgatatttattatgaatttctaatattccttactgaattaaagagtttaccttccattcattctttcttgttaaggtgtttataatgaataagtattaaattttatctaatgattttttgtttccattgagattgtaattttattttgttttaatttgttaatgtaatcaatttaaattaatagtttttctaatcgtaaaccaatgtagtattcttaggataaagttgagatagtcatgtatttttaaatatattgctgtatttactaatggatcatttgggagtttgaaaataagcttatatttgaattagtctttaatttctttgttatccttgtctacttctatatcaatcttatactaatctcaggaatggaattttagaatttcctctctttttatatttcctagattttgattcgatgttttatgaatatttgtaaaactcatataaaaatgctagaacctggccaggcacggtagctcatgcctgtaatcccagcactttgggaggctgaagtgggcagatcatgaggtcaggagatcgagaccattactggccaacatggtgaaaccccgtctctacgaaaaatacaaaaaaattagctgggtgtggcggcgcatgcctgtaatcccagctacttgggaagctgaggcaggagaatcacttgaacccgggaggcagaggttgcagtgagccgagattgtgccactgcactccagcctggcaacaaagctagactccgtctcaaaaaaaaaaaaaaaaaaatgcttgaatctaaagtttcaaaaaattcaatagatttttgaccactgaaaatttttatatattattgagttcattttgtagtttaattcctctagaaagtatgttttttatgtttttaaagcaagtgcctgaaaatatagtaatttttgatatgttttaaaattccttatctgtttgtgattctcttttctttcctaatattgcttatttgtgcctacgttctttttcttaattaagatctttattctttccaatgttcatggcataattgttgaaagtatttaagaaaggcaacctgttttacatgaattattaagtgcatttttgatgggaaaagtttaatttctcagagagccgtgtaatcatttcatttaggctacaactcactagtttttcatattctgattgcaaagcagtaatttactggttttcatattatgttttaatgcattgaattcctttagagtggggctaatgtttgggtattagaatggtacctttttgtttgaataaagattttcatcaagtttttatttgggagaataatttttgaaatacatatcaaatctcagaaaaacttaacatgtaggcatccttaaaggcttttaaaataggaatgaggatcatctacaggaaaccctagtgattagctgtttcatgttttgtgatgtcagatgtaagcagtgaaccaggccagcctatatagctattgctgcagctgcacagtccagctttcttggatttacctaataactaatgatgtctaacgtcttttagtgtgcttaattcgcctttttgtcttttttgttcaaacatttatttaaatctttttgcttatgaggttttttcttttttttcctgatgatttgatactttatgtagtctggatacaagtcctttaacagatgtaggatttaaaaatattttcttggccaggcgcagtggctcatgtctgtaatctcagcactttgggaagccaaggcgggtggatcacctgaggtcaggagttgaagaccagcctggccaacatggcaaaaccccgtctctactaaaaatataaaaattagccgggtgtggtggcgcgctcctgtagtcccagctacttgggaggctgaagcggaagaatcacttgaacccgagaggtggaggttgcagtgagccaggatcgcgccactgcactccagcctgggtgacagagtgagactctgtctcaaaaaaaaaaaaaaaatttttcctctagtctgtgggttatcttttcattctcttaactgtgtctttctaaaagaagagcttttaattttagtgaaatccagtttatcaattttttcttttgtggatcacacctttctgtcatagctaagataactttgctgaactgagggtcagaaaggtatatttcttgttttcctcttgttgtgaaaactgtctgctaaattatctttgtgactttatttaaaaaataaattgagtgtccatttatgtgtgggcctattcccggactcttttctgtttcattatgctctttgtcatctgtctttatactagtacctcactgtcttgattattgtatgtagttttataataggtctttaaaaactttttttaaattttttaaatttttgttcattcattcattcattcattcaatcagtcattcaaacaccaactcaagccagatacaataggtcttaatatcagatggtgtttgccttttagttttatctttttctgatttgtattgagtattctagatgtttgtgtttccatatgaattttattactggcctgacaatttctaaacaaattcagtgttgttttataattttaaatttataagtcgtgcccatcttttgccagattgatacttaatttttttcatttttttttgctattgtaactaataatgtggtttaaaatattaatttccagttgttttttgctagaatatagaaatgtagaatatagaaatatagaattgaattttgtatgttgatgttatattctgcaaccttgttaaacaacatcagattttcaacatagattatcatgttatgtgaaccgaggatagctttgcttctttcattccaatttgaatgcctttgtttctttttcttgccttggtctactggctagaatttccaatatcgtggtgagtagaagtggtgagagaggacatcttgttttgtttctgatattaggggcaatatatttatgctttcaccattaacctatggtgttagcagtaagtttttaatagataattgttatcaggttgaggaaatttccttaatttcctagtttctgacacctttttttttttttttgaaacaaagtttcgctcttgttgccctggctggagtgcaatggcacaatctcggctcaccacagcctctgtctcccaggttcaagcaattctcctgcctcagcctcccgagtagctgggattacaggcatgcaccaccatgcctggctaattttatatttttagtagagacggggtttctccatgttggtcaggttggtctcgaactcccaacctcaggtgatccgcctgcctcggcctcccaaagtgctgggattacaggcgtgagccactgcacccagccatttctgacactttttatcaggaatttacattagacttttgttaagtcctttttctgagtgtattcagataatgtgttttgtaaaattttgtttaaaaaaaattttgtctataggaagaattacattgatttattttttaatgctaagccaatcttggatttctaggataaaccttggttaaccatgatttactatctacattacatatggttgggtttggtttgctaaatttttttataatttttatattggtgttcatgagagatactgttctgtaattttttttcttactatatctttctctggtttgatatccagataatactaactttatagaaagaagtagtccctctaggtttttttgcccagtgtggctacaataggggttggcaaactatggctcatgggtcacatcctaccaaccacctctttttttcatggccagcaagctaagaatgattttccatttttaagttgttacattttaagtgtcatacacacacacacacgcgcgcgcgcgcgcgcgcgcgcgcgcacacacacacacacacacacacacacacacacacacacacacacacacacacacacacacacacacacacacacacaccccccaagtaatagccttgattttgcttgttggcctataaaaccgaaaatatttattaggaaaaagtctgccagtttaattgattttctttcttttttttttaaagaaccagattttagttttcattggtttttatctatttttctttttctccatttcattgatcgtctctctgatctttattacttcgtttcttccacttaattggagtttcatttgctctttttttcttagtttcttagggtagacgctacaatatataatctgcagtaaatctcattctttatatttttcatttcagacattatagttttcatctgtagtagttcaacttgggtatctattaaaattttttctttctttctttcttttttctgagatggagtctcactctgccaccccggctggagttcaaaggcgtgatctcgactcactgcaacctctgcctcttgggttcaagcagttctcctgcctcagcctcctgagtagctgggattacagacgtctgccaccatgcctggctaatttttgtatttttcatagagacagtatttcaccatgttggccaggctggtcttgaactcctgacctcaggtgatctgcctgcctcagcctcccaaagtgctgggattacaggcgtgagccaccgcacctggcctattaaaattttaacatcttttttatatcttccctgtctctaacttttgaacatatgaaatacagtcataataactgttatttctatggtgattctaacatctgtgtcagttttgagttggttttgatagattgatttcactcttctttatgggttgtcttttcttgtttttttgcaagcctggtaacttttgtggattccagacatgaattttaccttgtttgttactagaaggtcttgtataatttacaaatattcttaaattttgttctgggatgtagttatgttattttaaaataatttgatcctattttgtcttttaataattgttaagtgggacctaagcaatgtttggtctggggcacattttcctgctattgaggccaaatccttctgagcattttacccagcatcccatgaattacggttttctagtctggctgataggatcaggaactgtttctacctaatctgtatgaatgccaggtactacttcctctaatccttttagagagttctttccccagcctgagtagttccttatgtgtgtgtgctgatgagtactctgctaattccaaaatggtacctttgcagatttctggaattctctgtcctctacagttctctcttattcaaactctgtcttggtctttttagactcttagctccatttcttcaactcagtgaatgtactggctccatctgcatttcccctccatacactgtggtctggaaactctctgaatgcagtaagctgggacagtcacagggctatcatcatttgttttccttctctggtgatcactgccctttgttgcctgattgcaattttattagatcattgtttaatacatctaacctggattttgagttgtttcaggcaggatggtaaatgtcttggctagaagtggaagtcttatatatctgtatctttggcatggtgaatgtaagaaagcattctgttccctaagtattcagaaaagagactgttcgtgcatattgactcttttctggatggagtttggaaagaatagttctcctgtattttttttttagagtgatttttccagtaattttcttttccagttttttttttcacagttggattagattattaggcaatatggattactaattccattatgttttattagaattagattggaactctttgtggaaagctactgaaaagatcacatgctatttttttcatggctgttttgcctctgatgtttattccaccaatatttgaagaaagagataaaaaggagaacctagacataatctttctattgtcaatttttctatcactaacatatgttctgaaaaaggacattcctgtcctatagtatattgctgccaaaataaatcccaagagattgaagttttattctattttcaaattgtttcctagaaaccagccacctaattcacaaagagattaagagccaagtcttagaaacataactttaaaaaactatataccaggacatgcctcatttgtgaatgtatgcgtgctcataaattgggtaattgtgcacctaactactgtattcattttttattattcgctttgtgcttatacaaatgaaggctttttcattcatattctgtagccttggacactcatgattggaggatagttactttttatgctcctgttcaatgttaatgcgtacaattttacaggaaattataaaatgtctccaattactttggtatagctgtaacaatagctactttattaaacgtgttctgaagtagtgtaggtaattgacagttaatttggctttatcaggttatatagaaaatgttagagaagctataaaaaacctttcgtatcagagtgtttgcctcaaaaggctatgttggctgggcgccgtggctcatacctgtaattcagcactttgggaggttgaggtgggcggatcacttgaggccaggagttttagaccagcctggccaacccaatgaaaccccgtctctactaaaaatgtaaaaaaattagccagggatggtggtgcattcccgtaatcccatctgctcaggaggccgaggcacgagaatcatttgaatctgggaggcagtggttgtggcaagccaagatcccatcactgtactccagcctgggtgacaaatcgagactgtgtcaaaaaaaaaaaaaaaagactgtgttgacatctgaatttaagttctgccaactataatttaaaacttaagttcccttaaactggtcatgatggtaagaatagatagcccagactttttgagattacagctcatctctaaaatgacaaagctcagatataatagtagccttcataaaatttattgccagacactgctaagtacttttacagacatttcctcatttaaatagactttgaaagaaaaatcagctatttaatctttaggacaattttgtaaaaggatcaatatatgtacgtattaatttcctattgctgctttgacaaataccacaaactttatggcttaaaacaacataaatttattctcttaagagttttggaggccagagatctgaattgagtttcactgcactgaaaccaagatgtcaggagggctggattccctagagaagctctaggagagcatctggggtatttttgtttgttcgttcgtttgccttttccagtttctaaaaatgtcttccttgctcatggttgcttcttccatcttcaaagctaacagccacataaccttttcctcttctgtagtaaaatcttcttctaccttcctcttatgaagacacttgttattacaaaatggctcacctagataatccaatctcaaaatccttaattatatattcagagtttcttttgccataaagagtaatattcacagatttcatgattaggttatggatatctttgggagacctttgtttagcctaccacgaaattgtattatgtacatcaaagtggagtacagtatactgccataagtcacataaaaacaaaacaggaacaagcacagtttggaattaagttgaacagagaggttgataatataagtaagagatcttggattgctgttctgtgttccagcttttatattattgactgattgtttttgttgctgatagaaatgaatagaacaatgatcttcaattttttatttttattttttcgagacagggtttcactctgctgcctacactagaatgcagtgacatgatcatagttcattgtaatcttgaactatggttcaaggatggttcaagccatcctccttccttagcttcctgagtagctgggactgcaggcacacaccaccatgtgcccagctaatgttttcatttttgtaatgatgggggattgctgtgttgcccaggctggccatgaactcctgggctcaagtaatcctcctacctgggcctcccaaagtgctgggattataggcatgagtggctacacctggcccaatttttttctaatatgttttatcttctactcttgtctttcttttttctatataagaccaatgcttagtagtctaatgtcatgaattgaaagacagatttacatagtctgatattataattaatttagaaatacattatatttgatgtttgagcatgtccttagacacatgttcagatatgcttcgttattccctttaagccttttctttactttttccttcacttttgttactctcaatgctaatgaataattgacctctttgccactgatcatggtactctggggatgaaagatttttaggaaacagctctagaggtttgttaactcctagaagatcatagatttctgaagtagattaatattttctatttttcgttattatcatttcattgtccatttcactggttaatcctatacctttgaagagaaaattccatttggtactacttttgtgctatatggttcaacaacttatggagtttacagtataaatgttttagaaagtgagcttgtattttgttgcacagtttgaaagctaaatgtttacattatcttccctaaactacaggataccagaaggccctattgatcaggggccagctataggaagagtacgcgttttagaagagcagcttgttaaggccaaagaacagattgaaaattacaagaaacagaccagaaatggtaggtgattatacagtgttttcccctcctcagtatatgggctttagcacagataattgaaagtttccttttatcaaaatgttggaaatgctacaactctctattctttgactacaggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtactattctcctttcacattttatttgggctttagaaaagattataatctaagaatgagaaacagacttgttaatccatctgttgagtggtaaatattaatagcacctacaatatttaagaggcgaagagtacctgaggtcccaaaggatggtaattgccaagtgcagttcatcaaccaaaatataccaccagaaagtattaattaaaatgtatttctagaaatctttacattctaaataaattctgaaggtagtggtgccagccaacaatacattaaaatatctttctataaatgttctttatatataatcagtatttgaagtggagtgtgcagttttgcattgcggtacattggaactcatagtgagtccgatggttacatttctaattcaaacattaaaaactttaaaatagcatttttttaaggatttctaatgaaaggttaacaggattttttttttctttaagtaaaaaggagcattctgttcattgttctttcattagttgctggaaagaggtacctgagatctgcctggttaaatttgtttctcctatgcacacgttgctaaataatatgaagtttatcttccacagaaaagaaaacattttggtgctgttgtattcatgcagaacaaaatgtatctgaaaatcattataaatacagtgaaacctgtctttaggcctgttatatttaaaagtctatgtttccagtaggattctgatggcaattactgtctcattagtgaacaataaaagaaaaattgttgtattagcacaacctactactgtgaagaggaaaagaattaccccatacaagtaagagatttcatatttattaacatcagcagcaatattataatgattttgaaaaattgcttggttgttttaggtgaaattataaataaaaatctgtctattggaatcattttagcattaatgaatctacagaaatatgatagcatggatttcaaggggcagtgaattattaggccacacattggacagactttttgatatatttagcccaacttgcagtcaggccatacttagaccactaaaccaaatgctgactaattctgtcattaatatttctctaccctaaagctgattctaggcacgaagcatctcttaaatggaattttgtgcttgtgttctttgcttatcacagttttttaggccaattcacatctgaagaggatttgacttgggtagactatgctgtatgtaaaggagaattttggccactgacttctgatggaatgtttaattttaagatttgagtaattgggctgggcgtggtggctcatgcctgtaatcccagcactttgggaggctgagataagagatctcttgaagctaggagtttgagaccagcctggccaacatggtgaaaccccgtctctaccaaaaatacaaaaatcagccatgcatggtggcacatgcctgtgatcccagctacttgggaggctgaggcccaaggatcacttgaacctgggaggcagaggttgtggtgagcagagatcatgccactgtactccagcctgggcaacagagcaagactctgtctcaaaaaaaagatttgagtaatcaaataacttgagaatttaattttccagtgtttttaaaaattaattcatatatatatatatatatatatatatatatatatatatatatatgtatgtatatatttatttatttattttttagatgtggaggtctttctatgttacccaggccagtcttgaactcctggtctccagtgatcctccctcgtcagcctcctgtgtagctgggattataggcctgggctaccatgtccagctgaattgaaataattctttaaggaattattttgtaaataataatataatttgtttatataactcgcatatgttttgtgaccatatgtacaaatgaaaagtgaatataagaaatgggcccctgagaaactgatataaatcagttttccattttgttgttgttgttgttgaattatgattccttacagtgccatttagtatgttaaataatggtagttcattgaaaacaaaaatggtaagtaaaggtacccaagtcagtttattttcctgtcttaaacagaaatgacaatgaatctgggacataacttcatagggtagtaatttaactccaggaagccagattagaatgcagtaatacaaataatgagcaaaacacaatcaaacattagagaaataacccttaaactgacggacgtacaaatagaaaggacttttattatgtagaatatacccttttactgaccattttcaagatccttaagtataagaattaaaatcaaaacaaacttttaggtttgcctctggtaatttttatatgatacaaaagtccattttatttttacattggctcaaatgatagtgtataggtttctaggtctgtagctgggaccatggtcagtgaggctgccacctgggtatgggcctgccttcttaaaagagccctcctgagtcttgggctctattagggttttgcagccttctacctgggttagaagattattagcagattattgaacttgagtagttcattgtgggagcccctgatttgacagagtgtgggtaccctggccactttgtacttgcgatggcatgtgaagtggggtgtagtattatggaactgagaggtctgggctaattctgggtagtttgtgtcactacctagttggtgtccacagagatttggagaattatctgatgtggaaaatgcacatatttggtgtcagaagtgttctgtggtgaaaaacagatcataatagtagtagtaatactaagggcagctaaagttgctggtttttgagaactacaactacagactccctgtttctctttgtgagttcaccacgatgcctgtgttgtttcctggtagaaatcgcatttctctgtaggttagtgaccccatcagtgagctgtgggggtaagactcctcctttgttgcccacttgaagctgtttcctagtagtcagggcaccatgtttcctctcctggaatctggctcctgttgttcatcacttgcattaccaggcattaaaatgcagcctgggggccaaatatcataagtttgatctaagattcaactcacctgagatttttagcaaaatactatttatttacctgattggccttgatagctaataactagtagagcctaatctctgcctgcaaccacagttgggtaatcaactggtagtaattagtaatattcttgggcttttagaagcttttacaggctgttttaagaatttagaggtgttgatggtataataaatttagagtagcatattaattattatctgctatattgatatcaagttttagcatcactagatttctaaatgatgatttcattctagtgattgcatatgaccattcttcccagtaatacagttaaatatacttgtagcttttgatatcattgatcatgaattgaccctagcctacctctttgcagtagagagaattaagcggtttagagttagtatttttgccattgtggttttaccatttatcttgtattgtaggttcagtgcttcgatttatggcagtttagatgtgtacctcaacctctaagcatatcatggagtctgtcttatcaacctttcaggctgatgcagagacatgtttaacttaatcactgttgctctgattctttttatcatcttcatattgccaaataccagtttatgaaaagggtaccaaagctgcttctttctgcttttaaaattaccatattttttttaaatttattcatttattttattattttttttaccaagttctgtttatggtaatttataacaattataaaactaaagtacaggagatgagccatttttcaactgtgttgactgaaactattgaaaaacaatctgttaaagtagcaatctcatctcccttacctagtttgcatttctcattatcagtaatatatagggcagctgtgcttagactaaattgtgttctccaaatagtgaatgatacttatgttaattatgctgatttgctaatgtacaaaaagacattgtgggggattatgtaacaaaagaaatgactgtgactcaaggggtacactgggaaagattgatagaatagcttacagattttttttaagtttatgatcatagttgttgttgcccaatagcttgtattttcattctgtttggaaggtccaagaattgatattcccactcttgaaaagttaagtttggtgaaccttcaaaccttctattctttgtgttttatttcatatacacaaaaacagagagagagacagagagaggaagggaggaaggaagatcttactaagttctctgagatgtgatttgattgagacttatattaagctgggatgtggatattctttcttgaatttcggatttgtttcaacaaaatgtttttgtatgattgtcttctaaggaatccaagcttattttcaagtggtgctagaacattcatcttaatattcatgtgcaaagggatacatttctttatgaagtcatccttattctgctcatcacttagtctctatcagccagataatgattcttcatcgcctgtaatggaacagtgtctcctaaaataaagtttgcattagaagaagaatctccaggtggaaaagggtgtttttcatctagtagttctaattctgttttgcttcctacgaccacacatcttttgggtgtgatttccaaacttaagaatgattttagattaaaaataatcacttactaaggatttcttacatgccagtcactatgataaaggttctgcattcattatgttactttatcagcacagtagtcctacaaggtatgcattatttgttcctgtttttttttttgttttgttttctgagacagagtctcgctctgttgccaggctggagtgcagtggtgtgatctcggctcactgcaagctctgcctcccggattcaagcgattctcctgcctcagcctcctgagtatctggaactacaggcacacgccaccatgcccagctgatttttgtatttttagtagagacagggtttcaccatgttggccagaatagtttcgatctcttgaccttgtgatctgcccgccttggcccgtttgtgctaggatgctaggatgacaggcgtgagccaccacgcctggcctatttgttcctctttttttttatttaagatggagtttcgctcttgttgcccaggctggagtgcaatggcacgatctcagctcgctgcaacctctgcctcccgagttcaagcgattatcctgtctcagcctcctgagtagctgggattacagtcgcctgccactacacccagctaattttgtatttttagtagagacagggtttctccatgttggccaggctggtcttgaactcctgatctcaggtgatccgcccaccttggcctcccaaagttgttcctttttgtttttgagatggagtctcgctgtgtcatccaggcagaagtgcagtggcacgatcttggctcactgcaacctccgcctcccaggttcaagcaattctcgtgccccagcctccgggtagctgggactacaggcacacgccaccatgcctggctaattttcatatttttagtagagacgggatttcaccatgttggccaggctggtctcaaacttctgacttcaggtgatccatctactccagcctctcaaagtgctgggattacaggcgtcagccactgcgcctagcttagttccatttttataactgaagttatattcagttctagagaaattaggtggcttaacacaggctaagttaacagaacggttttactccaaaatccgttctcttaattgctaaatacttagcttttctgagctttttctcttctacgtacggggatataattcctatagcacagcattgtgatgattacatgaaggaaaatatataaaatactttacctagtgcgtgacacattatagattctagtaggctctggtcagacctattaatacattaggaaaacttaactcttagaccctgcagagctggcacagataaaggcagattattgaaagactcaataggaaaaatgttaaggcctggaaactaaatgtaagcctagtgaacatcactcaccaaagtaacataattgttgtcttatatatgatagtataagctatttttgttgtcatccttctggagttttccccacctgtgtcagttgtcaagatggtggcatcctaaagttcctccttgagataagggaggcaataaggagctttgttttcttgcctgtctcctggtcacatttttatccttagcattgcttatttttgctgcaggagcaaaccgaagtaaaagcagctttggacaaaactcaagtaatttttcttgcccatgatgcagatttgcccatggatttgactttgagagtaaatcttagtcacatttacccccgtaagtgttaattccttcaccttcttgcctggattccatctctgtgctggcccttagggggagcttctctgtttttttttttttttttgaggcagtgtctctctctgtcacccaggctggagcacagtggtgcaaaaacgacctgggctaaagtgatcctcctgcctcagcctcccgagtagctgggactataggcgtgtgtccctgcagccagctagattttttattttttgtagagagggggacttgccatggtgcccaactcggtcttgaactcctgtgctcaagtgatccttctgccttagcttcccaaaatgctgggattataggcgtgagccaccacgcccgaccaaacttctctcttcaacattttgaatcaggcgtaaacaaaaagccctctttgtgtttggttcctcagtggcatagaggcagactagaagtcttttttttttaatagttttatgactattgaaatagaaaactagagaaattagcagaaaatataaggaacataaaacataaccaatttttgaaatagaggttttaatacctgtcataggtggcttgctttcagagtcataaattctgttctacttggcggggcgcggtggctcatgcctgtaatcctagcactttggggagaccgaggagggtggatcacatgaggctgggagtttgagaccaacctggccaacatggtgaaatcccatctctacaaatacaaaaaaagctcgtcaggcatgtagctcatgcctgtaatcccagctacttgggaaactaacacaggagaattgcttcaacccaggaggcggaggttgcagtgagctgagatcgtgccactgcactctagcttgggcgacagagagagactctgtctcaaaaaacaataacaacaacaacaagttatattctactcggtgtcttcaggcaactttattgtatcctcaaatggccagcactattttgctggtaccttgcctagctttgttatttcccaaaccttgacctggtctcatactaggtctttagtatgcccacttattagatttcttgatatgttcgtagtcaaaaccacaacagccagattccctgctttctgggactcttctaggagatctggtttcagggtagagttactgaaaacccagggcttctgcagaatggttttgagtcactatggttcccttgctgatttgattatcttcttgtctttgaccaaaaaataaatactgcaggatgataactttcaaatataattgaatcagtaaagaactagtttgaatttaaggttgtatcctggacttaattgtcttgcttacatggtctccaacagagaggccgagaaacaaaagattttaaaaacaagcttaattttagtggatcatgaagttacagtaacttatattgataccctaactgcattatcacaaaacattagtgtactctttttttttttttttatttgatgtttggtcttctagttgcttggttattctgctttctaggtagagacagatgaatgtgaataattaattgccaagacttagtactgatgtaaacttggtaaaaacattgacataaactaatttattaaaaaaagtagagatcagctttcattcacaatggtaaaggaatgtcttgattcctatgacaagaaagcataaaccatgctaatgcttatatttcaaggcactcttctctctaaattagacctaatgcagtttttacctccttgaggctatatgatgattgtcaatgaaatgtaatgctttttgtttctgtatctgttcctgtgcattcgtgcacccatgtgcatgtgtgtagtgacacatttgacgtaaaactgagagcatattgaatttccttttttccttcaacagacatttgctgataaactggttattccattgtatgacatctccagcacgatactgttatttaaaactgagacttgcgcctgcgcagtggctcacacctgtaatcctagcactttgggaggccagtcacctgaggtcaggagttcaagacaagcctgaccaacatggtgaaaccctgtcaatactataaacagaaaaaattagccgggtgtggtggtgcatgcctgtaatcccagctatttgggaggctgaggcaggagaatcacttgaacctgggaggcggaggttgcagtgagctgagattgtgtgactgcacttcagcctgggcaacaagagtgaaactctgtcataaataaataaataaataaataaataaataaatgtaaagttgagacttgcaacaagttttgtgattactcctatttgataggtaggaaaaaacaaatgaccacattctattatgatgaaacctatgaaatataaagaataatgagtgtgatgagggtgatgggaaagaggcttatgaaactgagaatatgttttaaatgaagttttagccgagccctatagccctattatagttaaagacttttgtgtttccatgagcaactcacaatttcatacagatagtgactttccccctcagtaactataaaaaaatactgtagtctacataatagtccatagaggactcagttttataatctgaaaaaactttgaagttgaaactttgcctagtctaaagacttcaggttaatttctgcattgtaggtttggtttttgcagccaaagtctctttcatgaaaagaaaatgttttgaatcctagctgagaataacaaataagaaaatggacaaggcatcacatattggcctcttgcctgttttaaaagggtgaaaatggaagtagataagctgcaaagtgtcctgtgtgtgatgaatgttgacacatgaaacaaatgtctaaagtgcttcacaaatggaactgttgttccaaagcatcgttcaaagttgttccactattaatttaggatgaatagtctaaatggtggctaagatttttaatttttaattgaattaatagtttcactttattcaaaaggggctattatcacgtattctctgttaatcatgtgtacttctaatggctttctgtgatagtaaataagactttcctgtgggctgccattgcatttttgctaaataatttagcatctagttaagaatcaggaataaaagagtactaagactgtgtcacaagcaaatcacagttgttgagggcatatttcaccatctcttaagtgattccttctcattgatcaatcccccttcttcagggtgttatatggaactcaatattggatcatttttataattgattatcaataccacgtgttactgttacccacatctaatggctccttcctcttggtagtagaattattagtaggtactcttcagacacagtgtaaaagctcagaaacaactctctgaggacctctagcattaaaaaaaaaaaatagcggctaccacatgtattactattttgtgtgtattttttaaagagctttagagaaggtcttttgatactttgtctcagagatgtcaaaataattttcctaggacacaaaattagtaggagatagaaccaaaattgagaaattggtatgtctggctcccaaagctctctcctctgattcagactttctgatttttggatatttacattgaggagaggacacattattgtgctctggacctcctactttgatatttgttagtgtagtaattagaagcctggactttaaaattcattgcttgggtttgatttcctactctgacatttctgaggtttgtgactttgagcaaattatttaacctctcagtgcctgccatttcttacctagtttgtaagattattgtgagattaaatgaaataatgtaaagcacttagaataggtgtacctatttattgttgttcttttttatttattgtaatacatcagttttctctaagtactcttggaatctccagctaatgctttatgtttttagttaatacagtcattgtaagtgatttctagatgtgtaatttttctgacaatataaatacatttctgactttataattttcataagcaaataatccataatcttaagcatgccagaggagttaatacaaagtgttgagaagggatgaagctggagctacacctgggtaaggattattccccaaacctgtctaccatcaaactggatttgtaaaagataaaaattatcaccgttatctcattatataaactcttgaaggtttttcttttgctactttttcattcatctaaagatatttatcgaatattttgtctgtgacatgcactgttccacatgctgattttaaataacaaaaaacaaaaaaataaaagaagcaaccaaaaaaaagttcattcttttggagcttaaattctagtagggcagaaagataagaagtaagtaatattgtatattggaaaatgataactgcttagaaaaaaaaaataagcagggaaggagtgttagcagcagtgaatccatacgggcctgcagcagctcgattcttgcttccttggaggaaataatttggccaggggaacataaggcagagtgagagatcaaggcaagttttagaacaggcatgagagtttattaaaatgttttagagcaggaatgaaaggaagtaaagtacacttgtaagaggccaagcgggcgacttgagagggtcaagtgtgctgtctgaccattgacttgggcctgtatatattgctatggttccggggtttgcatttcttcttacctgatttttccttggggcaggctgtctgcatgagcaatggcctgccagcacttgggagggatcgcatatgcagtgtgtttactgaagttgtgcacatgctcatttgaggctttttttccttaccagttgagtgttcctagaggaaggtcatataacagttaaagtctgccattttgcctcttagtacgcgtttgagccaactcacacaactcttgaaaacttatcaggaagctgctgatgaccagcttcagttgttttctatctatttaggagactgccgttccctggcaccagctgtgactagttaaattattttagagagatactttaacaactgcctgaccatcacctgatggtcgcctgacattgcttggaggttaagggggtgccttcttctgccctcttaagtctgcctagctacctactcaaacaggaggagagggaaaaccaagggttgagggtgataggcgggagtgttggatttttaagtgggataatctgggaaaaccttatgaagatggtgacattagagcaaagatttcaaggtcatttagatgagccatgtgaatagatatctgagaaaagagcattccagggcagggaggatcaaatagaaaagctctggagtaggaatatacctggcagtgtcaggggttagcaacaagaccagtgtgactgaaatagagaaatcaagaaggatggtagtgggagatgagatcaaagtgagccatattgggtggggtcttttaggtcaaagtagtaattttggctttgactctgagctgaggagccaattcatgttaagaacaaagtagtaacattatttgttgatgttgtaacaggatctagctgatatattgagaacagactttagatgtaggcaatggtggaagcagggagaccttgttaggaggttgttgtaatccaggtgagagaagatggtgtctcagttggtaaaagtgctggtggtgatatgtgaaaaattagaaattagctataaatttgctgacagatttgtaggggatgttagacaaacagagactcttgctttttacttttctttcttgctaaatgcaagtcataatttttatttaatgcaatataaataaaaccatttgtagcagccctaaagtttctctttttagtttactggagattttactttactctgcaggtaatccagcatgttgtaattgaaattactgatgctacacagaatgggaattactgatgctaaataatcattttattagtttagaccaggactcagcaaattatggcccagagaccaaatctggctcattgcctgtttttataaataaagttttattcaaacacagccacacctattcatttgcatattatctatggcagctttctgctacaaaggcaaaggatcttagagatctgtagagactaaaatatttactgtctggcccgttaatgaaaaaatttgctgacccttggtttatactgttaagagttgtgtaaaaattttcctctgatctttttccagtcactcagagtgtttaaatatgaagagaaaaattaaaagggggcatgaaatgatagtagagagaaccaagaggtactaatactaacgtcaacttctttctctatgttaatttactcatttgtttgctttgcgtattcactttcctccacatctttgtagtgctttgtctgtgttgagaaacaagtgcagctgactagcttgaacaaaaaaagtatattttctcaacagtgaaaatttactataggaatgactattggattttaagagactaatttttgaattgcacaaccttgatagaaaataaaagatgagtaccagtgtcaatgcgagcatcaatctttatgaggaatctggcattcttcttaagactttgtgtaatccagtgaagcagtacagacaagttcgatctccattgttgtttgttttaacaggtctataatgacggatctatactacctcagtcagacagatggagcaggtgattggcgggaaaaagaggccaaagatctgacagaactggttcagcggagaataacatatcttcaggtaagaaggttgggttaagaataaatttgagtgaaaaaaagaaggatcataatataactaagagtaataatttcagttgtttttagtcttcctggcccttgaaaatcagtactcacacattttacatatttattcagaaagacactgtgttatgccttgagtggaatacaaagatggctaaaacaaagaccctgtcctaaagggagctacttcttacacacgtacacacacacacacacacacacacacacaatacaatacaaatataacatcttacattttataggagagaaatagatgaaatgcttattggagttttgagtaaggagacatcagggatagtcttgtagagaatgtattgtttgaagtaaactgtaaaagatagttaaataggatttggacacacagaaatgaaggaaaagaatgtaccagctggaggttatcagctaagcagtggctcgtaactgggaaagaacagtacaggaacccatatgataagtgtggcagttcagtttgtctggaattttaggttgtgtgaaaggagggatggagaataagttggaaaggtaggcttggaaacagattacagaggttaaggtttatggtacataggcagtaaggggtcactgaaagattttacttatttgttttataaatgttattataacaaatagaaagtattggtaaacatcaagtctcagaccctttaaaattaatttcactttgttttttgtgttcttttctagttcttattaatatgtacacaccgtcttacatatatgtaagaaaataatttatttttgattttgtttttctgcttaatatgccataagcatttttctattttggagtcacaacctgcttttgaaatgttttacatacaaaagtggtatgagagtggtacttaagtgatattaatctgaaactagtattttagttgaacttgattatttgaagagactagaagcagggagaccatttaagataagaggaccatagtgcaggtaagaagtattaaggtatgtggcagtttgctttggaagtgaagagacaaatttgagagagattgggaagataaaattgataggcctttccaagtagatgaaagaactgaaatggctgggataatggggacatcattatctgataaggtgctgagggacagaatagttttcaggggaaaacaatgagtcagtagaatcttcaaatctcaaaatgtttgaagttgaaatgaccttggaacatcctccaccctcatccttttctaatgctgtggatggcatactgtgtacgctctactttccctgtaaaattaaagtattgtataaaagcaaaatgacagccagtgatatggttctgtatattttaaggtgcacatttttctacacttaaataggaaaaaatagaaaatcaagtgtttaaagagatcattaaaaaccaaactgatcttggcatgctatcttggtctcatacccacatggccattcatcagaggtgtctgcagaatgagaaacacttcacctcctgtagggaagaggtaattatctcctatcaactagaacctcactcagtgaactataaacagctggtggtgcagaaccatcatccttatttaaaatggaaataactgtggtttctgagcttcctccatttcctcttattcgttaaattttcaccaactatatctggtgatagttctaaactatgatctagtgatagttcagctacctaaactgtaacaagtacctgccacctgttttagtttccttttttttttcctcttggtttgtgggtggccaagtgctttcacctgtagtactaatttgatcctctatatgctgatttttgtggttccgtattagagaatttcatttgcaaatcatgctaataatttaaagctacattggctttttaaatcttttaaactatagcaaaacctagcactttacttggaccttaccttcagtttcagatattgctatttaactttactttcatgcttttcctttttccccccattggaaggaaaaggtgatttttttttttaattttcaaggagatagggacaatctcagtagaaaaaaagtgctttggaaaaatatttttctttttttcataggttgttggagtacaggtggtatttgattacatgttctttagtggtgcttggtgagatttctgtgtgcccatcacctgagcagtatacactgcaccctatttgtagtctttcatcgctcgctcccctcccacccgtccctccaagtccccaaagttcattgtatcattcttatgcctttgtgtcctcattagcttagctcccacatatcagtgagaacatatggtatttggttttctattcctgagttacttcactcagaataatagtctccaatctcatggaagtcgctgcaaatgtcgttaattcattcctttttatggccaaatagtattccactctgcatatacatatacatatacacatacatatacatatgccacaatttctttattcactcgttgattgacgggcatttgggttggttccacaattttgcatttgcgaactgtgctgctataaacatgcatgtgcaagtatctttttcatgtaacgactccttttactgggtagatacccagtagtgggattgctggatcaaatggtagctctacttttagttctttaagaatctccacactgttttccctagtggctgtgctagttacattcccaccagcagtgtagaagtgttctctgatcaccgcatccaggccaaacatctactgttttttgattttttgataatagccattcttgcaggagtaaggtggtattgcactgtggttttgatttacgtttccctgatcattagtgatgttgagcattttttcatgtttgttggccatttgtatatcgtcttttgagaattgtctattcatagccttagcccactttttggtgggattttttttttcttactggtttgagttctttgtagattctgtgtattagtcctttgtcagatgcagactttgcaaagattttctcctgctctgtgggttgtgtgtttactctgctgactgttccttttgctgtgcaaaaactctttagtttaattacctctgagctatttatctttgtttttattgcatttgcttttgggttcttgattatgaaatccttggctatgccagtgtctagaagggttcttccaatgttatcttctagaatttatatagtttcaggtctcagatttaagtccttattccatcttgagttgatttttgtataaggtgagagatgaggattcagtttcattctcctacatgtggctagccaattatcccggcaccatttgttgaaaagggtgtcctttgctctcccctctcccctctcccctccccccccccgtctccccagggtctccctctccctctctttccacggtctccctctgatgctgagccgaagctggactgtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcctgaggtgcctggattgcagacggagtctcgttcactcagtgctcagtggtgcccaggctggagtgcagtggcgtgatctcggctcgctacaacctccacctcccagccgcctgccttggcctcccaaagtgccgagattgcagcctctgcctggccgccaccccgtctgggatgtgaggagcccctctgcctggctgcccagtctggaaagtgaggagcgtctctgcccagccgccatcccatctaggaagtgaggagcgcctcttcccggccaccatcccatctaggaagtgaggagcgtctctgcccggccgcccatcgtctgagatgtggggagcgcctctgccccgccgccccgtctgggatgtgaggagcgcctctgcccggccacgaccccgtctgggaggtgaggagcgtctctgcccggctgccccatctgagaagtgaggagaccctctgccaggcagccgccccgtctgagaagtgaggagcccctccgcccggcagccaccccgtctgagaagtgaggagcgtctccgcccggcagccaccctgtccgggagggaggtggggggtcagcccccactcggccagctgccctgtccaggagggaggtgggggtcagcccccgcccggccagctgccccgtccgggagggaggtggggggtcagcccctgcccggctagccgccccatccgggaggtgaggggcgcctctgcccggccaccgctactgggaagtgaggagcccctctgcccggccaccacccggtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagcgttaaatggattaagggcggtgcaagatgtgctttgttaaacagatgcttgaaggcaacatgctcgttaagagtcatcaccactccctaatctcaagtatccagggacacaaacactgcggaaggctgcagggtcctctgcctaggaaaaccagagacctttgttcacttgtttatctgtggaccttccctccactattgtcctatgaccctgccaaatccccctctgcgagaaacacccaagaatgatcaattaaaaaaaaaaaaaaaaaaaagaaaagggtgtcctttccccacttgtttgctttgttgaagatcagttggctgtaagtttttggctgtaaataaatttctgagttctctattctgttgcattggtctatgtgcctatttttataccagtaccatgccattttggtgactatggctttatagtataatttgaaatcaggtagtgtgatgcctccagatttattctttttgcttagtcttgctttgactatgcggactcttttttggttccatatgaattttagaattgttttttctaattctgtgaagaatgatggcggtattttgatggggattgcattgaatttgtagattgcatttggcagtatggtcattttcacaatgttgattctgcccatccatgaacatgggatgcgtttccatttgtttgtgtcatctatgatttctttcagcactattttgtagttctccttgtagaggtcttttgcctcctcggttaggtatattcctaagtattttattttatttttattttttgcggcttttataaaaggggttgagttcttgaattgagtctctgcttggtcgctgttggtgtatagagaagagctactgatttgtgtatgttaatgttgtttccgtaaactctactgaattcttcctcagttctagcagctttttgaaagaatctttagggtttttgaggtaaatgatcatatcgtcagcaaacagtgacggtttgacttcctctttaccgatttggatgccctttctttctcttgtctgattgctctggctaggacttccagtactgtgccaaagaggagtggtgagagcgggcatccttgtcttattctaattctcacagggaatgctttcaacttttccccatttagtattatgttggctgtgggtttgtcatagcttttattacactgaggtatgtcccttgtatgccaattttgctgagaattttagtcataaagcgatgctggattttgttgagtgctttttctgcatctattgaaatggtcatgcaatttttgttttcaattctttttatgtggtgtatgacatttattgacttgcgtatattaaaccatccctgcatccctggtatgaaacccacttgaacatggtggattatctttttgatatgttgttggatttggctagctagtattttgttaaggattttagtgtctattttcatcagagatactggtctgtagttttctttttcagttaatgtcctttcctggttttggtattagggtgatgctggcttcatagaatgaattagggagggttccctctttctctgtcttgtggactagtatcgaaaggattggtaccaattcttcctttaaatgtctggtagaattcagctgtgaatccatttggtcctggactttttttttttgttggtaactttttaattaccatttcaatcttgttgcttgttattgttctgttcagggtatctaattcttcctgatttaagctaggagggttgtatttttccaggaatttatccatctcctctaggttttctagtttatgtgcataaaggtgctcatagtagccttgaatgatcttttgtatttctgtggtgtcagttgtagtatctcctgttttgtttcttattgaggttatttggattttttctcttcttttcttggctaatcttgccaatgatctatcaattttatttatctgttcaaagaacctgctttttgtttcatttatcttttgtattttttttttgtttgtttccatttcatttagttttgctctgattttggttatttcctttcttctgctgggtttgggtttggtttgttcttgtttctctagttccttgaggtgtgacctcagaatgtcagtttgtactctttcagtctttgtgatgtaggcatttagggctatgaactttcctcttagcaccacctttgccatatcccagaggttatggtaggatttgtcgttactgtcattcagttcaaagaatttttaaatttccatgttgattttgtttttgacccagtgatcattcaggagcaggtaatttaatttccatgtgtttgcatggttttaaaggttccagttggagttgatttctagtttacagtcatatatagctcagttgtgagaagaagtttggtctcaattttattaacctgtatattggttttacttgagaggagcaatttcacaggacataatggaaaattgaaaaggcactttgggcaactagagtttagtgggacaaagttcatagttgtcaaaatcattttctctttagagttgaaggcagtatggcatggtttacaaagattaaactgattaaaagattataatactcggattgaagacaaccctaatagacaagtatgctatcaggctcaaatagaatggatcaagcaaatcttgtaagggctttagtcttttactgtatatgtttatctaaaaagttttttcccgcaaagtgaacatataatattgggttgtattaaatgccattttgtcctggtcttactcttgtgttatataatcataacattgagaaaatgctattgtttctatttctgtagtttctgatgaagtccatttttaaaactgcacgttgctgatatatattcattatgagtccacattttaccataatataagtcattttcctagacttttgggtgattttatgtggaagagattatctttagaaaatttatgttgcgatttctgatgagctcatgttaaacaggcacgatgagtgagatctgtatacttcaagccttagttttttaacttgtttggagcagttggaagttggcagttctcatgtaaagtgctgctagttagagcaaatagcctctgcagaaggatatctccgagtttaacttgaaattatctgtctctgatatacgaaaatggattttgttttctgcatagccccaaagttgatattttaagcaaaattaagcccatttcaggtgaataaagtatgtaaaaagaaataacagtaaagatttatttatatttatttatttattttgtggagatgggatctccctattgttgcagtctgcttagtccctagctcagctaggtctgagttcttgttccacaaccaagaagaataaggcgtgtggacaccagagagtgagtagagtaggatttcttaagcaaaaggaaaggtctcagcaaacagaggggccctgaaagcaggttgccagaaacgggacttacttctggtcttttgtgtggcagaagccaggaagtcgtcgtggattttgcccaaataggagaggtaaagctccctcctaggggtgttgcatctgcccacgcttggagttggccagagtgacttcatcttggtattactcatgagtgcctaagccaaacccacaggtgctaaaaccacaaagttaatgtcatgttaatgacataatgagcttggtcaagttaacaacatttaggttgatttattgcacctgcgcctaagttgggtcagtcgtttctgagcaacaccctggcacaaggtgaagttcgtaaccacatttcttctggttagctgcagaagcagtgtaggtgctgtcctacagttgttcctgtgaacattgtccttctcccaagaccctccgtctctatctgcctaaccagcccctaactgcctcctctctcactgtgttgcccaggctggtctcaaacttctgagctcaagcagtcctcctgcctcagcttcccaaagtgttgcaatcacaggcgtgagccactgtgtccggccagaaagattttttggtttgcccccgtgttttgcttgctttggtttatgttttgaataggacttttactggaaattggtagattatttttcttttttttttgagagaaagagaggaaaaaaggtgtgaaaatggaaaacaactatttcactttttaaatgaggatagggattttttttcattcaaaaataagttttattggagaaatagaaaacttctccagtgacagtatatgatcctttggaataaggggaatgttaatgctggggatacattattgaggctattaaacatacatttcagcttatggaacccctcactccaacacaggatttgcctgatctcatttttctttgacaggactaattcgttaagatagatttaaagccagaatataactatatacgttatttatgtgcttgtatactgactctgagatcaaattaatcatcacatattcttagagttgtgaattgtgttctaccaagtaattcagattgcatttgtatttccgcctaaccaaaataaagccagaagtggtaatatctgtaactcattagaaaaagttgtcagcctaactacattaaaatatttgctaaatatttaatacaactgggatgggcagaaaccttcagagcttttccctatttgaaagaaatttttagtttaagaggaaaccatctaggaaaaagcaggcagtttctcagaagtaaaacctaagagtatactgagaaagaaaataccttttccaagataaaaaaaaaaatgaacaacttgactaaggacagaacaagaagtggtagtggatatagtggcatgggtagatttcatgaagtagcagaggggattgctatactggaagttgactaaggacataggctggtgataggaagtaaagaagaaaatttattgaaggaagttttctaagcattattaaaaacaactttatcttgaattcttacagattttacagagctcttgcttgtgggagcgtaggtccaattgaatagttcattggtgcattcattccttaagtatttggatatactgggcattaggtacattgctggtgatatagtcataaatcaaatagacatagtgtctgcccttaggaagtttaaagtctagtagcttaaacttcctgtgagtattgtcttcaaatccagacacacacacacacacacacacacacacacttttgaaacttccctacaattctttgttttgatagttatatttctgatactttttttggatctttctactatttcccatatctctggtacactaagttttcctatgggctccttcgtcattcctttttagaaaacttttattatggaaaactttaacatgtataaaaataagagctggtggacccttttgtcctcatcacccagctttatgatcagttttgtttcatctgtactaccagtgctacttaccatctctaggttcattttgaagcaaatcccagacattttataatttcatttgtatttatttcagtatgaatttctaaaagatagtttttcaaaacgtaactacattctattttacacctaagtaaattaagaatcattgtttaaaatcatcaaataaccagttgttgatcaagtttccccaactgccaaatacattttaatgtgccatttaaaaaatgattatgaatcatcacaggagcaatttgattgtaagctctgcatatactttttcttcctggaatggaaaaatgagagaagtgaatggtcagaagaaaaattagtgtggcctgacttgaaataaagaaataaagcaataaagaaataaatacaagcaaatgatgatagaataacttagaagaatgcaaaaactaaaagcaaaattaagatgaagaaaaataaaaggaccaaaccaatggatctaagaagaaaagaaaaaaaaaatgctacagtcatctcaagtgaaaaagcagatggtaaatactagagccagttttataaaattatagttatgatattgattttttaaattattacttagttgaatttctccagctaacagcttctatttctcttaagcgtttaacattcttggtcaaaatacataatatttttggaacatatttttaatgtaattgttatttaatgccttcctaaataatgataatgtgaacttaaactctttattgactttcatacaaaagtagaaatctgtcaacagtatttactcatattattttatttaatttgaagataagaacttggaagaataacatcatatttgtgttctctaacataatacttcatttagctttaaagaatttcccccaaaacaaagtgctacattagagagtattaacatagaatggatataaataaatgagttaatgagtaaatgaattatcaatgtaacactaagagaactgatatattatggtacctttgattctgtgctatactccagagcctggaacagtgcctagcataattataaatactccataaatatttttgtatgaataaattaaaaacctaacttgaattgactatagaaaggcatttaaaacaaaagaaaaatagaaccagatgtttaacacaaatatgaaggcttactgatgacttaaactcaagggtaatctctttatcatttggcagtagtttctttttctttttttcttctacagccttattgagatatagttgacacaaaataaacggcacatatttagagtatacaatttgttaagttttgacgtatacagacacccatgaaaccatcaccacaatcaagatagtgaacttatttaacactctgaagtgtgctcatgtccgtttgtgtttcctccaccacttcccaccttcatccacaggtttaactcagatctgctttctatcattatagatgagtttgtgtttcgtagaattgtatataaatggagacctacagtacatactattttgtctggcttcttttactcagcgtaattattttgacgttcatctatgttgtatgtattaataatttgttattcttaattactgactggtattctattatatggttatgccaaaatttacttatttgcctgttgatgaacacttggttgtttccactttggggctgttataaataaactgttgtgaatatttatgtacaagcctttctgtgggcatatacttccatttttcttggctaaatacctaggagtggaatggctgggtcgtataacagtgtaggtttaactttttaagaaactgtttgaactgtttacaaaagtgattgtgccattttatattttcatccagcagtgtctgagacttttagttctcatataccctaactaacactttgtatggttatcttttaaattttagctattttagtgtatgtgtaggggtatgtcatggtttttttttgtgtgtatgtggttttttttttttcattttcctgtaagtattgttgaatatcttttcatatgcatattttcatctgcatatcatctttggtgaaatgtctgcttaaatcttctgcctattttttaattgggatgtttgctttcttcttattgagttaaggttctttatatatattctagatatgagtcctttgtctgatgtgtgttttggaaatttttgtttggaaattctagtttgcagcttgccttctaattttcttaacagtgtcttttgaaaggcaaaagtttttaattttgacaaagttcagtttattaagtttttaaatttatgcttttgtatttcgtatttatgaaatttttgtgaagcctaaggtgactagaattttttctggtttcttctaggaattgtataattttagctcttacatttaggtctaagatccattttgaggaatcacgtaaactaagaattgaggttcatttttttgcatatagctattcaattggtctagaatcattttttcaaagattatgtctttcctattagttgctttagaacttttatcaaaaatcaattgactgctgggcgcagtggctcatgcctgtaatctcagcattttgggagtctgaggtgggtggatcacttgaggccaagagtttgagaccagcctggccaacatggtaaaactccgtctctactaaaaatacaaaaattagccaggcgtggtggcgcacacctacaatcccagctacttgggaggctgaggcaggagaatctcttgaacccaggaggcggaggctgcagtgagccaagatggtgtcactgcactccagcctgggtgacagagtgagactccgtctcaaaaaaaaaaaaaaaaaaaaaatcaattgaccatacatgtgtgtcatgtgtgtctgtctttctgttagtaccacactgtcttggttactagctttgtagtaagtgttacaactgggtagtgtgatttatcgttctttttttgaaattttgttcattatatgttctttgcattttcatttaaattttagaatcaacttgtctgtgtgttgctagcacatagaaatacaattgattttttatatattgatcttgcatcttgccagtttgtcaaactcacctggtgcttttttgtagatttcatcagagtttctacataaagtatcatgtcatctacatatagatacacttacttcttcatttccaatatggattctagttggcagtagtctctttgagtcattaatcttaattaaatagtacagtttactattaggataacttacagtaagccacaaattaattcctccttcatttaaaactaaaatccttaccaaagtccaaatttcagcttttaggttttcttagcaagagttttaaaatattttgagattcctaatggtaatgaaggaatttttttaattcctgagagtacactcactaagctgacagcattttgacatttttcagtttacatatttttatatattcaaattctcttaattatcaataataaaaggctttcacaacatcattccttattgagggtataaaagggaatacatatttaggtcattaacatctgtgacctggaaataaaattgacagattctggcccagcgtggtggctcacgcctgtaatcccagcactttgggaggccgaggcaggcgggtcacgaggtcaggagatcgagaccatcctggctaacatggtgaaaccctgtctctactaaaaatacaaaagattagccgggcgtggtggcgggcacctgtagtctcagctactcaggaggctgaggcaggagaatggcgtgaacctgggaggcggagcttgcagtgagcagagatcatgccactgcactgcagcctgggcgacagagcgagactccgtctttaaaaaaaaaatacacacacacacacacacacacacacacacacacacacacacacacacaccagattccattctagatgctattccttaactcatttaatccttgagagtagcaacacccagtagaggttttatccttttaactttcttgaatatacgttgaacttaaattcaaatttctttaatttaggtatatcagcccaatatgtacttgttttaaagttatttcgaaagtaattttctctttctagaaatatgcctcatttttttcaagaaatggcaggtttcgctatagttcgactctgatctaagtcacaatacagttctagaaacaattttccaaatcttaaagcaggtctggtttccacatagaaatagagtaataatggaagttctgattgtaactaccaagactcaagatggaatttcttcttccataatagtggtatgagttccagcgaagcaagaattagggagtagcaagacgcctatgaagggaatacgtaggctcttgagcagaggcagattcaggtttgggggagtcacctgaaacctattcaacttctggtgctgtctttatgaaaaggaatacaaaatattaaatgtttacaattggctgtcattattcatgttatatatatatatttttttttttgagacggagtctcactctgtcacccaggctggagtgtagtggtgtgatctccgctcactgcaagctccacctcccaggttcatgccattatcctgcctcagcctcccgactagctgggactacaggcgcccaccaccgcctcccgggttcacgccattctcctgcctcagcctcccgagtggctggttctgcaggcgcccatcaccatgcccagctaatttttttgtattttttagtagagacggggtttcaccgtgttagccaggatggtctcgatctcctgacctcgtgatccgcctgcctcggcctcccaaagtgctgggattacaggtgtgagccaccgcgcccggccaattatattctttaatactgaattagcaatagtgaaccactattcctaggggaaatacagagttaggttcctgtgagatcaacattttcatcaactgattaacatatataaccttgttttatgtgtgtttctatttcaagaaaccttatttaatgtatattgttgatttattaacatggataactcatatgtgaacaaagcttatctgacatacatactttctctgtaaagcacacacagctttcttgcccttagggacactggacagcacttcactactatgtttgggggccattttcaacagtgaaatcactggaaaaaaagcacaaaaatgagaaaaacagctaaatatactgcagaaaggacatttgtttatagtaagagatttgaaacaagaaggcaaaaagccaccttggctgaaattacgtgccttggagtactcaaaattttcattgcacgtgtgcatgaatgaccgtgaaagcaccacaagtattgatttgggtgttacaaataaattctagttggtaaattcacatggaatctgtgaatagtgaggattgactccaggatgaaaaaagaactcctaacaagttacaattgtataaagctgacaaatgccacaaatactaaaccccagaaaaataatttttaattaactgcttgatgctctctataatactgttttcccttacatttcttagctgcataccctttgattgtatgacagtgatttgtaatgttttctgtaaagagaattgagaatgactttgtaatattaatattgtctataaagagaatggaaaatctgaaaagatttttttctctagcatggttgatttaaaatgttgtttttaaattattgatatttgtggtacataacatttgaaacttcacatacatacatacttcatatttgtagtactgctgtaagcttgtgccgtttagacaggatttcagataattttattttatgtgattctcatcagaaaaggaaaaaatggttcatataattgcttgtgctacatttttaattgtctacactacattttcaagactattagtgacagaagagaacttctattttgactaggcatcattgagaaatgcctccttcatttctgttattaccttgtacttaccatgctaggaaccatgggacacattcatatcacagtgcaatctctcaccctgtatctatttatgtgacaaaaatatctctgcacaaaagcaactgtgaactacataaatatatctctaaatccaaactaaatagttctcagcttaatttctccatcacaggatcccagaaatgcagatggccactttatttgctacccaacactaataccgacgctggaaaactgagatggcaccgaatcctgagagacagatatcttaacttatttaacttaactcatttaactcatgatggtgaaattttacaaaaacacatccaggtaacatagcacaagcctctcccagggcctttgaagggaaccgtgcaagcaagggtcccttaagcttacatttcagcaaatctcctaaggaagctcttcccattgaactaggagggcacctcaagttcctaaggggttctcagtcctgctcccaagataggagattacttgagaaaaccaacattaagaaacctgaaatagagaaagctatattgcaaaattagatgaaaggtaatagatgctgaccctttaagattgagttctgtctctaatacaaagatataacagagaatgtccagattgcctctagttaaaattttgttttaatttaatactagaacagcagctttccattaaaaagtgctaacctctgactaggactcactttccatctctccttagagcctgcagcactttctcagattgaccagcctacaattgtgtatcaactgcttgtttactaactgccaagaacctttgtgtaagtcagccataccctaggtgtgagtgttggttatggcagaccataactgagcagcctttccaatgacttttttttttttggtctctgttcagtaaccttcactgcctcctcttcctctatccctcccctctaattgcctagctaagggtagattaccaaatgagaatctaacatcaagtaagttgtagatatggctcattgataagtcataaatgcatacaaatacatctctgtgcaattgattaaaacatatggataagctctgaccctgaaaaatgaacatgataattctcacacattaaatattgttctgtggtaggttgtctaaaaaagtatttggatgtttgtgtacttggattatgcaaattcatgtatcataaatttgacctatctaaacctaaaataccaattgtgataagtaatttaacaggagtgatgtatgtgatttgcatagcttgtatcacttgaaaaacttctctgtgaaaggttcgcactgatttcttttctatagaaaattgtgacattctagtcattacagtgatgttatactaggctcaaggcttaggtcagttgtatttgatagatgataaaatacccagatcactcaaggtcttattaaagtcctttggttgtgatagggagcaggtgtttcttcttgttcctctagtatgttaaagtacattaaaggaagctgtgaggttgaagaacatttgtaagctgccatttctgagcactttctgtatgcttagtattatgcaaagtaactcttatgatgcaggtgttgtaatgttcaatatgcaggagagtaaattgagacttagagaggtttgtacttatctttgtctttaatgatagtatgagaggtgatttttctttctctgggttataaaaacttgaacttaatagtgatagaatgtagaattatgtgctaagtagattaaaactgataatcagaggtatgggtagaaagcctgacattttacagttgaagtattaaacacatcctaacctgtccattacacctatgggacatcttctttccagcttataggaaatgagtaatagttgctcttaaattttgttccatatatagtagaggtatcctggaagattcaaaatatatttatgatctaagtaaatgttgtcaggaaaatttcagttttagcagatcagacattaggaaaatattgctactagtgtgaatagaaagtaatgtggacattggagaatttccttaggtttactgaggacctaaatgtatgtgtctcattaaaggttaaaaaaaaaaaagaagtctcagaagttatattaaagcaaaatacaaaatggaacaagaccttggggttttgcttagggagcatatatttctgcccactttgttggaggttgctcttcctttttgccaccatgtttttacagattttattggcctagaccagaggtcagcaaactaccacccttaggccaaatccaacccaactgtttttgtaaataaagttttgttggagcataactatgttcatttgtttgtatatcatctactttcaggctacagttgcaaagttgaataattttgacagaaaatgtacagcctgcaaagccaaagatatttactgtctcctcctttacagaacaactttactgaccctggcctagacagtgatgaaaataattcttaaatgtttttcctcctattttccttttcttcctcttcctgttccttctattcctttagctatatatgaactcttgttggtattccaggtgtcagctttctgagcatatgcctttgtctgcctcctgttgaggttcccacctccaaacagttatttttttccatttttgaggctaaggatttttactcgttagagcaacaggactagacatcaggagttatgtaagtactcaggaatataccccttgctatcttacagactgaccaccatttgtttgccttttgaagagcacagtgatcttcttaaaatgtagtcatgttaccgatgataaagctgtcaaatgtacaatgatgtctttttaaatattgggaccaaatcccaatttattctgactaatatcgggttccacaagagggaatttgaagcatctctgctaatgaaatcagttttcattttaatttatctttgattttttgcatgttggaggtgaggagggaatgagggtaacacttttcatttagttcttaattttcttctgttctactctacaataaagttctgatggtatattggagctattatggtcatgctatcacaagagggtctaggatctaacagccagaaagattaagatgcaaatgcaaaaggaaccatacagatttcaatttggagaagtagggagtctctgacgatatttgaatggaaagagacatgtcattatttttaccattgcttcttattttctctcaactattccatgtattttccgtagttcttacaccttttattcctttcttttcattggtataaacattgttcattgttaaacaaaatatatcacctataaacatctgacacttttgtatgcccatagactaccatttctttgataaagatgaagcatatcagaaactgtctaggattgttagaattctagttaacattctgccaataaaacagccctaagctttggacatttctctttctcagatctacctgaggttggtgattttttgtttgtttggttggggatgttttggtgggaagggattgttttattttatttttaatctgaatcttcttcccttggagtgatagccgaacttgctgagtttgtgagtatcagggatagaagatatcctgaagccacaagtcacatctgaaatagaaaagttgctattgtgtcccatgtgagatggttgattatgtttaaagggctaaggacaagatagatactgtgtgtttggctttgcaaccaaaggacctagtgccctgccttttgtacttaaataatggatgaaaatggaaataaagctgaactctaaggaaaagcttttaaatctaaaagagaccattcagtattcaaagcctacacactacagaggctttgaataatctccttaagttttcactatgagagttcatttcaaataaatgttatattttccttttaaataaaaagatataatgatattgttctcaagattgagagattgttgaaaaaagttggtttaccatttttaaaagaaacatattagcaaatgcctctgaaaatacacttattagtttgccaataaatgagtaatgttgcagttgtgagttaaatgtgcattaaatgtttgagaatatattgggcttaaaatacagttttaggcttctatttctggataagatatagtaaacacatcatacactatatatattagtctattctcacactgctataaagaaatacctggctgggtgcggtggctcacgcctgtaatgccagcactttgggaggccaaggcgggcggatcacgaggtcaggagatcaagaccatcctcgctaacacagtgaaaccccgtctctactaaaaatacaaaaaaaaattagccgggcgtggtggcacgcgcctgtaatcccagctactcgggaggctgaggcgggagaatggcgtgaacctgggaggcggagcttgcagtgagccgagatcgtgccactgcactccagcctgggtgacagagtgagactctgtctcaaaaaaaaaaaaaaaaaaaaaaaaaaaaacctgagactgggtaatttataaagaaaggaggcctaattggttcactgttctataggctgtgcaggaagcatagtggcttctggggaggcctcaggaaacttacaatcatggcagaaggggatgtgagatgtcttacatggtggagcaggagcaagagagagagcagggaggtgccacacacctttaaacagtcagatctcctgaggactctatcgtgagaaaaatactagcagggtgttaagccatttgtgaaaaacggccctcatgatccagtcacctttcaccaggccccacctccagcactggggattgcatttcaacttgagatttgggtggggacacagatccaaaccagatcactgtaattcctgctaattacaaaaaaaaaaaaaaaaaaaaaacaaaaaaaaccacaaacttgtaatttcctattttttgtgtgtttacttatttattttacttcctatatatcccagccaagggtactagaggcctgcagctagaaaccttagtggacagagaggggggaaaaaaaagccccattttaatgatatctatccagttgcagtcccttccccaggtgctgtagctatggagattgtgcatgtagccctgtccctcattcctgtcctgcaataatgagggtgcccctcccactcccactgaacactgttcctaccactcccactgggcactgctgccatggaaactgtggatggagctgcaataacaagtttgcagccctccccaatggatgctacagccacagagactgtgggcaaagccctgaccgccgtttccatcccctaaccctcccaactagagtgtggagggaggattaaaaagaggagggagttagagaaagagacttaaaaaaatctgtgtttgaaatcctgggcagatttcttagcatccctttcatgaaactgattagaatcaatacagaaaaaggttttagaattgggctctgctgtgttataccacccaggtttcagactggcctctgggtagcccagtggggcagaacagaacaacactaaaaagaccctaacaattaaattgacatttgattcacagcccataaaagttggctaagacatgcattgtgaatctaaacaacttgattgcctatcaaagtagaaaatttaaacaacagagtctcctaacataatattcatcatatcaagaaccaagaaaatcttaattcgaatgatgaaagttaatcagctgacactacactaagttgacacagatgttggaattgtctgacaaggattttaaagaagctataataataaatatactccaattacaattacagtcttgaaacaaatgaaaaaatagaaagtgtcaccaaagtaatagatgatataagggagaaacaaatggaaattttagaactgataaatataataaactaaattaaaaattagctcagtagtaaaatagagatgacagaggaaagaaatggtgcactcaaatttagatcaatataaattatgcagtctgaacaacagagagaataaagattttaaaaaggtgaagagagtcttatggggacctctgagaaaattacagaaacatcttcatatttgtatcattgaaatcccagaagaagaaaagtaggagtgagagattgaagaacatatttgaagaacagagagacacagggaaaaagccagtgaagtcaggtagtgattggagagatgtgtctacaagccaaggaatgacaaggatggctggcaaccaccagaagccgggagagagacatggaacaacttcttccttagagcctccagaagaagccaaccctgccaacaccttgattttggacttctggcttccagatctgccaagaaaccaaaagacaggatgagaatcaacactttgtaagagccttcagtggaccagaagctggaaaggccagatactcgctttcctagcaccctccctgttttgtatgccctctgctaggatggctgtgcgatttgctcctggttgattcaatataagaggaagttggctggtgggaacgtcagagaaatgtttttctttctgataaaaatggagagcacataagaaaaaaacttttagtgtacttcttcttctggcctttggatatgatgtgagaagcttgagaggacatgatgctttggagctgttacaaccatcttgtgaccatgaggcattcagataaaaagctaacattctgaggctggtgaagaagagactggctggaaacaggaaaacattcctgggactgtcttctgattttcttattaggtaaacaacgtgttcttagtgcttaagcactttttttttttttaaatacaaccaaaagcagtcttaactgatgcacaagccaggtgcctgacacaatgggggtcaatatgtatttattggataaaggaataagagaaagaatgaatgaaacttctactaaacctacctatactccagctgtccctgttaacaggacctcatgtggaatacttgaaggctgggctggaatcatctgagagcacattctcttggctgatgctggaaagagccaaacatttggagcatgcgatagcaggggatcattggccatctctctctgtattggtcttttcagtattgcaacttcaaggtagtaggattttttacaaggtagctgagggctccaaaggtagtcacttcaagaggcagagatagatggagaacaagccaggaggaatgtgtgtccttgatataacctagcctcagaagtcacatagcatcacttctgccctactgtattggttagagcagtcatgagccccactaggtagaagaggagaggtagagatctcctctcttggtggagaggggatggttgtagaaaagcatgtggaactggaaatattgccagggctatttatttatttattagtttatttttgaaaatccagtctgctacagtgccttatatacacctctattatcagattgaccatctcgatgtcattcatgtctttcatgtctatccttctgactgaaggatgcaagcacctggaagttttagtctgtgatttattaactttagtatctctgatacctttataaagatatgtttaataaatgccttattttgaagaaaagaaaagaaattgaagaagtgacagaaaacttcttaaatttggcaaacctaaatattcaagaagctgggcaaactcctaacaggaaaaactcagatccattcccagatactttttaagtaatttgctgaaaactgaaaacaatgaaaaaaatcttgagagcagccagagagaagcagcgcattaattgtagaggaacaatttgaatgactctgggtttcttatcagaaaacatggaagccaagagaagtaggaaaactgtatcgtttgttttgagccaacatcttgctattttgcccattctggtctcaaactcctgacctcaaacaatcctcctgccttggcctccgaaagtgctgggattataggctttgaaccagatttaaaaccttgtgctgaaaggaaagaattaccatccagaatttttcacctagggaaaatacaacgaagtgagaaaaagacattttcggatgaaagaaaactcggagacttcattgccagcagacttgcgtaaaaaaggaagttcttcagacaaaaaatgatgacagaagggaattctgctggaacatcagaatgaagaaagtacaaattaataggtatagggaattgcctaatcttctcctgttgagtttttaaaatgttgggtaagaagcaaaattttttacaatggccgatgtggttcttaatgtttatgaaggtgatttttaaaacaatgtcataaaagtggggagagtaaaggaacctaaaaagtaggaaggtttctgcattccatttcaaatggcaaaatgttgagtagactgtaataattgttgtatatagatataattatccctagattaactactaaaaatgctctataggccaggcacggtggagcacgcctgtaatccctgcactctggaaggccaaggcaggcggatcacctgaggtcaggagttggagaccagcctgaccaacatggagaaacctcgtctctaccaaaatacaaaaattagccgggcatggtggcatgtgcctgtaatcccagctactcgggagactgatgcaggagaagtgttgcttgaacctgggaggcggaggttgcagtgagctgagttcgtgccactacactccagcctgggcgacagagcaagattctgtctccaaaaaaaaaaaagctctataaaaagatattttaaaacactatagaagaccatactttacaggaaccatttctgtagttccttaaaacactatagataaatcaaaattaaatactaaaaaaggttcagagtatgcatagacaaggagaaatgggaacaacaaaaggagcaaataaaaaacaataaagtggcgtacttaaatcccaacatgtcaataattgcatgaaatataaatacaaatgatctaaacataccagttaagaaagagagaaaaaaaaatacaggacaaagactggcagaatggtgtttttttgtttttgtttttgtttttgatacagagttttgcagagacagggtttctccatgttggtcaggctgatctcgaactctgacctcaggtgatccgcccacctcggcctcccaaagtgctgggattataggcgtgagccactgtgcctggcctattttttattttaatgatccaactatatgctgtccccccaagaaactaacttcacatataacgatataggtagattaaaagtgaaatgatgggcagatacaccatgcaaacaataatcaaaagaaagatagaatgactgggctgggcacggttgctcacgcctgtaatcccagcactttgggaggctgaggcgggcagatcatgaagtcaggagatcgagaccattctggctaacacggtgaaaccccgtctctactaaaaatacaaaaacaaaattagctggcatggtggtgggcacctgtagtcccagctactcgggaggctgtggcaggagaatggcatgaacctgggaggcggaacttgcagtgagccgagatcacgccgctgcactttagcctgggcgacagagcaagactccgtctcaaaaaaaaaaaaaaaaaaagtacagtgactgtattaatctcagacagaatagacttcagagcaaagaaaactagcagagacaaaggaagatataacgataataaaatgatcaatttaccaaaaaaatgtaattttaaacatgtgcacttaacaggttttcaaaatatatgaagcagaaactggcagaactgaaaggagaacagacaaatatagttggagactttaatatccctctttcaataattgatggaagcattagaccgaaaacaaacaaggtcattcatcatgaccaagtgggatttatccctgggacacaagaattgttcaacatacacaaatcaatcattgtgatacatcattatcaacagaatgaatgacaaaaaccgtatgatcatttcaattgatgctgaaaagcatttaataaaatttaacttcccttcatgataaaaaccctcaaaaaactcggcataaagggaatatacctcaacataataaaagccatatacaacagacccataactagtaccataatgggggagaaactgaaagacttttctctaagatctggagcatggcaaggaggcccactttcaccactgttattcaacatagtgctgattactctaggtagagtaatcagacaagagaaagaaatgaccaacatccaaattagaaaggaagaaatcaatttattcttgtttgcagactatatggttcaatatttgaaaaaatctaaagactcttccaaaaaaaaaactactagaactgataaattcagtgaggttgcaggtacaaagtcaacacacaaatatcagtattgtttcaaagtcaacacacaaatatcagtattgtttctatatgccaacagtgagcaatctgaaaaagaaatttaaaaaagtaatctcatttgcaatagctacaaataaaattaagtaacaagaaattaaccaaagaagtaaaggatctctacaatgcaaactataaaacattgatgaaggaaattgaagagaacataaaaaatggaaagatattctatgttcatggattggaagaataaatattgttaaaatgtttatactatccagagtaatctatagattcagtgtaatccctatcaaaataaccagtgacactcttcacagaaatagaaaaaagaatctaaaacttacatggaatcacaaaaaaaccagaatagtcaaagctatcctgagcaaaaacctcaaaagtagaggaatcacactgcctgaggaaactggaggaatcacactgcctgacttcaaattatatactacagagctatagtaaccaaaacagcatggtaccggcatatagaccatagaccaatggaacaggtggagaacccagaaacaaatctgttatctacagtaaactcattttcaacgaaagtcacaaacttacactggggaaaggaaagtctcttcaataaatggtgctgggaaaactggatatccatatgctcaggaattatattagaccccagcctctcaccatatacgcaaatcaaaatgaactaaagacttaaatctgagacctcatactatgaaactactaaaaggaaacattggggaaactctccaggacactggtttgagtgggtaaagatttcttaagtaatacccgataagcacaggcaaccaaagcaaaaatggacaaatgggatcttatcaagttaaaaaccttctgcctgcacagcaaagggagcagtcaacaaagtgaagaggcaacacacagaatgtaaattagtacaaccactatgaagaacagtttgggcgttcctcataaaagtaaaaattgaactaccatatgatccagcaacccagctgctgggtatataatgaaaggaaatcagtatattgaagaaatatttgcacttccatgtttactgcagcactttccacaatagccaggatttgaaagcaacctaagcgcccatcagcagatgaatgaacaaagaaaatatgtgatacctatacacaatggagtactatccagccataaaaaagaatgagatcctgtcattagcaacaacatggatggaactggagatcattatcttaagtgaaataaaccaggcaaagaaagacacacttggcatgttcttacttatttgtgggagctaaaaattaaaacaaattgaactcatggagatagagactagaatgatggttaccaaaggctgggaagggtagttgtgggggcgggtaaggggacgtggttaatgggtacaaaaaatagttagaaagaaagaataagaaagaaagaatatctcacagcacagcagggtgatagtcaataatacatttaaaaataactaaaagagtataattggattgtttgtaacacaaaggatggctaccccatttaccctgatgtgatttttcatgcatggtatgcctatgtaaaaataccttatgtaccccataaatatatatacctactatgtactcaaaaaaattaaaaattaaagaaaaacaatgctagaaaaatagaaactttttacttaccagcaaccccgttaaagaggatgaaagagaagccatagactgagagaaatctttgcaaatcacatgtccaacgaaggcatgtatagacaatgtattaagaactctccaatctcaatagtaagaaacaatctaattagaaaataggcaaaagtcttgtacagacggctatgcaaaagacatatacagatgacaaataagcacatgaaaaatgttaaaaaatcattagttattagggaaatgcaaaagacatgatgagatacaattagtcacctgtcagaatgactaaaataaaaaatgccaagaatgtggaacaaccagctctttcatgcattgcttatgagaatgtaaaatggtacagccattctaggaaacagtttggtagttctccataaacataccattaccaatatgatccagcaatcacattcctgtatatcctagagaaaacccatgtccacacagaaacttgtacactcatgtgcatagcatcttagtttgtaataaccaaaaagtggaaacaacccaaatgtccttcagtgggtaaataaactgtgatataatccacataatagaatactacctagtaataagaaatgagctattacacacaagttggatggatctcaagagcattgtgctgagtaataaggcaatctcaaaagattaactactatctaattccatttataatgctcttaaagtgactaaattatagtgatggagagcagttcagcgggttccagagattaagatttggggaagagtgtacctctaaattggaagtataaggggtttctttgctttgatggtacagcttgtatcctaattttggtggtggttgcatgagtgtatacgtattataaaatctgagtgcacgtgaaaactggtaaaatctaaaaaagtctgtagttaatagtattgtataatgtcaatttcctgattttgataaggtactattgttaagtaatatgttctccttggggaaagctttttggaaggtacgctgtaagtatagtaactctctgtactattttggcagtttattatggatcttaagttatttcaaaataaaagtaaaaaaatacagtgttaaaaatatttgaggagtaaagaataaaatgaactggttacagtactgttcattgaggtggtttgagaaaggtgatcttgaggtgttttttgttttttgttttgtttttttttcattaaaaaaacaataatagctggggattccagagaaattcatgctcagctaacagtgtatttttcatgtatggctggctgcatggagaaatgagacaaagactccgtcttcgagaagaggtatccagatttgaaatctagtctaattgttgttgatggtttggttttaaagccagtgaatagacaagtgctgtaagtaccagtactacccagaagaatggtactttgcagaatggaaaaaccagcaaaactgtgtaacttaaaactctgacttttatttaaaacgaaacatttggagcagcttttgcacaggaacagtttcaaccattgttttccttttgcaagtacttcatcttttacacttgatcttagccaaaaggccgagaactgatactttatctttttactcctgtgtagtaagacagggctaactattcataggcatgctttttactccttttccctttccaccctcttcctcttcccctttctgtcctcttctctcgtccgcctttcttcccctctgttctcctcccaactccccttttttctatcttatttcctcctctcctcttttctcttctcactccctttttgaaaagagtacctgtcatatttttgaggaaagagaccgtaatgaattctgtcaactaaaatgatgacggaggacctttctaaaattcaatcttaattttgtaagcatgctctttataacctcaacagttaaattgattctgagacctgggaattagggtataaacttacagagaaaagttgaggtgcttgagaagatacattttctgtgcatttatataggattgtcagattctggctcctcatgtaactcaacttctgtatccttggaggtagttttatttacattatattcttgaatgagaatatgcatcattaattatctgcctttcctttgtggcccttctgatggcagaaaaatattaccaaggttattctagcatgcaagtctcttgaaactaagttgagggttttctagagaccacctggaactcccagaggtaacagaatactgtcttgaaagcctcagtggaagaaatgccccacatttgcttgttgctttctattggatttatggaatttccatcttttaaaaatgactttaaagcatttaatagagactttcaggtaaagagcaaaagtttttaaaatgtattatttaaagtaagctaaatgtggctttacttaccaagataagctttcctcttctatgaccatatagtaactatctgcctttgctgcagtctttcagtctataaactctgtatcttggtatctttcctccctttagtttctactcttagattttacagaatacccatagggaaattgatttcctgaagcacttggtaaactacttgggcctgagctattgtgttgtccttactacttggtacagattagattgttctttgctagaggggtggaaaggatgccttagtacagtcttaactttgctatggaaatattcttgtttaatatgttaagggacaataatttctggtcttggcttttaaaagtgagcatgctttttaattgcctctttcatggttattaactgagtcttcattttaattaccacaatggagtacttcagttctcttatttgcttcattaccttttctccttggttttgaaaataatgttagagaaataaaatcagattgtttctaatataatgaaatgctttcactacactattaatgaattcgttcttcattaccagcacaaagctagatattgcaaatctttttaaacaaataaaaactgtttagtcttctgattagagcagacaaagagcacagtaaaatttaactcacctggcctgatccctttttttggtttttactgagctgtcttcactggaaataggagctatctttgacttaactccttccaatagaaggaatttcttagggaggagctggaaggatctcctggggttctgattcttaattttcagtttacagaaatagccagataggtgttttgagcctggacttcttgctgcatcttgtattgaagacatcatggtgaaatcgataagggcagtggacagtggatcaagagccctgaacaggtctcttgaacctgaacagatttgccacctgttaatttatttttatgactatggacttgacatcacctttgtctctgtagatgtaattcagttgaactaatggttattgagcatttactgtttgcaaaaggcagctggagatattatgtccagtttatatttactaaatgttttctttgttgttaatttagcctttttctgcaatgtttttggtcagtagtaactctgggcaggtgagggcaattacattgtggctggaaaatttgtactctgaagttgcttttattggtgtgtaggaaaaatctttattaaaagtcatagaaaaaaatcatttaatttataagccacaaaatcagtactattttgtaatatgttgtaattcacattgctactaatttactaagtggagtcagtggaaacccataaatcctagtagtagtgcctaagtagtagaagaacgcctatggtttactagttgattgaaaattgttctttttttgcaaagtggaaattaacctggtgtgctaatttgaaatatgtctaacagtgactatttttatattttaacctaagtaaaatatctcagcgttatgatggtgtgtttactgaattagtaatcatttatttctaaggactgctgctttccttcaaataccattttggttagaggcttattgattcaagtattgttcctaattgttgatttacagggcagagagagcaaatacagctttcagctctgttgaagcagggtcattcttggaaactaatagtgtcagatgaaatgcctcagatagtgtaaaagaaaataattgggccaggagtggtggctcatgcctgtaatcccagcactttgggagcctgacgtgggagaatggcttaagctcacaggttcggatcagcctgggcaacatgggaaaacccatctctacaaaaaactaaaaaagttagctgggctacttggggggatgaggtgggaggatggcttgagcccaggaggttgaggttgtggtgaactgtgattgcaccactgcactccggcctgagcaatagagccagaccttgtctcaaaaataataataataattgaagaaaataaaaagggacctgaattcagaagaatcctgttatatcttaaatccttatttcttgatttatatgtactatgatgacagctttgctgatgaattataattacaaaaatgttacataatgttgttagcatataaagactcgtgattgagctaccttgcaacactaatactcaaaaagaacacacacatacaaaaaactggatttattcagtgtgaaataatgtctcttgaaattatgagaataaataagtatgttcaaattaattttgtgcatacaccagctcatttatttagcctcatagtagctctgagaaagaagggcgagtgaacagggagaggttgtgtagggaggtaatttttgtgtctattttaaactaaccaattgaaaccaaatcacacaactgagttcataacagaaccttcactggaccaaaatcatatctttaacctctctatccaagctctttcattagagaatgttgtcttaagtaattttcacagatttaccttgtatttctaaaacttgaattatcattattgcaaggagctagaatatatctgcctattagtgagtctgacttttaagtagatcccatatataaaaatctcatattataaaatataatttattatgtttatagtttagagtaaagcttcttttagtaatgagacccttctatatatcttgctcatggatatgacacattttctagtcttttgcaggcatcaactggatagtataaaactaggatcagtggtaactgacaagagctatttggtaagaaatttgaaaattacaaaactatggctctgtatcccttttatagagtcccataaatctctttatatttgttgctattctggaactatgctgaataacaaaggcttagctcagaagaggggttttctatgaagttcttttcatcagaataaattcctgttcatttcagagttgttgctttattttttttttctagatacgtactctgataaacctaatcttgtgttaggaacataaataccttttctgttctttagtgtcctctgcctttttctggaacttttatgagcaagttattttgaattttccagacttttaagtattatttggacaaaaaaattgggctatggctctgagctttttcagtgtttaatttactgttatcagtacagtcattcattttctcgtatcacccttcaagtcttccattgattaccttatatgtatagacctttctcatttcagaatcaagcataatggattttccctctttctttatgtcctctatgacataaacagaaaagaattaatatagtctatcttcagcttgatttgagatatactaagcatcattcattaagccgcttgtacagattgcccttttaggtctcagctcttgtgctcaaagctttaggttctagtcaaactctgttctcaacacagtgaatatactttcttaaatgcagatgtgagtcttcttttaaatagaaaatctatagtttccaaactaaaggtcagatgtttcaattattatgttccttcactctttttttccttaaaaaagaagaagaagactaacataagatgtaatagtaggggaaattgggtgttaggtatatggggattctctgtactatctttgcagtaattcagtacatctaaaaactgttctaaaagaaaaggtttattgaagaagatatgagggacattttctttttcattcatatgaattttagtgatattcaggtactctatttctcatgaaaatctgacaaatgtcactgttgtttgtccgtacttttgatcaactgagtcaataataaacctttgaatcagttcgagaatattatttattcccaggatccttatataatattgtacagaaattaaatgatacagatctcccattcccacatgataccacactcctctgtttctctcagatcttttgtggctatagcaacaagtgtgagaatgcttattgctttaggagtctgccatgagttcacattttcaaagaatcagcaactctactacttgattgtggaaacaatattgaccaaatcttgctgaattttatcagggttctctcagattcaaaaaggctcttaactcttcctaaggtacttgatggtatgggttctgctttgatctaaaaaaagaccagcttgctgtgacacatttgaatatgaaaggtacttcttctggaggtaacttgtagtttcccttctcagtctttcctttggaatcattttatagactgcagcttttgtttctagggctctgcttgacaggacagataatatccctggaaaatagttttagagttgatgtttggtgactgcattattcaaggctcatataaattgagaactggttacattgcctcttgctatgtaggataaaagcttctgttcttggaattacccgtcctctctcttgtagacaaaatagctaggaaaactgctcagactgattttgttatatgaagaactaagatgcctaggaataatttagcaatagctcatccaaattaaagcagagttgaactttagaatggaaaaaaaaaagaaattatcatgttagctaaacatttgctgtctggatctcccagttaaaaagtggcataatacttctcaagttagccagtatagaacatgttccacattcagttgtgaaaatggctggtagctattatcaagtatgattttttaaatgttccatgcctgatattttgtaattgttgaattcagatatccctctactcagtggcttttacttcataatgaaaaagtagatttggttgtaatatataaaattgtgaagatagatggaattaatagagaaattagagtttttcttttaagataatttgagtttcatcatagaaggtaagctcagaatgctgaaatgctgctggaataaatgaactgttttacttttttcataaagatattgatgtatgcaactttgaattcagagatgattccatttgcatgttctgagtgatgaataagtgaaagaaataaaagactgaggaataaagaagtgaaagaaagaacttatacactgctggtgggagtgtaaattagttcagccattgtagaaagcagtgtggaaattactcgaagaacttttactaccatttgacccagcagtcccattactggatatatacacaaaggaatataaatcattctaccgtaaagatacatgtatgcatatgttcattgcagcactattcacggtagcaaagacatggaatcaacctaaatgcccatcagtggtagaatggctaaagaaagtgtcatacatatacaccatggaatactgtgcaaccataaaaaagaatgaggtcatctcctttgcagggacatggatggagctggaggccattatccttagcaaactaatgcagaaacagaaaaccaaatactgcatgttctcacttataagtgggagctaaatgaagagaacacatggacacagatgggcaccacagacactggggcctatcggagggtggacaatgggaggagggagaggatcaggaaaagtaactaatgagtactagacttaaaacctgagtgactaaataaagtgtacaacaaacccccatgacacaagttaacctgtatacaaacctacacgtgtacccttaaacttaaaatttaaaaaaaaaacaaaatgcaatgttaaaaaagagaagtgaaagaattttttaaatgtaactgcttaatttcacattgtttacagttcttctcaagtaagcttcttttcactgcaatctccttaaatatgtacatacggttttctttggattcactgaaatccaatccagcaggattctttcctgaataagaaacgtactggatcagtcctgacctattttatgatttttggtacttgtcacctgtaaagagaagttaagggaacatcaccaccaaccccacagaaatacaaaaataccatcagagactatgttcataacactctgtgaacacaaattagaaaacctacaagaaaaagataaattcctggaaacatacaacctcccaagactgaaccgggaagaaattcataccctgaacagaccaataacaagttctgaaattgaatcagtaataaaaagcctgccatccagaaaagtcccaggaccagatagctaaattctgccatacgtataagaagacctggcaccattcctactgaaactattccaaaaaattgaggaggagagactcctccctaactcattctgtgagggcagcatcattctgataccaaaacctgggaaagacacaagaacaaaaagaaaacatcagtccaatatccttgatgaacatagatgcaaaaatcctcaacaaaataatagcaagccaaatccagcagcatatcaaaaagttaattcaccgcgatcaaataggctttatccctgggatgcaagattggttcaacatacacaaatccataaatgtgattcatcacataggcagaactaaaaacaaaaaaattatctcaatagatgcagaaaaggctttcaataaaattcagactctcttcatgttaaaaatcctcaacagactagccatcgaaggaacatacctataaatagtaagacctacctgtgacagacccacagacaacatcatactgagtggacaaaagctggaagccttccccttgagaaccagaacaagacaaggatgcccactctcaccattgctgttcaacatagttctaaaagtcctagccagagcagacaggcaggcaagagaaaaaaattaaaggcatccaaataggaagaaaggaagtcaaactacctctctttgcaggcaatatgatcctaaacctagaaaatcccatattccctacccaaaagctcctagatctgacaaacaacttcagcaaagtttcatgctacaaaatcagtgtacaaaaatcagtagcatttctatacatcagtaatatccaaggtgagagctcaatcaagaatgcaatcctagtcaaaattgccacaaaaagaataaaatacctaagaatactgctaactagggaggtgcaagatctctacaaggggaattacaaaacactgctcaaagaaatcagagatgacacaaacaaatggaaaaacactccaggctcatgggtaggaagaatcagtatcattaaaatggccatagtgcccaaagcaatctacagattctatgctattcccatcaaactaccgatgacattcttcacagaactagaaaaaactgatttaaaattcatacagaatcagaaaaaagcctgaatagccaaagccatcctaagcaaaaagaacaaagctggaagcaccgcattacccgaattcaaactatactgcaaggctgcagtaaccatggtatgggtaccaaacaccatggtacccataccatgtatcaccataccaaacagcatggtactggtacaaaaacagacatatagaccagtggtacagaatggagagtccagaaataaagtcatatacctacaactttctaatctttgacaaagctgacaaaaacaagccaaggagaaaggactccctattcaataaattgtgctgggataactggttagctatatgcataagattgaaactggaccccttcctttcactatatacaaaaattaagtcaagatagataaaagacttaaatgtaaaacctaaaaccataaaaactctagaagaaaacctagggaataccattgtggatataggccctggcaaagattgcatgatgaagacgccaaaagcagttgcaacagaaacaaaaattggcaaacagaacctaattaaagagcttctgaacagcaaaagcaattatcaacagagtaaacagacagccaacagaatgggagaaaatatttgcaagctatgaaaggtctaatatccagaatctataaggaacttaacaaggaaaaagcaaccttattaaaaaggcaaacacttttcaaaagacagactcttttcaaaagacatatacacagtcaatacgtatcaaacatcactaatcattagagaaatgcaaatcaaaatcacagtgatataccatcagaatgaggcaacagaatgctgttattaaaaagtccaaaaataacatgctggtgaggctgcagagaaaaggggcatttatacattgccagtggaaatgtaaattagttcaaccattggaaagtggtttggcagtttctcaaagaacttagagagctactatttgaccccgcaatcccgtttttgggtatataaccaaaggaatataaatcattctgctataaagacacatgcaattaacatgtttatcagagcactatttgcaattgcaaagacatggaataaacctagatgcccatcagtggtagactgaaaaaagaaaatgtggcacatatatatcatggaatagtatgaagccataaaaaagaatgagatcatgtcctttgcagcaacatggatggagctggaggccattaccctaagcaaactaatgcaggaacagaaaaccaaacacttcatgttcttattaaaagtgggagctaaacattgagtacatatagacacaaataagagaatagtagacactggggcctacttgagggtgaaaggtgggaggagggtgaagatcaaaaagctgcatatcacttactatgctgattacttggggtgtataccaaaccccacgacacacaatttatctatagaacaaacctgcatgtgtacccctgaagatgaaagattaaaaaaaaaaaagagcagttgacctctctgtacaacttatctttattttcatttctctttctccctgacagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtaaggagcttgtgcagcatatgagatctctgggctgtttcactcaattaccagattattagatttctaggtagaccttcatggaacatacttatcttttcctctggatccatgaatactatacattatccagataaaatctagaagaacagtattttatcttaaaagtattttattatgtatttcatttctgatgctcatttttatgtgaatttagcaaaatcactgagtttttttcagggagcataatttaatcttttaataataatgatatgactttcactctataagatgatttcacattattgaactcattttaatatgaagtaatcatcatataaagtagtccagtttatatggactactatatatgagtagcatgagcatgcatgagaatcatctggaaggtttcataaaactccattttctgttaaggaaggtctaggctgcagcctgagagttttaatatctgacaaaagttttaggtttagggaccgtgctttgagaaccactgaggtggaccttgctggtaactttatcttcaaatgaagcctaatttgtttatgtgattttaattgtattcaggaaacatttaatgaatagtaatgtgactaaggtactatactaggcattataagcagatagaaacatcagtaagaaatttcctttctctccaaggaagtggtgaaggagtagaatatagaaaagaatttcttaccgctagtctagtgcttttctttctacaatcatgatctttaagatctaaagttgggctaccttgttaaaattgtggctttattgttttgtaatcttggacaagttacttaacctaggtcttagtttccttatcagtaaaatgaagagtaatcactttattgaattgttggtagattaaatgaaataatatatgtaatgcacttagtactgatatatgaacttatatctagtaatttttagctattatgaatagcctttattcattaaacaaatgtataatgagtgcctacagtgtgacagatactgaattaagtgatcaggataaatactaagcaagacagtacacatcctctgcactcatatcttgtgggaagtccaacatttttcaaaaaactgaggcacttcagttaatatcatttattgtggggctaagcaccttttttcacgagctacaacactagatacgaaatagggagctatgtcatcagcaaagtaactttggttccttcatttcttttgcctcctttgaaaaaaaatcggtaatatctgactctttgcagaagtgtcatgaaacttaattgagtactttctataaaatactttgagttgctctgcaagaggtcctgtatggattaaaagtattgtgttttgtcttctgtagggtgttttagaagccttattttatatatcacccgattttttatttttaactcacttcagattttaaggtgaacctctttatctagaacctagttaagctttagttttaaggttatatcttccactgatctggtctgtacttttcacggctagtgccaacagattagttataaaggttaggaagatactaaatttgtcattcaggaaaagaaactctaccagccccactatggctaacttttttcatttcatggacttagttcagtttaaacttccttgattgtggaaataatagccagggccaaactatgtttccctggttctagggggagacaactttttgtatggtagtcagaaaagtgaaaagttacagatttatcaggtttaatatatagtttagccctgcccgtgtgctacaagtggttatttggtttgtttgatttttaatccttacttgtacattttgtagtcggtagtggcaaccacagggtatgaaaatttaacatggcttgaatttcaaacactcagaatttcttaatgttacaactaaagaggatgtagaaagcatcctttctttattcatctggaatcaaaggcctagttaaggctaaatgacttacccagggtcatacagcttataaatgccagaactctggttagcacattcacttgtacatacccccagtctaagtccttatcagtaaactcatgccaaacactttacctcgttactagcagaataatctaccatcattactagaagaatgatgattagaggcacagaaactgcctggaatatctaggaattaaataattttaataatttagataccaatcttttatctgaaaagagatttcttttaagcttagaatatttttgtttttatgaagagtatggctgccatcaatttatctgcttatttacattatctatatatgtgccctttagagaaactattgaacatatttccaagaattagaggaaatagtgaattttaataagctccttgactttaattctttagttagtcataaatcagctgtgtctgttgtcattctgagttgtacaaaaaatcttgggatatttcctttgtcaccattactgtgaaattattattgttcatacataacttgacatgatgtccttgcagatggaatttagtaattcttgttcaagtctgtccaccagtgcaggaattagtttgtacagtgatcatttcatagctatatcataccttattatggttggtgtctatttttctcctccattattttatgtttgtgtgtgaaactatatcctttgtaccaagtaaaatggttaagtgaaggaaaatactaaaggtaatgcttccagtaaaaagtaatcaaaatatttcccatcacctgtacatgccatgtctattcctaatagtttatgtgccctaaggttgttgatgaaatgatcaatttagttttttacaccacaagatgtttcctcagcctgaactaactacacatactagacctgattcttccacatagattgcttgtgataattcaaaatgggaatcttgcctttatgtttaatagtttgaagtacctttcaacaatatttatttattgttttttgttttgtttttagagacagagtcttgctctgacacccaggctggagtgcgggggcatgatcctagctcactgcagcctcgaactcctgggcttaagcagtcctctcacttcagcccccacagcacctgggactacaggcatgctccatcatgcccagctagttattttattttttattagaaatagggtctcactatattgcccaggctgatgtcaaactcctggcctcaagcagtcctcccacctcagcctcccaaagtgctgggattataggtgtgagccactgtgcctggcctcaacaatttataatttggttttttaaaggatattgactattttaggctatatatgatgactagctttcaaaatgcttttctagcttatataaacaatattgaatagatgatttagtgatagagaactccacttaaattcagttccccacttcaatctttttccttgtaaaaattaaaaattattcaccttaacagttaaactacctaggctgttctgtctttccttctcttgtctttttcccactgtcttaataaatacataagttaaactgaattcttaatatgataaatgtaattggaaaattttatttgtaaatgaaaataatgactagtaaaaaaataatttataaatacgataaagtttgatgccctggaggcgaggtgcctggtttaaatacatgtttaggtagatgaccgtttggtatatccacttatctaaactgaacagttaccttctctccatgcctcatttccaaaaggttttagtcaaagagttttatttgacatccttaaggtttatgtggaggcaaccttgaaataaaagtaattcaattaaagtatttgctatttgctagatacctatgctgtactacatgaagacagacacagtctctttcgtgtaaagggcagtcaagggggaaagatagacaactgaataagcaattaaaatatgttgtgctaatgtggtggtatggttaagactaccctgaagcaaatatctaatgcatatttggggttcttttggaagaaatgatttttaagctgagacctaaattatgagtaggagtcaaccaggtagggacatggtggaagaattttctgtcagtgggcacaacatgtaaaaagacaggcaagagaacatggagtcactgggggaactagtagtaattcattgtaaagcttgaatactgagagactagctaatgtttccttttaaaaacaagcatcacttacaggatttccattttgatggttgtgtattcttgttcttcactaaaactgacaggttttaattcgagagtcaaagctgtttttttgattttggtttagagagtagacagagttataagaaattgatttcagatgacttttttgttatctcataactattaaactgtttattcaaatatctcactcaggtcagaaggaaaatctttagcaagtagaacacaaatgaaattatactttcagtctttcctttgatactaatattttaacctttacaaaactactaagatgtctgttggaatcatctaaatattctaaccaagttgtatccttaataaggattgacgtcaggtagactaatttataaactgatattaagcaataatgtgattaagaatatatagatataatatacatattaggctatagatatgcatatgttaagtctttttacagtagtattttcagtctttgataattgtattaatagaaacttaaaacaagtacatttactatttttgatcccttatgctgcaaaaaatcttgatttctctgtttaggggatctgagggagaggaaggatattagactgtgagtctgatccagttctgttgtttttagctttctgaactttgtgaattaacttagcttctgaacctcagtttagctctttaaaaaactcatgatactcattatctacctccctgtccacctggaatatattattaggttataacctgcaacaacaggaaagttatccttttattctgagatgaaaatcatgcctttataagagcttcatatgtagttttctgtctaagttaaatggaaaagttgaaagaaatacagagaagcaagataacttctgagaataacttctagacattcagaatatctctatgcttaataaacccacaatttaatcaaaataaaattctgggccactcatagagtctctccgcagctacctgaagccttcagcagttttaagtattttttctatctcaacatacctaagatagaaggtatactctttcttatgatagttattctgtgtaattagtgaaactggctttgttgcagcaaagatctggttgtgcaggaggctatttggagagtgagttggtaccacatatagttgaaaagctagctgtctcctctccaagattctagtaggtttctctgccctttacctgactccttttagaatcattaacctaaacaagtatcattgcaggtacataaggacttttgattcaactgctataaaacttttttgttttactacttatgggccacaaaagaaagaaagatctttgcttcaggaatttaaaattccagttagaatatacttaatgtctcagaagaagttaagctgcttttcaccattacatcttctttcatttcccacttaaggagatagaagtctatggtatctcattaaaatctagtgggatcatcaggaaatacaggaatagggaactgaagctttgtccacattgtagccttgacccttgtgagcctacactcttacaattacagatatttattttcgtgtttatcctgtaagtgcttctcagattgagttgtgagtaaacctggggaaagtgaattagagatttgcaacctaccaggataaaacatggtacattttcttggactattaattttatttactggtaggtaagctaaatcattttcaaataataaaacaagatctgtaatggtataaaatgaaaatttgatcaaactccagcccattgattgaggccagacttcatattctcagtagcatgaatttaccttcctctgctgttaggagcattttggtggaaaattttaagaaacaccattctatgagttttttagctgtttatttcaccttgacagagactccatatgggagcaaagcagcaaggtacttctaggttatttaccttctaggttatttacacagtgccaagcgtttgaccagagcacattagatgtaataagagaggccgggcgcggtggctcacgcctgtaatcccagtactttgggaggccgaggtgggcggattaccagaggtcagaagttcaagaccagactggccaacatggtgaaaccccatttctactaaaaatacaaaaaaaaaaaatcagcctggcgtggtgatgggcacctgtaatcccagctactcaggaggctgagagggaagaatcacttgaacctgagaggcggagcttgcagtgagccgagatcgcgccactgcactccagcctgagcgagagagcaagactctgtttcaaaaaaaataaataaacaaaaaataaatgtaataaacaaaacctgtctccccagatccccatccaaatttcaaaacattacccttctagctatgtgaagcacttttattaaactgtagattttgttttgaaaaaatagtctattaccaagaatgaatcttttaagcaatttattctcccctttttagaaaaggttctggcagaatgagttcagagataaaaggacgtgtgacttaggaaaaagcaatacgtatttagcatccacctcactatggagtgtaaactatttcattggaaaagtttctgaaaaatctcctaaagtctatttaggacctatccaaggttgttagagctagagatagaatccaggtgttcttaatttcctgtggggtgtctgggccacatagccttgataactgtctcagaaattatcagtgtttttataaatactgatatacctattatgatagatgtattccttaaagatttggcataaattattacaaattgagtcgtgtttgaaacattccagcggagctagattacaaagtaaataatcttttttctaataggagctagtagtcggtcccctgagtcaccccccacccctccttccttcttccttccctccttcccttcctttcttccttttgtaagtatttgggtttttctgttttcctcagacatacttatgtgaatctttgagtctcagtcacagttgaccttcaactcaaacaccaaagtatagaaaaagaagattgcaatctttcagtagcattttgataacagagtcttgtttgcttaaaacatgtggatcacgttagagtgattctacaaacaagataattgttgacattttgaagaaagtaaagaatgcatcctgtcccttttggttagttttatatgccagagctctgagtatgatgtgaatctgtaatttctttgtctcccttccccaggattatataaattgtaggctaatttcatggaataggaaataataaagtccgtgatctttagtggagttatacatatttttttccctccaaaaggttgttactcagtaagaaagttctatagtggtttatacatcagttccattggaaagaaagacatatttgtgtgtgtgtgtgtgtgtgtgtgtgtgtgtgtgtgtgcgcgcgcgcatgcgcgcgcacgtatgtgtgtgcgcatgtgtgtttttaagtaatagactttattactcatgcatttttgttgccttagcagaaggtcaaaagcagattacagaatcataaaccttcttagatgatactttggtatcaggcttctttcttttgttttgcttccccaaatacaaagatcaaaaatattcttagcagttattgaaaataattagagttgagtcttccacctcttcctaaagaggtcctccttttgattcaatttaagtttagtctcctattataagtagccattaaacttaatgcaggttatattctctggaagcaagaaattgcaactagtgatactataagtcatactgattttcccaaaagatatattacaattagagttatcatttttgttcagattttgatatccaactttacttttgaaaaagtacaactgccagcaaatactgtattaggtataaataatgggcacatttatatttataatgtttttaattataaagtttctttaaaaaaaatggatcagtaccataaacagggaagtacactagtcattcagtaaaaatttgaatgtttctagatgccatgggaaatataaagatgactcttcaggaacttgtcattgagtatcatgagacccatacatctgtaaatgtaaaaaaggtagtgtcataagagaggtataaggtcctgtgggccaccagagaatagaaaaactgtttctggctaaagcaatcagagacttcactagatccatgagctgggctcttagagaatgaagaacatcatttaccaggacagatcagtgtcattgatttggagtcagaagttattagctgtgttactttgggtagtgtcccttaacctccctgttctgtgtaccttacagagttgttatgagcattcagagtgataatatatttgacagtggtttatatattctaaatcaccatatgttattattaccactttagttttatgggaacaaagcaaaataacaataatagcatgattgggttatagagtttcagcagggcttcttttaactttaacagccaacattaatgaaactcagagctacttgatggctttttgtgtagccatcctcccaaagagagccagctttggctccctagctcccctagcccacatgaggatcattctccacttctgttgggttttatttaggttgccctgtaaaaatctcagtgtctaggctgactaaacatcaaaaatatgctcctaatcaaggagctgaccagtttctcttagtttctgggacagggttgccttcttagctagagccatcgctgaccccagtcagagagctctcctgacaaaacagtcttcagatagtctttttaaggtctccaagttgataggatgatggctgggagtaaaggggggtactaggaataaaccattttgtcttggagctctaatatgtatataatactaagagaagcaaaaataggcccctgtgaagcctctactctgtgggagctaacgcttaggaatctgaacataccccaggtaggaatttccacgtaaattttacctaaaagtagaaagggttttttcatttaaaagtctttttttctaaacactgcaatggaattgtacaaatcctaaggatctgaatattagaaataaatacataacagtgagggcctttgactgagaaaacatccctttggtatctctctattgactggaaggagctacataatgccagaccagcagagattatgtaagcaaccaaaaacgtagtattgaagcactgcagcatgatcctttcctctctaggttttgggtcttgtatattatatttgaagctattatttagtgcatctaggttctggctaggaatgaactggaacatttcagtgggattttaaggcatggtgaaaaaagtagttgatgaaagagtaaatcaccgtgtttttctttctttgctgccactgcccatcttgctgtgttcactgaaatcaagtgtaggagttggggagtaggttaaatacctgcctctgctgctacatctggcaaatcttgatccatataatttagaattaataataggacattggcaaaaataggcattatactgtatgttcctcttttctagattagatccagtaccaaccatggggccacccaaattgagacattagaatctatacagcaatctttctgcattctttggaaatataatacctagattgaattcagaatatgttatctacattttaaaagttatatggtgtctctatttcagagggaagattaatattttatggcctgtcataaatgaccatcttagaggcacccatttgttttatgtatgcattaataatggaaattgagttcattcaactattgtaatttttgtacatctgtatcatgatttatatattgcctcattgatgagcatgtaaattatttcaagtttttgccattataaacagtgacatagtatctttatgcatatctctttgtgcatatatattaattttcctagggcagtgcttacaaactgtatcacattatactatatgtaaaaattatttttactgcccatattatcacctgggggatggtggcaaagctacagaggtctctgacagtgtgtcacatataaaatcttatgctctaaaaaagggcttgacaaactatggtcctcagaccaaatttagccccctacctatttttgtaaatatggtttcattagaatatattcatgcccatttgttagtgtgttgtctatggctgcttttacactacagtgacagagttaaatggttccaacagaggaaccattgtatatggcccactgtattagtcagggttcttcagacaaactgaaccaataggatatatagtgagatagagcctgaaagatgtattataaggtcagtaccttataattagctcacacagttatcaagtctgagaagttccacgatctgccatctgcaagctggagacccaggaaagccagtagtgtattatagttgaaaggccagacagagagctagagggctgatggtgtaatgattccagttcaagcctgaaggcctgagaaccaggagtgccagtggcagaagacagatgacctaaagatattctcttatgttttcttccagaaactttatagttttagcttttgcatttatgtctatgatctctctagtgttaattttcatgtgtcacataagataagggttaagaccattgttttccgtatttttattcatttgttctagccttatctgttgaaaacttttcccatttgaattgccttggtcccttttgtctaaaatcaatcagtaatatatggatctatttctggtttctccatcctgttcagctgctctatttgtgtctatccttacactttaaatttttatcagccatcagatatttcacagcatgttgattagaaagctgtacatatgcctagaagtggtattgttaggtcatatgaaagtatacgtttctttaacttgcctacatatgcctaatccctctatggaaaaattatttcagtatctcctctgctctcagaatccttctctttttaatctgtcttccacagtgccatcagaatgatattttcgaaaccaaatatgactttctctcctaaggccttccatggctgcttagtgtatagaaactccttgcttagaatataggatataagctccttcacataaacagcctgcttttcaaaatgtgccctgcactccataattcactagtccacctacaaatgtattccttgaaagttttgtgtacttttactgatatactgggaacatgtaattcttcctctctagagaatatctttcctccacttcatcccatgaaatcctatttatcttttagtatcattccctttgtgatatttccctccaattgtccccatgttttcactgtatttaaacagttcatgtttctttgagtatactgtgagttctttaagaagcttgtcctatttatttttgtttcctcattgcctaatactactggccaatacttgttactcagtttttttaaattaaattgtctatgataagcagaatggtccttgaaaaattttaatctccttctgaatctatcaaataaagaaaataccaccttacctatgttattcaaaggtttctggtgaagagcaaatgaagtaataggcatggaaatgtttgaagaatgttttaaaaatgtgatggccttattgttgtttataacaaaatttcactagaattaatcctcttggtttcttacaagctttattatggtggaactttgccttcatatatttgcattggttaaaattatcctaatattaaaagactttaaagatttttatttctaatgtttccagtaaaactgaaaataacttagttaaaaaatatttttgcatttaaaactatagaaaataaggcattttctttataaaatctcagttgtatgtgtgtatgtgagtgtctttttggatatctttgattcagtgaatatactgagtactgctcagttcaggcactatgatcgtgatcacattacagtaatagctaatatttagtgaaccatactacgttactgtgctaagaacatcacatataatctaatttaatattcacaataacccttattatccacattttatataggtaagtaacttgccagaggtagtacagccgctgatacagaaacccagtctgacttcaaaacctgacctttaaatattgtgctcagggatcagcaaactataacacccacagcctggttttgtaaggcctgccatattttcaacaggttgttttaaaaaaaagatgtgacagagacatatgtggcctgcaaagcataaaatatttactatctggccctttacagaaagtgtttgccagcctaaagatggttaaagagagtccctgtaactctggaagctcccaatccaaataggaaataaacacaaacattttaaaagtctgcctcaagaggcaaaatgtggttagtgatgttattataaagatttaaacaagaatcccaagggggccaggtgtggtggctcacgcttataatcccaacactttgggaggttgatgcaggaggatcgcttcagactgggagtttgagaccagctcatcaacatagtgagacctggtctcttaaaaataaaattttttttaaattagctgggcatggtggcacatgcctgtagtcccagctacttgggaagctgaggtaggattgcatgagcccaggagtccaaagctacagtgaactaggatcatgccattgcactccagcctgggcaacagagcaagaccatgtctcagaaaaaaaaaaaggaaccccaagggattggaggttgtagtcattccagccagaaaacttagaagaaatggcatttgaactggttttgaaaaagttgtaaagtgaccagacatcttaggtatagaaatctgcacacccggagtacttggcaggtgatgataaaaatacttgcccatgacatgccaagataccagaactcctgggcattatttttccttctacctcttatttgctgaattatgtagaagagtgcatcaaaacatctgcttcttagtttagcctttagtcagttgtgaataaaaaattggttctgatagttatcttgtatttttcaagtgaatcaaaaacaaatctgatagagggtgcttcagtgcaagttattttttaagctgtaaaaatgtgaaaatggtagtgctttagttaaataaaccttgcattttgtattcagtcttagctgtcattggattggcaaaactgaaaaccaatgtttacattcacagtaattgcaatttttttttttttttttgatacggagttttactcttgtcacctaggctggagtgcagtggcaccatctcggctcactgcaacctccacctcccaggttcaagcgattctcctgcctcagcctcttgagtagctggaattacaggcgcccaccatcatgcctggctaattttttgtatttttaatatagatggggtttcactatgttggccaggctggtctcgaactcctgacctcgtgatccgcccgcctgggcctcctaaagtgctgggattacaggcgtgagccaccactcctggccaggtttcttatttttaggaattcagcatgtaattttataatgcatttgcattaatttgggagaaaaaatgaaaccatgcttttgaagaatattggcaaaagttgtcaagttaagatagaattgcttgttaggaaactttttaattgaattgaggaaatgacacaagattggcattgttattactcaacccttgattgtaaacagtgccaaaaatataataacactgccatgaaagatttatattttgtaaataaagcacacagaaaaatattaaactacattgggagatgcattttctgccaacataattaagaatattacagttaaataatcaaatatttggatattgaggaattttattctcaaagagaaaaaaggatactttatgtggattgaaaaatattccagacaccaaaaataaaagcagaggaggcataaagattccctgattttacagtttgtgtagaatagcatccattgtatgaataatgaatattatgtctatattcatgacatttttttaaaatctgataatagcttcaagctgtttctttttctgaatatcattaatattaatatataatcattaaactaattaatgtgtatgtgggcaaatcactgttccctattctattgtggatatataattgaaattaaatgtttctcatttgaataagtgaaatctcttctttgaacatttttcttagcctgaaaagaatatatattaatgataagtagcaactttggtttctttgttatacgttggtgcagatattttggttggcattgattttatattaaaaatatatatatattttatcgcattttcagtttgataaaaagacttctactataataactataatatacccttaaatatttatcagtacatattcctctgtattttagtagtggaattatctatgtaattgagtgaaaacaggagtaaccacagatgcataaaaaaacacatctgtaaattattgcatttgccatcttttattaaagactgccttgcaattctgtttcacggaaatgaattaccagtaggtctttagagtatgctaagatgacgaaaagggaagaaggaattcttctcaaaagatttgaatgtagtctttgagttgtagctaaagaatagtctgaaccctctatctactcatgtcattctttaaaaatagtggaaagaaatggttccaaaagctatattttgaagctattatctgttgtcaagggcaaactagcattttaaagctattgctttgatatggtttagctttgtgtccccacccaaacctcatcttgaattataaccccgaggtgttaagggaagaacctgatggaaggtgattgaatcatgggggcagtttcccccatgctgttcttggtgagttctcacacacttcgtaagcatctggcatttcccctgctctcacttctctcacctgccaccatgtaagacttgcctgttttgccttccaccatgattgtaagtttcctgaggcctccccagccatgtgaaactgtgagtcaattaaacctcttttctttataaattacctagtctcgggtatgtcttcatagcagcgtgaaaatggactaatacatgcattttggtaaaacagtatgttattatccagtttcatgtttaattagtttaatttaaattaatcaaatgccattttgtattaggggccacaggtaagagaaactcacagaaaaggattgttgaatttgtggatttttaaaggccattgctgtctcctttcctgcctcctctctatatttaggctagtgactaccagaaagaaataggaagataaaagctcacacttaaaacaaacaaacaaacgaacaaacttattttacagtcttttatcaatggagtatgagacagcatatttttgcaaagtaccgctccatttcctaattcaaaaaggagatttggacacagttttccctggcagcactgaaataagaatttgctttctctcagtggccgtataaaacagtgagaataatgcagtcaactctctaaattaatttaaagaaatataattgtagatagtttgaaatggtaaatattcaaaaaattaattttccttcactttggacagttgtatgccatgctattgtaggttaaccctattaccagaaagggggtcccaatccagaccccaagagagggttcttggatctcacacgagaatttggggcaagtccatagagtaaagtgaaagcaagtttattagtaaagtaaaggaataaagaatggctactccatacgcagagcagccctgagggctgctggttgcccatttttatgattatttcttgttacatgctaaacagaaggtaaattattcatgaattttctgggaaaggggtgggcaattcacggaactgagggttccttcccattttagaccatatagggtaacttcatgatgttgccatggcatttgtaaactgtcagtgatgctggtggtagtgcctcttagcatgctaatgtattataattagcatataatgagcagtgaggatgaccagaggtcactttcctcaccatcttggttttgatgggttttggctggcttctttatgcaagttgttttatcagcaagacctgtatcttgtgctgaccttctgtcttatactgtgatttagaatacctgacctcctgggaatgcagcccagtaggtcttagcctcattttacccagcccctattcaagttggagttgctctggttcagatgcctctgacaactccagagtagagaagtggtgaacagaggccacagaaatgatgagcagtctacctaccatgtggagaagacacctcagaaatggagagattttatatttttgttgcatgatggtaaacagctgtaaccaccagcttggcctttttggcagctggctttatttagcattttaagctttaagtttgcctctggtgcctggaattgttcaattaaaattttaaatttattcttatcatcctctaacacaaagcttacttatacaataccaaatctagcctgagacacttgttcttgaatcgattcttttttaaataataagttcagtatgaaataaatctctgctgaaatgaaagaaagcacccattatcatggaactgtggttcctgaaagctacttaggtaggttaatagttgaggcctattaatggatatgccatattattacattaaagccattctcaatgaaggattaaagttgttagttttaagagttgtttttgttttgttaagaacagtttgtacaatgattgatttttgtcaaagaattgaaaatgccatctaatacaggtagggagaggaggttgattgtcagtttgatttaagtcttaaaagttcatcaattagcaaagaacaagaaactgtttttttaagagggcaaattttatgtatctgtttaccatgaaagagaacttaagagaagctgtatttccacttttatcaaattagaacctttatgtcaatattaaccagaaaatccttagttacaaacttgaaaacatctatacttaaggacagttgttctgttcattcaaacagaacaagtttcttcccaggttgagaagtcttaggtaacctgtgactcatgctttaattttaaactacttcttcatatggcctttcagttgaactaaaaaggccttagatttagtagaatggactctttgtgtttctaatttgtgataagtttggcctttgttagttggttagaggtttccttgaatcattccaggactagccctctctttagtcaaagagaaaaccttttcccatccttaataattttaccagttactaggtaaatcattccaggactagccctctctttagtcaaagagaaaaccttttcccatccttaataattttaccagttactaggatatcatccttttttacttttaatctttaaagagtttttctcagttattctttccagaaaatcacatggtgaggtatcattatttttaattaacatagaactgaagaaaaaaagagagattgtgttaattggacagtagtgttagggatcagaattttctggatttaattacatttgtatcatattgtcattttggtgatgccaaatctgtttatttagcataatttcctttaaataaaacttttaagtttaaagcaatgaacacctattgctgaaaaacccagaaagtacagaaaatccaaaaataaaaataccacttaaatatatatgtgcatatctatatgtattctttttggtcggttttgaatgaatatatttttaaatattagagtttatttcttagagcagttttaagcttatagaaaaattgaacagaaaataagagttcccctatataccccccactccccctaccccctgcaccaagtgccagccatgacttattctccccaacctttttaagagagtcccactctgttgaccaaactggagtgcagtggtgcgatcatagctcactgcagccttgaactcttgggctcaagcagtcctcccacctcaaccaccgagtagctgggactataggtgtgctaccatgccttgctaagttttaaattttttgtagagacaggtcttgctatgttgcccgggctggtcatgaactcctggcttgaagcagttcttttgcctgggtttcccagtgcactgggattacaggcatgagccaccatgcctaaccctctattattaatatttgtattggcatggtatatttgtcataatcagtgaagtgatattgatatattattaactgaaatccatagttcacattagggttcactttgtgctgtacaattctcttgcttttgccaaatgcataatgtcatttattcactgtagcataatcatacagaagtttcactgtcctaaaaatctcatgctccacttatttatccctccccacctgccttgccccttaacccctggcaaactaatcttttaaatctccacaattttgctttttccagatgtcatatagttggaatcatacattatgtgttttttttctgactggcttttgttttttttaaggttcctacatgtcttttttgtaactttacagctcatttctttttattgctgaattgtactgtattatatggatgcatcacagtttatttatccatttaacaacagttagttggtgctggaactggacatccacatgccaaaaaaaaaaaaaaaaaaaaaaaaaggcaggggagttgggattagacactgaccttatacctttcacaaaaatgaactcaatatggatcatagatgacatcttgattgcttccaattttttggcaattttgaataaatctaatgtaaatatttgtgtgcaggtgtgtgagtgggcatacattttcaactcacttgggtaagctgtagcagtgagattgctggatcatatggcaaaactatgtttagctttgtaagaaactgccaaattatcttccaaaacggctgtctatctaggctgttataacaaaatataaactgggtagtttaaacaacatacagttttggtgagggccttcttcctggtgtttaccttcgcatcgtggagagagaaaattctgtgtctcttcctcttcttctgagaccaccaattccatcatgggaactctaccttcattatctcatgtaacttaattacctcccaaaggccccatctcctcataccatcacactggaagttaggacttcaacatatgaatttgaggggagaggagggactcaaacattcagtccataacagtgattataccatttggcatttgcagcagcaatgaatgagagttcctatttcttcacatcttccccagcatttggtgttgtcactatttcagattttagccattctaatagatatgtggtagtattctgttttaatttgcaattcactagtgccatacagtgttgagaatcatttcatatgcttgtttgtcatctgtacatcttctttggtgagatgtctgctcaggtcttttgcccattttataattgggttgttagctttcttactattaagttttaagggttctttttatattttggaaagagttcttatatattttggttataagagttctatttatatataaagttgagttgagttggatataagttctttcatctgtgggttttcatttcattctcttaactatgtctcatagagcagaggttttttgtttgtttgtttgtttttttgttttttgttacagagtctcgctctgtcgcccaggctggagtgcagtggtgcaatctcagctcactgcaacctctgcctcccgggttcaagcaattcttctgcctcagcctcccaagtagctgggactacagccacatgccaccgtgcctggctaattgttgtatttttagtagaaatggggtttcaccatattggccagactggtcttgaactcctgacctcgtgatccgcccacctcggcctcccgaagtgctaggattacaggcatgagccacagcacccagccgagcagaggttttcaacttcactgaagtttaacttctcaattgttttattttatggattgtgcttttggtgttatatctgaaaactcattgccaaatccacagtcacctaaataatctcctgtgttatcctctagaagtgttacagttttgcattttacatttaggtctgtgatccatgttgagttcatttttatgaaaggtataaggtcaatgtctagattctataccctgtttttgtttgtttgtttgttgtttttgcaagtagatgtctaatttttccagcaccatttgttgaaatactatcttttctccattggattgcctttgctccattttcagagatcagttgaccatctctatgtgggtctttttctgggatcttctgttccattcatctatttgtctgttttccaatatcacactgtcttgattactttatatataaagtaatcttcaaaaaagtctttgaagtcaggtagatcagtcctcttactttgttattcttcaatgttatattaactcttttgggtgttctgcctttctgtataaactttagaattagcttattgatagccataaagtaacttgtcaggatttcaattgtgattgtgatgaatttatatataaagttgagaaaaattgacattgacaatattgagtcttctatccatgaacctggaatagctctttatttatttagattttctttggtttctttcttcagttttataatttttgtcatatagagctcataatgtattttattagactttaacttctgtcatccctttatctctctctctctctctctcattcttgtgctaatgtaaatggtggtgtgtgttttaaatttcattgcccattggtggtatataggaaaacatttgactttttttttttttttgaaacaagagtctcgctctgtcacccaggctggagtgtagtggcgtgatcttggctcactgcaacctctgcctcccgggtgcaagctgataatcctgcctcagccttccgagtagctgggattacaggcgtgtgccaccacaccgggctgattttcgtacttttagtagagatggggtttcaccatgttggccaggctggtctcaaactcctgacctcaggtgatctacctgcctcggcctcccaaagtgctgggattacaggcgtgagccaccacgcccagccacatttgacttttgtatatcaaccttgtatcctacaaccttgatatagttacttattagttccagcaggggttttttgctggtttttttggggggtggaggggcaggggcaagttgccaactcttgggatttcctacataaatgaccatgtcatctgtgaacaaagatagttttatgtcttccttcccaatctgtataccttttctttctttcttttgtcttattccattgacttctgctactgactgattccttttatttttagtgttacgtaggaatggtgagaggggccatccttgtgttgttcccaacttaggaagaaggtatcaagtttctcaccattatgcagtttgctagctgtaggctgtttgtagatgttctttcttgctgagagtttttaatcatgaataggtgttggatttggtggactacttttcttgcatctattgatattattaaattatttatctcctttagcctgttgatttgatggactatcttgattgatttttcgatgatgaactagcactggatgtctgaaataaattccaattggtcatagtgtataattctttatttatttatttatttatttattgatcattcttgggtgtttctcgcagagggggatttggcagggtcataggacaatagtggagggaaggtcaacagataaacaagtgaacaaaggtctctggttttcctaggcagaggaccctgcggccttctgcagtgtttgtgtccctgggtacttgagattagggagtggtgatgactcttaacgagcatgctgccttcaagcatctgtttaacaaagcacatcttgcaccgcccttaatccatttaaccctgagtagacacagctcatgtttcagagagcactgggttgggggtaaggtcatagatcaacaggatcccaaggcagaagaatttttcttagtacagaacaaaatgaaaagtctcccatgtctacttctttctacacagacacggcaaccatccgatttctcaatcttttccccacctttcccccctttctattccacaaaaccgccattgtcatcatggcccgttctcaatgagctgttgggtacacctcccagaccgggtggtggccgggcagaggggctcctcacttcccagtaggggtggccgggcagaggttcccctcacctcccggacggggcggctggccaggcggggggctgacccccccacctccctcccagatggggcggctggccgggcagaggggctcctcacttcccagtaggggcggccaggcagaggcgcccctcacctcccagacggggcggctggccgggcggggggctgacccccccacctccctcccggacggggcggctggccgggcggggggctgacccccccacctccctcccggacggggcggctggccgggcggggggctgacccccccacctccctcccagacggggcggctggccgggcggggggctgaccccccccccacctccctcccggacggggcggctggccgggaggggggctgaccccccgcacctccctcccggacggggcggctggctgggcggggggctgacccccacccccctcccagacggggtggctgccgggcggagacgctcctcacttcccagatggggtggctgccaggcggaggggctcctcacttctcagacggggcggctgccgggcggaggggctcctcacttctcagacggggtggttgccgggcagagggtctcctcacttctcagagggggcggccgggcagagacgctcctcacctcccagacggggtcacggccgggcagaggcgctcctcacatcccagacggggtggcggggcagaggcgctccccacatctcagacgatgggcggccgggcagagacgctcctcacttcctagatgggatggtggccgggaagaggcgctcctcgcttcctagatgggatggcggccgggcagagatgctcctcactttccagactgggcagccaggcagaggggctcctcacatcccagacaatgggcagccaggcagagacgctcctcacttcccagacggggtggcggccaggcagaggctgcaatctcggcactttgggaggccaaggcaggcggctgggaggtggaggttgtagcgagccgagatcacgccactgcactccagcctgggcaccattgagcactgagtgaacgagactccgtctgcaatccaggcacctcgggaggccgaggctggcggatcactcgcggttaggagctggagaccagcccagccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagacggcgagatggcagcagtacagtccagcttcagctcggcatcacagggagaccgtggaaagagagggagagggagaccgtggggagagggagagagggagggggagagggagaataattctttttatacattgttaggtttgatttgctaatattttgttgaggattttgcatctacattaatgagagctattagtctgttttctttctcatgatgtctttatgtggttttggtattagtgtaatattagcctcatagaatgatttaggaaggattccttctgtttctattttctggaagaaattatacagaattggcatcatttgttccttaaatgtttagtagaattcaccagtgaaactatctgagtgtggtgctttctcttttggaaaattattgtttattctatttctttgatcaatatagagacctattcagattaccaaattctccttgtgtgaattttggtagattggatctttcaaagaattggttcaattcatgttagctatcaaatttgtgggtacagtgttatccataatattcctttattatcgttttaacgtccacgtgattagttgttgtggcctgtcttttatttctaatattagtaatttgggtcttctccccttctttctcagttagcctcactagaggtttcttcattttactgatattttcaaagaactagcttttcagtttgttaattttctctgttgtttttctattttcagtttcattgatttcttctgcttactttggatttaatttgtgcttttttctagtttgctaatatggaagcttagataattgggtttagctttttcttccttttcattatgtgtattcagtgctgcgaatatacatttaagtaccacttttgcagcgttccacaaattttaatgttttattttcatttagtttaaaatattttttatttcttgacatttctttgattcttgtgttataaataacacaaagtgcttcagctatctttttgttaatgatttctagttccattgtggtttgagagcatactttgtatgatatctgttcttttaaatttatatttgacccagccatcccattactgggtatatacccaaaggactataaatcatgctgctataaagacacatacacttgtatgtttattgtggcactattcacaatagcaaagacttggaatcaacccagatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcacttataggtgggaattgaacaatgagaacacatggacacaggaaggggaacatcacactctggggactgttgtggggtggggggaggggggagggatagctttaggagatatacctaatgctaagtgacaagttaatgggtgcagcacaccagcatgtcacatgtatacatatgtaactaacctgcacattgtgcacatgtaccctaaaacttagagtataataaataaataaataatttgttaaggtgtgttttgtaggccagaatattgtttagcttggtgaaatgttccctgtgaactcgagaagaatgtgcattctactgtggctagatgaagtattctataaatcaattagattgatggtgctgctcagttcaactgtgtctttaccaatattctccctgctggttatgtcaattactgatagacaggtattgaagtctccaagtataatagtgaatttgtatattctcattgcaattctgtaagtttttaccttatgtattttgacagtcagttgttaggtgcattatacatattaggtataattgtgtcttcttggataattaaacctctgtcattatataatgctgtctattgctgataatttttttgttttttgttcatttttttaaaaacttttttattcaatattagagctcaggtaagatattgctgataatttttcttgctctgaaatctactttatttgaaattggtagagctactctagctttcttttgatttgtgttagcatggtgtatttttctccaaccttttacttttaacctatgtgtatatcttcacatttaaagtggatttttgtacctaacatatagttggtcttcttttttttttaaatccacttggacagtctctgcctcttaactggtgtattttgggctatttacatttaaagcagttattgatatagttgggttgtttctataattgtggctgttttctatttgttgccctatttttgtgtccttttttatcttcctctagttttctgccttctctggttttaatgggtcattttataatgattccattttttattatgtcttagcatatcagttataacttcttctagtggttgccccagagcttgcaatatatatttaccacaaatccaaatccactttcaaataactttatatatcccttcatgggatatataatgccaagaccttataacagagtattcctaatttctctctcccatcccgtaaagcattactatcattcgtgttagttatccataagctatgatcaccaaatacattgttgctagtattattttgaatacactgtaggtaaattaagaacttaaaaaagatttcatttatacctctctaacactcttctttatacatatttgagtttatgatctatataattttccttctctctgaagctagcaacaaatttcctgttttgtttatctgagaaattcttaattatccttcaaaagtgaaggagaaatactgcagaatgcagaattctaaatgggtggttttattctttcaaaggaattcaaacatctttattctattccactctcttcttgcttgcatgattcctgaagagaaggcacatgtaaatattgttcctctctagataaggttcctccagcccagcgtttttcaaaatttttttctgactttttgcagtttgaatatgttattcttaggtgtagttttatttctttggggttttttgttgttgtttgtttgttttttgtatggatacttgatgttctctaggttttatagatttgtggttttgtgtctctcattaattttggaaaattctcaggcattattatttcagtaattttttctttttctttcttctcctctggtactcccattacatgtatgtccaccttttgtaaattgtcccacagttcttggatattctgttccattcttttaattcagttttgtaagtttatgttcacatatctttaagctgattctttccttggtcatatccaacctactactgaggccattaaaggcattcttcatttctgttatggtgtttttttatttttagcatttaaaaaaaattttttttccttggagtttccatctctctgcctgcattactcatctattcttgcatgttgtccatttgtttattattaggtttttagcctattattcatagttaaattcccagtctgttacttgcaaactctctgtaatatcggagtctggttctgagggtttgtatcttcagactatattttttgccttttagcatgccttgtaatgtttttattgaaagccaaatgtgaggtattggataaaaaggaactgaagtagataggctgttagtatgaggttttgtgtttatctggctaggagttggggtgtgcttactgtagccatagctatggtatcagatgctaaaatttcttctagtgtccttgtttttgtctcccttgtctttaggccttttagagactcctgaaataggcagttcttttagctgcaatttctccttattgttcatcagtcttattgatgtgatggtatggtttgtggggaggaggaagtgttccgtagtaatatcattaggtctcagtcttttagtaaacctgaattgggtatttctcttccccctggtgggttaggctttgataaaactccagtagattaagctctggtaaactagttttcctttaggccatgcgttgttaaggatctgttgagtatgaattgagctaaaacgtgaaaattctctggaactgaagaaaagtacaattatgttttattataatgatagtaatcatcacaaacagctataaaaaggaatatgaggccaggtgcggtggctcacgcctgttgcctgtaatcccagcactttgggaggccaaggcaggtggatcacctgcggtcaggagtgaggtgggtggatcacctgaggtcaggaattcgagagcatcctggctaacatggtgaaaccccatttctactaaaaatacaaacaattagctgggcgtggtggcacattcctgtaatcccagctactccagaggctgaggcaggagaatcacttgaacccaggaggtggaggttgcagtgagctgagatcacgccattctgagatcacgtcattccactccagcttggacaacaagagcgaaactccatctcaaaaaaaaaaaaggaatatgaaaataagttggttttaaatgtaatgtttaatttttgtaacttctgttattataatgtgtagaaatattccaagtgagattcttataaatgaatttcaatatttatttcaatatgaaatctacaaaattctgaatggagggacagacattctagcaataatacatgcctagcataatttcatctggctctgtacttcatataaaaattaaccataacttcttacattactgaataactaaaatatagattctataatgtttatcgaaatgctcaaagatcattctttgggtccaggaaattagaggcaactgcctggaaaagtgtacagtaaaataataaaattaacaaaaacaagaataatatctcttttcctgtcatgtactatttcggtagtatatatttatgaaatagttgatgggtctgaggcagaagacctatgtatttctgaagtattgtgcaagcagtgagaagaatagaagtgtccatgtagcttagcaagtatttatattccctttttgtaggtatttgaggtcttaaactattatctaagaaactgttaaagttcttaaataaaggtagaacctgagtaatattaacgttttgcatcgtaaagtaataaaactgtggcatttgcaaatctcaaaaattaccaagaatgatgcagttgtgatgctggatggtaggctcatctattgtctaggtaagcgatcatttcctatagcaaactgtgggatccctgttaggtacggcacgttatattattaagtttatttattcaattacgcatttattttgtgctttttatttgcctgcaatagtggtagttactaaggcaacaaaatgaataggtttatgtttatgtccttgttccagacttatgggggagacagatacacataaaaacatgcagtttgctaaatgcaatgattgagatacctctgagagttaaatttctgaaaattttaattcctgaaagccaaagattttctgtaccacttctgtgtggagtacatatcaaatgtcgggaccagggatactaattattaactctccacagcccatctaatagaatctatttgaggaatacacctctcgctgtcttgtgtatgtcatgtaaacactccctcccttctacacacacacacacacacacacacacacacacacacacacacacacacacacacgcccatgcagaaacacatgcccattcacacctgttcctaaccctgggaaactaatcctttaggctgggctctgccaatcaaattccctgtttagaggtaatgtaacctggtagttgtgctctccaactctggagtctgactggtctggattctgactccttcactggtcatctgtaagtgtacttgccccataggattgttctggcaattaaaagaaataatatttctaagcatgtagcacactgctcagcacatggtcttagtgttagaatcattacaagatagggactctagtttacatggaggtgagactaagctgtaaaatcttgtagactgatgctgatacctacaaggtgggctgtgagcaagagataagtcacttagcagaaaggagagtatagcagacccacccagaccccacagccacatagaaatgggtaagaattgcagatttctcattgcgggaagatcagttatactttctgctcttcatctcttggcaattccattgtattctttcagtaatctttcttttcatttgagctaatttgtctaggtttttattccttacaaccagtgaaccttgactaacaccattctcaaagaatatttactggttttttttatataggttagaggaaataatcatacgcaagttacgttccatgtagtactaacttctgaactccagtattctttatgaattatatattctagtctaacccagcaggtagcatcatcaggcataagtaatattctgtttttcctcttcttatacttttctggtttttgtggtatatctacctcttatctccaatactgcaaggaaaagaaataatttgttggtacactaagaaaatgcatcctttagagccaaaatgtaacataatctgattatgttgtatatgttgtttcctgtgcactgaagcctaagaagagcattttgggttatatcactgattcattccattcactactctgattaacagtgattctcagtgactttgtaggacatatggttgccatccatgacatcaaggcctgaatattcatattttcccccaaacatttcatctctgactttcatattctgttgtgacaattagttctgtaagaattttacatattgtataaaagttttattttacatgctcttaaactactttcttttctttctttctgtttttttttttttttttttttttttttgagacggagtcttgctttgttgcccaggctggagtgcagtggctcaatcttggctcactgcaagctccgcctcctgcgtacacaccattctcctgcctcagcctcccgagtagctgggactacaggcacccgccaccacacctggctagttttttgtattttttttgtttttagtagagacggggtttcaccgtgttatccaggatggtctcgatctcctgacctcgtgatccgcccgccttggcctcccaaagtgctgggattacaggcttgagccaccacacccagcctcttaaactactttcaatgaaagggtcctagttctaagatttaatgaacacattcttgaacccccatccaaatatttggatttttgtaagctttgaacatactgcctctcagcgttcatctttttagatagaagagaatcatcctattgtcatttggggggatcaccactcttttaaataaaatgatttgtcttctttattagaccattctttgatctgcagtggttgaaccacacatatttatacataacacatcatgtatgtgtgtccaacttagtgatctgttgaattaactttaaaatcattttgcgtcccctctaaaagttctttctctaatctttttaatcttttataaatttcactgacaagaataatgttaattttaatgataatcagggctgaaatttatttctgaaaacataaaatatttgtattcatgttgtgattcattttggataccatcaggtgttatatcccaaattttggatcatatcatcaagagtagatactttaatttataaggtcttcatgagtaaactgaaattttttatccctaattatgtcacttaagaaattaaaggaggaaatatatttaaggacggaagcaaaatgtgtgtgctttaatgtttaatggttggaagtaagtgtttaaatagataataggaagaggagtttacaagtttaataaacctctttgtgataaatttgctcctgggttttctgtcccaaagtaggctatttttccttcatggaaagcttattacgtaattttacataattattagaaaatacgactgtcacaggacagctgattctcattctctaagggtattattaactcttaaccatgagctttaagataactaaaatgcaccctaaatgtgtcatacaaataaattaaatttgagataagctgtctttagctattatttttctttctttggggatcccagtatgaacccaaaatgacaatttatgaagttgttaagccacaattcacatccactaattgctttatatggctatacatgatgatgcatgtttgaagtttatatcatttatgtaaattcctagatctagtacacattatagagaaaaatctgtatcttacccataggaacttctctagagcccctccttttatcatgctatttaaactcacacctggagtagccacctcgcctctccctttgttattccatgaagagtcattttgagtctcactgaaactatgataatggagtgggaatggaataggactaaagattctggaatcagaatgtctgggttcaactcctgtctctgactcctagctgagtgaccttaaataaggtgcttaacctcagctataaaatgggaacaagaggccgggcgtggtggctcacgcctgtaatcccagcactttgggaggccaaggtgggcggatcacctgaggttgggagttcaagaccagcctgaccaacatggagaaaccctgtctgtactagaaatgcaagattggctgggcatggtggcacacgcctgtaatcccagctactcaggaggctgaggcaggagaatcgcttgaacccgggaggcggaggttgctgtgagctgagatcatggcgttgcactccaacctgggcagcaagaacaaaactccatctcaaaaaaaaaaaaaaagggaacaagaaagtacctcatcacaactttgcggattaattgagataatgcgttggaaacatttagtatagtaccgcgcatacagttggttctcaataactgttagctcttaattccagttgctaatagagagctgggacaaggaggtataaatgcagcggctatgttagaagcatcttatagcatggctcattgagaaaaggtgaagtagtatatggaaaaaaaggagtctggcccttcatccctgccagaatctttatgacctcagatgaatataggagtatcgtaaaatgatttggagctaccaggtaagatgttgtggcctactgataaataactgtctacaggttgaggcgtgtgttacatagggtagaaatttttgtggtttttttttttttaaacagagttttggtgtgtcgccaggctggagtgcagtggcaccatctcggctcactgcaacctccacctcccaggttcaagtgattctcctgcctcagctactcagcctcccaagtagctgggactacaggtgcatgccaccacgcccagctaatttttgtatttttagtagaaacagggtttcaccctgttggccaggatggtcttgatctcttgacctcatgatccatctgccttggcctcccaaagtgctgggattacagacgttagccactgcgcccggcctagggtagaaaattttaagtaaccttctaggcgaggaagtggcagaagtcttcctttgtaaattctagtccaagttctaaagaaagttgtcatgatactgtctttgttttaagctcaaatgagaaattgtatgagaaacataatgtcaagtatcaaatctgtacaaagcattgtcttttaaagcaatggcaagccaaagcctacttcccaccatatcagacatctcctccttgccctgtttgctacatgtatcttcttccctcctcccacttgcatgctctgttagttaaggtttcatgccttttgcttcatagttctttttcttcatttatggatatcccctcttcttcccaattaaacccaaaaggataaaatatagccatttttttgagtaatacctttacactatttgtttcagctatgccaccagaagctatagattgtaaagtattaattagctctctttctagagattttacacagcgcaaaaggaagggagagtggagtgacctatgtcagatcatcagtagcagtgacagtagcagctgtggtttggcacataagaccatactccacaccccatcatctttcttccacaatggaagcagaggcagctggggaagaagatacattgtgcagtctgagatggcagcaagagttaaagatgggagtgtgatggtagggtgaccgttgaagctactggtactttttagattggtggaatttatgatactagggagatttgctgctccagttcctgttttagtaggctaagatgtacgtctgttttatcagcaatttgtacagcactttagctatgcaatactaaattaagctatacagtgttacactaactgccctctttcctcatattccatagaaatcttaagtgttttgtttttgcttcctttaacatgactctgcgttttcattttcttctcttacgatgtggccagaatttctacttaataattcttatatcttagggtattgacctttacgtataatgaagaaacccaataggtctccctgatttaacataattggatgataatttagcagaaaaattacaaatagccttaaagccattgtgaaacatctcattcgtaactcctcaagtatgctaattacagaggcagctgtaaaattcacccagagcaaaaaggaatccagtgtgctgactgacagcttcatcctgcgagatcctgatggcatacctgcttattctagtcgtttctttcaagggggcatgacatgtagtgaaggaataaggggaacttaagagtggaattgtgatttttttttttaaatagggcaatggaggaaagtgaggctggaatttagctcttgggtaaatttgatgaaattaagccttgccttcctactgctttctgttcctatattcttgtttcttgccaatgaagagaagctgttctagtatctttgtgatcctttgagccggaaggaggttctaagttaggagaaagtactaacttatttaaaaaaaatagaacaaacaaaaaaactccctcaaacgtctagccatggactcatagggtcttatgaatcatcaaagagactgttggcagtatcccctttattagcaagctgtctgtagtctgcaacttcttggcaaagcaacttttatatgtttataagttaaatggctaaatttgttttagaaatattaagagtgacttcagggagccttctgtttagtggcatgaagcaaacaaatctcttttgtcttttttcttttgacactgtcctgcctgccttatcctgaactgcataactcactaagatattacctgttttccattagccattcttttagtccccaacccagagttaagtctgtcagaatatcattgagatcagttaaccataagtttagctgcctttgcaaggcatgtctgttgctattaaaagcagcaggcacctcatgagaatgctgcccagtcattcccagagtgtgatatgctaattcttaagaatgttgctaacactgcactatgtttcatatgattcaatttagaactttttattcaattggttggaggcttcaagttgacagtaataatagtctttcaagttgttgactaagtagagcagtgatagaattcatatgacatagaattcatatgacaggccatagttgctcattcaagtccaagaagagatctctacaggccacagtggctgaaaaacaacaggaaagtagcctagatgttcactttttaatagtataacatatctttcctccctattttaagtgaaaacagatctctgtcattaaatgaggatataaatatttatgtcatcattgttgaaatcccaaagaatagaccttacacatttctgtgttcattttaaatggccgtcttttgtgtccaagttaaatttaaaaagctccctcatccctctaaaggtctcaccatagctagttagctttcagccttgatctccttttactcttgcctcctctaaaaactttttgatagttctctaagaacctaatcggagtcatacttggcaatacactgttaaagaaaatgtgtatcctagaagtccagatagtctttgtagatataaattaaacatacaaatcccttgctgtaatatgagcagaaagtgttactgttttagacaagtagctgctattctgtgtttcagtacagaacagggttttggtcaaatcaaggtagtgatgacagaatgtcagaacttcacggtagctaggagtccctactcttcattgtagtcatttattgaatattttgaaaaggtaaaaactgctcattgttttattgtctgtggtaaacagcatgaattagatatactttgggcataaagtgctcactgaaatggggtcctttcatatatttttcagataatatgatattttggcaaataatctcttcctagatcaaactatagctggcttattgagaattgttcagcagaatcgtccccaaaataaagaactaacattttctgagaattactttgtgtcagccattgtgctaagctttctacatgtaacattttatttcatccttaaaataacttaatgagtaagatactattatcagtcccattttatagatgagtatggtgctaatattaatgccattttccagatgaagaaactgggatgaagttaaatataacttcttcaaggtcacacaactggtaagtgatagaggatttggacaccagtttttgtgattccaaagcccatactctcagccactacatgctacagtcaaagactgcatgcataggcatttgccttagtatattttgcttgatgtgcctctctgctccagcctccagcaagactatgggtttcagcgatctcccctttgctaagggcagataagagtgttacctgtccttagtaaagagaatgaatgaccttataaaacaggattattaaccagaggagtgtcagtccgtttgggctgctataacaaaatactataaactgggtggcctataaacaacagcaatttatttcttgcagttctaaagactgttggcaccaacagattcagtgtctgatgagggcctgcttccttatgggtgatacttttttgctgtatcctcacatggtagaaggggcaaacaagttctctggggtctcctttaaaaagttattaatcccattcatgagggttttgcctgctcttatgacttaattacctcacagagacctcctaataccatcaccttgggaagtagggatttcagcatatgaatttggggggaaaataaaaattcagaccatagcatggagacagacttgaaaatgttcctgaaataatcagtaataaccatattaattcatgttgaacggggctagtttgtactgattctttataaatgtatagtgctaacttatgtgtgatttttacatatgaaacgttttcttgctggaaggttggtatggtgtattcttttagagccttaaagtcttgatggaatggcagggctctcttgattaaactggccatacttaaattattttttaaaaaatatagattccaaaatggctgaactaatttacattcccaccaatggtgtacaagggttccctttcctgcacatcctcgccaccacttattattgtctttttggtaatagctattctaacaggtgtgaggtgataactcattgcagttttaatttgcatttctctcatgattaaagagcatttttttccatctatctgttgaccgttagtatctcttcttttgagaaatatctgttcagatcctttgcccatttttaaattggattatttgctttcttgctattgttgtttgagttgcttattattatagatattagccctttgttgggtgtatggcttgcaatttttttttccaattcatggattatctcttcactctcgttttctttgctgtacagaacgttttattttgattcagttccatttgtctatttttgcttttgctgcctgtgcttttagagttctttccaagaaattgttgcccacaccactgtcatgaagcttttcccgttttcttcctatagttgtatagtttcagatcttaaagtcttataaccattttgagttgatttttatatatagtataaaagttcagtttcattcctctgcatatccagttttcccaatactgtttattgaagagatgagcctttttgcattgtgtgttggcacctttgtcaaaactcaattgaccataaatacttgggtttatttctgggctttcagttctgttccattggtcgatatgtctgtttttatgccagtaccatcctgttttgattacagtagctttatattttcaaatcaagtgggtctggtgcctccagctttgttctttttgctcaagattgccttgactatttgggttttttagtgaattcatacatatgttaggattgttttttctatttctgtgaaaaatgacattggaattttgatagggattgtattgaatctgtagattgctttggatagtgatacggttatgctttacatccccacccaaatctcatcttgaattgtaattcccataatccccacatgtcaagagacctggtggatgtaattgaatcatgggggtggtttcccccatgctgttctaatgatagtgagttatcacaagacctgatggttttatcaggggctcttccctcttcacttggcacttctccttcctgctaccttgtgtagaaggtgccttactttcccttcgccttcttccaggattataggtttcctgacgcctccccagccatgctgaactgtgagtcaattaaaccttttttctttataaattaccgaatctcaggcagttctttatagcagtatgaaaatggactaatacagataatgtggacattttaataatattagttcttccaatccatgaacatggtacatctttttttacttatttgtctttttaatatcttttgtcaatattttataagttttcagtgtatggattttcacctccttggttaaatttcctcctgttttattttttgatgctattgtaaatgggattgtttccttaatttccttttggaatagtttgttgttagtgtagggaaacactattgatttttgtatattgattttgtaacgtgcaactttactgaatttgttcattagttctgacagttaaataagccagtcacagaaagacaaacactgtataatctcacatgtgatatctaaaaacgttgatctcataggaagagtagaaaggtgataatcagtgcctgctgcggtcgggggatggtgtgggaggggatggggaaaggagagatgttgatgaaagggtacaaagtttcagttaaactgtaggaataagttttagtggtctgtggtactgcatggtgaccacagttaataataatgtatatttcaaaattgctaaaagaatttatttctaatgttctgattacaaaagaaggatacgttggtgaaataatgggtatgttaattagcttgatgtaatctttctacaacgtatataaatatcaaaacaccacattgaaccccataaaaatacatatacaattattaattttcaattcaaaataaattaaaacaaaacaaatatgtaggtttcataaagtaggatgtagtataagtaatgagtaaacactagggtctgatcttggccgttttattaacaatattacctttgagaatttcttttaatctctcttagtctatttcctctgtaaaatgaaagtttgaataaacctttgtttcccaaactctgaaagattactagagatgattttaggtggcatatgagattactttaggcagtgccttgataaaacattaaaataaacattgaatcacatagtaagaaagttactcctttttcaatctttctgattacatcaaaaagaaagtctcagtttggtattaagatatctttaatagttctctaacactggataattgtttggttgtgggggtagggtaggggtgagagtgaacaggtactgtgaattttatactcctcaagagtttccacatgagagtcacacagaacaatgaaagtaagaagaaaaaaagtttctacagaagcgaaattaattcccttagaatgaaaaagtacagaaatgcttttttgctctttctgttgacctcatttcccttgcacttggaacaaaatcaatgtgttatccaactggcacgtttggcaggaggaaccaaacgtgtgaggcacagccgtttctgacttctctcatggtgtggcccatactcaaggcacttctcttctaccatgtaataggctttggttgacaaactttgcttaggacaggatggcaactgtgagaaagtccacgaagccataaatccaaaccacaaaatcacattctgcaattcatcgacattggttatcaagctgatattttgattgtcattttatttctctctctttttcagttggtttcaaactcttaggaaatgtaagaggaaaagcagttattaccctttaaaacctcactaataatctccctttttaaccgaacttcagcttagagttttccataagcaatggtattcatatagaatttaataacatgtttttttcagtgaatttatatttatggttaacatctataaaagaaactcatttaagttttaaaagatgaattggcttttaaaatattaaataatacatatggtacatggatataaaaatcataaagatggtacacaaatgactaaaatttagaaaatactgaacaagattatttgtgagatttcttttagattaaaattcttttgcatgtatatttgaatagaatatataatgttatatggtaaatcaagtaaaagaagggctttctaacatagcatgtactatgttattttctttcattttgaaatatgttgttattgaggaaattaagcttttgttctatgccaattttcttctataagtgtaaatatcttttagtagtttactagacagtagcgtgtatctttttgatagcatatttgttggtgatgatttttttttaatctatttttctttcattgaatgcagtctagtctggatgagggttttgaactggaaatcttgagtagttattatttagaggtgaagaatcatgtcatcactgtataccctttctagcacagtgttcacgtagtagttgttttagctcgttttgcattgctataaagtaatactcaaggctgagtaatttataacaaaaaaagatttatttggctcatggctctgcgggctgtgtaagaagtatggtgccagcatctgcctctggtgagggcttcagaaagcttgcactcatggcagatggtgaagggacatggcaagagaggagggaagagagagaggggtgaggaagatgctgggctctttttaacaatcagttctgctgagaactagtagagcaggaactcactcattacctctagaacagtaccaagtctttcatgagggatctgcccctataacccaaacacctcccaccaggaccaggccccacctccagcactccaacactgggaatctaatttcgacatgagattaggagggggcaaatgcccaaactgtaacagtaatgatcactaaatatttaaacaagtgaatgaataaatgaatgaataaagaataaaaaactgagttctctgtcttaaatatgtgggcagtttttatttctttcttaaagctgttaatggagcaatctgtaaggaaactgaggccttgggttaatcagaagataacactttcatataagtaaaatttggagctagttacactgaacatttagaataaccttgctaggaagaagttgttaaaggaaggcagccctactaattttgcttttacttacaggaagctgaatttatggtcatatatgagactagggttttccttcctttctctcttttttataacaaaaaaattctccttcttgctctttcattcttctttttcttacatgcatgtactatatttctgatcatcttcacctcaaggaaagcaccccagttttccttacattaggggagactattacagcttaatttaaaatgcagctaattatttactcttatactcttaattatagtttcttgtctgataaaggtgcccacctcttaactggcaccctagatgaactgcagtactgatggtgaattattttactgccatttattcaggcaacaaatgtcatgtttcaaagattttgttctaagaatcctaaaaggagttttatatatcagagggagagaatatgaagaagttattagccaaactgactttctaataaccatgtagttggcttgattgactatattatattcctagatcatttcatttattttaaaacattttgcatatatacaggaaaacaatttgaagactgtgttttgttctggtgaatacattttaaacatattctaggtttattctttacaagtacattatttctttaatggtacagtgatttttattctaattcattatagtcagagacatcttaactggagttattttgtatgttcaggttaatattttttgttatcaaaaatttaacttagtacattttatggtagtgaaatatttctggtatctttgggtctcgtagttactactatgtggtcgtgaatatgtaaaataaactcggtgctggctatcacattttggattatacttatcattggattataaaggtgatagaacatcagtaacattcatgatttatggaaatttaattctgaaagtaatcataatctgtaaaaattagcatctagtctctgaactttagagttcaaggtaaaaagcaatacacattctattatcatatttgaaaatacagtttttttgttgtgatggtggtggtggtagttgcgtttttgagacgaagtttcgctctattgcccagtctggagtgcaaatggcatgatgtcggctcactgcaacctctgcctcctgggttcaagcgattctcctgcctcagcctcctgagtagctgggattacaggcatgtgccaccacacccggctaatttttgtatttttagtagagatggagtttctccatgttggtcaggctgatctcaaacttctgacctcaggtgatcctcctgcctcagtctcccaaagtgctgggattacaggcgcgagtcactgcgcctggtgaaaatatagttttttctttttaatttttgaaaaaattctgtgggtacatagtaggtatatatatgaggtaatgagatattttgatacaggcatacaatgcataataatcacatcagggtaaatggggtatccatcacctcaagcatttatcctttatgttacaaacaatccaattatatgtttttacttattttaaaatgtacagttaaattatcattgactgtagtcaccctgctgtgctgtgaaatactaggtcttattttttcgactttttgtacccattagccatcctcccttaccccccacctcccactaccttttccagcctctggtcactgtcattctacactctatctccaagatttcaattgtgttaatttttagctcccacaaataagtgagaacatgccaagtttgtctttctgtgcctggcttattttatttaacacagtgacctccagttccatccatgttgttgcaaatgacagggtctcattcttttttatggctgaatagtactacattgtgtatatttaccatattttctttgtttattcatctggacacttaggttgctttcaaatcttggctattgtgaacagtgctgcagtaaacatgggagttcaggtatctctttgatatactgatttcctttcttttgagcatatacccagcagtgggattgctggatcatatggtagctcaatttttagtttttttgaggaatgtctaaactgttctctgtagtggttgtactaatttacattcccaccaacagtgtatgagggttcccttttctgcacatacttgccagcatttgttattgcctgaattttgacattttttctggggttaaatgataccttgttgtagtttttgatgatcattgatgctgagcacctcttcatatacctgtttcccatttgtacatcttcttttgagaaatgtctaatcggatcttttgcccatttttgattggattattacttttatcctgtagagttgtttgagcttcttttatattctcgttatttatctcttgtcacatgggtagtttgcaaatattttctcccattctgcaggttgtctcttcattttgtttattgttttctttgctgtgcagacttgagtcggtcccatttgtccatttttgctttggttgcctgtgtttatgtggtattactcaagaaatctttacccactccagtgtcctggagagcttccccaatgttttctcttagtagtttcatagtttgaggtcttagatttaagtctttaatccattttgatttgatttgtgtatatggtgagagataggggcctagtttcattcctgagcatatggatatccagttttcccagcaccatttattgaagagagtttcctttcctcagtgtatattcttggcacctttgttgaaaatgagtcagtgtcaatgtatagatttgtttctgggctctcaattttattccattggtctatgtgtctttttctatgctagagccatgctgttttggttactatagctccacgtttttatgctagtgccatgctgttttggttactgtagctccatagtataatttgaagtcagataatgtgattcttctggttttgtgctttctgcttaggacagctttggttatcctgtgtcttttgtggttccatataaattttatttatttatttatttatttatttatttatttatttatttagtagccacagagtctcattgtctttgcaaggttggtctcaaacccttggcctcaagccatcctcccggtttggccttccaaagtgttaggattataggcataagccaccacatccccatttaagttttaggattttttttttctatttctatgaaaaagtcattggtattttcatagggattgcattgaatctgtagattgctttggatagtatgggcattttaacaatattgattcttccaatctatgaacatggaatacctttcctttttttggtgtcctcttccatttctttcatcagtgttttatagttttcattgtagagatctttcacatctttggttaagttaattcctaggtatttaactttatttgtaactattgtaaattggattatgttttggatttctttttcaggttgttcactgttgacatatagaaatgcactgatttttgtatgttgattttgtgtcctgcaactttactgaatttatcagttctaaatttttttttgtagaatctttaggtttttacaaatgtagtgtcatatcatgtgcaaacaacaagaatttgatttctttctttccattttggacaccctttatttctttctgttgtctgattgctctagctagaacttccagtactgtgttgaataacagtggtgacagagagcatctttgttgtgttccagatcttagagaagtggttttcagcttttccccactcagtaggatattagctgtggatctatgtatatggcttttattatgttgagatacgttgcttttatactcagttttttaagggtttttatcatgaagagatcttgaattttatcacatgctttttctgcatcaattgaaatgatcatgtggcttttgttcttcattctgttgatatgatatgtctcattgattgatttgcatatgcccaaccatccttgcatctctgggataaatcccatttggtcaagaatgattgtttcagtttcatttatttctgctctgatctttattcttctcttttactaattttgggtttgatttgctctagttttgtggttctttaagatgcatcattaggtcatttatttgaagtttttctacttttttgatgtagacacttactgctataaacttctctgtcagtactgctttcactgtatcccataggttttggtatgttgtgtttccatgatcgtttgtttcaagaaatttttttaatttccttcttaatttcttcattgatccattggtatttaaggaacatattatttaatttccatgtgtttgtatagtttctaaaatttatcttgttactgatttcttgttttatttcattgtggtctgagaagatacttgaggctgagtacagtggcacataccttgtggtcctagctactcaggaggctgaggtgggaggatcacttgagcctgggaggcagagtctgcagtgagctgaggtcacaccactgcactccagcctggacaagagtgagaccctctctcaaaaaaaaaaaaaaacaacttgatagtatttcaatttcgtgaatgttttaagacttgttttgtgacctaatttatggtctgtccttgtaatactatccatgtgctgaggagaagaatgtgtattctgcagccattggatgaaatgttctataagtatttattaggtccatttggtttctgatgcagattaagtctgatgttcctttgttgattttctgtctgtccaattctgaaagtgaggtgttgaaatctccagctattattatattggggtctacctctctcgttagctgtaatatttgctttatgtatctgggtgctccagtgttgagtgcatatatatttataattattatatcttcttgatgaattgatccctttatcattatatagtgaccttctttgtcccttttttttttttttggaaaataatggaatttattctagacaggatttctttttttttttttcctgccttcaagcatctgtttaacaaagcacatcttgcaccgcccttaatccatttaaccctgagttgacacagcacatgtttcagagagcacacggttgggggtaaggttatagattaacagcatcccaaggcagaagaatttttcttagtacagaacaaaatggagtctcctatgtctacttctttctacacagacacagtaacaatctgatttctctttcttttccccacatttcccccttttctttttgacaaaaccaccatcatcatcatggcctgttctcgatggtcgctgtctctttggagctgttgggtacacctcccagatggggcagccaggcagaggcactcctcacttcccagacggggcggccgggcagaggcgctcctcacttcccagacggggcggccgggcagaggcgctcctcacctcccagacggggcggccgggcagaggcgctccccacttcccagatggggcggccgggcagaggcactccccacttcccagacggggcggccgggcagaggtgctccacacttcccagacggggtggccgggcagaggcgctccacacttcccagacggggtggccgggcagaggtgctccccacttcccagatggggcggccgggcagaggcgttccccacttcccagacgacgggcagccgggcagaggcgctcctcatttcccagatggggcggccgggcagaggcgcttctcacctcccagacggggcggccgggcagaggcgctcctcacctcccagacggggcggccgggcagaggcgctcctcacctcccagacggggcggccgggcagaggcgctcctcacttcccagacgatgggcggccgggcagaggcactcctcacctcccagacagggcagccgggcagagacgctcctcacttcccagacggggcggccaggcagagactctcctcacctcccagatggggcagctgggcagaggtggctcctcacatcccagacagggcagctgggcagaggcgctcctcacttcctagacggggcggccgggcagaggcgctcctcacctcccagacgaagggcggccgggcagaggcgctcctcacatcccagacgatgggcggccgggcagagacgctcctcacctcccagacggggcggccgggcagaggcgctccccacttcccagacggggcagccgggcagaggcgctccccatttcccagacggggcggctgggcagagatgctcctcacttcccagacggggcagctgccaggcagaggcgctcctcacctctcagacggggcggcctggcagaggcactcctcagttcccagacggggcggccaggcagaggcgctcctcacctccttctttgtccctttttatagtttttttttcttgaaatctattttgtctattacaggtatagctactcctgctcttttttggttttcattggcatgaaatatctttttccatccctttatttttagtctgtgtgtctttataggtgaagtatgtttcttgtaggtaacagatcattgaattttgtgtttcttagctattcagccactctatgtcttttgattggagaattcagtttgtttacatttagtgttattaataataagtaagatcttactcctgccattttgttatttgttttctggttattttgtggtcttctcttccttctttccttcctttctattttccttttagtgaaggtgattttctctggtggtttgttttaatttcttgctttttattttttgtgtattcattgtatgttttttgatttgagattatcatgaggcttgcaaataacttatagctcgttattttaaactgatgacaatttggcaccgattgcataaacaaacatgcaatcaaaaagaagtctaataaatactctgtactttgtccccccaactttttaactttctgttatttctatttatatcttatggtaccaagtatgtcttgaaaagttgtagttatttttgatcggttcatcttttagtcttttacttaagatatcaataggttacataccacaattacagtgttataaaattatgtggttttttgtatgcttagtatgaccagtgaggtaccttcagatcattttttaattgcccattaacaccttttttccttcaaattgaaggattccccttagcatttcttgtagaacaggtctgatgttgatgaaatctctcagcttttgtttgtctgggaaagtctttatttcttctttaagcttgaaggatgttttcactggatatactattctagggtaaaagttttttttccctcagtagtttatgtcataccactctcttttggcctgtaatgtttccactgaaaagtctgctgtcagacatattggagctccatggtatgttatttattttttcttttgctgcttttaggatcctttctttatccttgacctttggaagtttggttattaaatgccttgaatggtagtcttctttgggttaaatctggttgatgtataactttcttgtacttgaatattgatatctttgtctagaattcggatgttctctgtttcatccctttgaataaacgttctgttcctatctctctctgcctccttcttaaggccaataactgttagatttgcccttttgaaactattatttagatcttataggcatgcttcattgtttttcattcttttttcttttgtctctgttgacagtgtattttcaaatagcctgtctttaagcttaccaattctttcttctgcttgatgacttctattaagagactcagtatgtcagctgcatttttcaaccccagaatttctgcttgattccttttaattgtttcaacctctttgttaactttatctgataggattctgaattccttctttgtgttatcttgaacttctttgcatttcctcaaaatagctcttttgaattccctctctgaaaggtcacatatctatgtttcttcaggatttggtccctggtgccttatttagtttgtttttcaaggccatgttttcctggatggtcttgatgcttgtgggtgttcattggtgtctgggcattgaaggtatttatcgtagtcttcacaatctgaactcttttgtacctgtcttagaaaggctttccagatatttgaagggagttggctgttgtgatccagttttggtcattgcagccatatctacattagggggcaccccaagcccgataatgctgtggttcttacagacttgcagaggtactacctttgtggtcttagataaggtctagaagaattctctggattaccaagcagagactcttgttctcttcccttactttgtcccaaacaaacgagtctctgattctgtgctccaagcctcttgtagttgggggagtggtgacacaagcacttttgtggctaccaccactggaactacactagaccagacctgaaaccagcatagcactggatctcacccaaggcccagtgtaacccctacctggctacctcctgtgttggctcaaagttctagggctctataatgagcaggtggcaaagccagtcaggcttttatccatcccttcaggacagcaagcaagttcccctgggccccaggcaggtccagagatgccatctgggagccagcatctggagttggaaaccttagaaccctatctggtcctctattctcctgcagctgagctggcatccaaaccataaggcaaagtgcttcccacttttcactcctcttttcataggcaaaagagtctctccctatggccaccaccactacaagcccacagggattattgccaggctacggttcatgttcacttaaggcccaagggctcttcagtcagcttgtggtgaatgttgccaggcctgggacttgcccttcagggcactgggctcccttctggcccaggcaggtccaggagtgccatacaagagccaaggtctggaatcaggaaccccaagagcccacttggtgctctgttccactgtggctgagctgttatccaagttgcaagataaagtcctctttactcttccctctctactgctcaagtggaaggaaggagtctcttttggagctgtgaactgcactgccttagattagggaaagggtggcataagcactgccttagccacctcagctggtggctcactaggttacgtgccccctaggtccaatgactctcgaacccagcacagcactaaaacttgcctagaaattacagttcttgtggcctagactgcctttcaagttcatttagggccccaggacacttcagcctatagtggtgcggcttgttgaaactcaggctccaaccgctgggatggacatttcccctctggctagggcacatctaagttctccctccatgggcattggctgagttctttgctaatggcccgggtgttgcttgccagttggcctggtgttgctttctgctgtgacatggtaacactgagttccagtgcaaagtcccacaatcactgtgctccccctcccccaagcacacagattctttgcaccacacggccactgcatgggggtggaaggggtagtagacaatcgaaaactgtctttcctactctcttcagtgtctctttcagcaatatgaagttaaaatcaggtactgtgatcacttacctgatttttggttcttgtgaaggtgcttttttgtgtagatagttgttaaatttggtgttcctgtggtgggggcagcgattggttgaggcttctattcagccatcttgcttcatctccctccaatagattaaaaaaaaaaaagattttagaattatctaatttttttctttaaaagatgtagatgattggcttataattataatcttcaggtgtttccagagtcattgtgttctgtcatgaaagtaatgcaagagcaattttgctgtaatgaaaagctagaagtttcgagaacactttattttctaattccaaaacaacaacaaaaaatagaactttgctagctggctgtgtctactgtcattctttgattagatactttgagttctgcataccatgaggtgttggtatgatagcatgttatgatagaaacttttagaaaagaccagagacttgagagatagactaacctgcatgtgaaattcacctccgtcacttttgctctggtatttcgagcaagttatttaacttcctttgtaaagtgaagattatacttctttagagttgctgtgaggatgaaagcactcagaataagttcttgttgaatggtggatgtataaggaataccatgtggtaatgattatatgtttcaatattgtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattgggtaagaatctgattttttccctcaaactgtgatatgtagtagttagggttatgtatctttacaatatattgtgaattttacaatatgtagttcaatttttatagtcccaccaaaggacagaggttctagagctatcctaaggtcacatggagactatttttttttgtttgtttacttagaacagctaagaaagttgcttagtagtgctctattactgtctccagttctcctcttcctttgcttctttctcctcttatcacagctctcttttggcttttgttgttgttatttttgagatagggtctcactctgtcacccaggctgaagtgtagtggctcactgcagcctcaaccaccctgggctcaagtgatcctcctacctcagcctcccaagtataatagctgggtctaaaggcatgtatcaccatgtccagcttctttttatttttattttcatatttcccaccccacatctttccttgtgtcttagtcttcatatgtagaggagttattgaccccattctaagtgttagacgtaaagaaggtacatgtgaagtcagaatatcaaatcgtatttcttctcatgtaacttttgattgaaattcaatggaatcattcgttctgcccacttcatctctatagagcccactgaacaattccaatttccccagaaaaagagtgattatgaaggatgtgggaaggaaagatgatagaatagatgttcatatgattgtatccacatctgggttatagtctggaatgcaaagcaaagaatagccgtgaagatggcagagtaactctggtgaaatcaaaccttcactccagattcataataaaaaactggccttaagtttggcccatatactgtgacctaaaggcgtataagtctacctttttctacatataaatagtgatttagtaatttggggggaggggaaggcaagatttaaggagggtgttttaatttatgaaaataaactgttatttttatttccattaatattgctttggggccaggcatagtggctcatgcctgtaatcacaacactgggaggctgaggcaagtggatcacttgagcccagaagtttgagaaaactcaacataggcaacatggttgaaaccccatcaattaaaaaaaaaaaaaaaagcaaaaattagccaggcttggtgacacatgcctgtagtaccagctgttcgggaggctgaggtgagaggatcacttgagcctgggaggcagagattggagtgaaccataatcacgccactgcactccaatgtgtgcaacagagcaagaccttgtcttaaaaaaaaaaaaattactttggaaacactaagatgggaggagagaggagaaaactgtggaagtcagtgccttattcagtacagggaagtgtgaatctgtgtccccaattttacaattttggggcttttcttaaatatgacaggtgaaattaatatctgctgtcatttgatatggtgaaaaacagagaaaggaaatgcattatgcccacaacagaagggctggaatcggtttcatttacctaaaatagtaaaaaccgttaaaaggtttgctggtcttaacggtgctgtaaaagtttatccaggtctatgttttcctgggacaacttttaagttctacaagctggcagttatggtgactctccagggtaaaataaagaggaaaacccttggtatcagaactttacaaataatatctctaatgttctttagtaacaactgtgaatcctggtatcatcctggtaacaaaaatcttaagttgtattcagtttttttccagacagctggttgctgcctagtatgaaatgcagctctgaaatttcccatttattcctaagatgtgaattattttctctataagaaatcattcttcaaaggctttacttactttctaattccccttgtattgtttagcctgcaaatatatttagaatatgtatttttgagtttttaaaatactatgtgttttactttttctaatagtgaaaatgaaagaaaaatcagttaaaaatgcctataatgccaccataagtaggggtataaattgagtaccctcaaagcacccagtgtcagtacattaccagtagaatctgaatttctcccccagagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaagttagaccaactagtgattctagagtggggttgtctctttcagtttaaaagaattcttacttcccatgacttgtgatttttgtatattattattgctaattattagggttttaaaaattcaatggactatgtacttgtgtaactgtcagtctaatcaaagtgtttttattagccatatccaataatgccttataagaagtctaaaatgaactggaccactgacttacgcattgtcaccagcaataatcattattatcattaaaagtatcaccctacttcttggtactaaaatcttcactagtctgttggagctgccataacaaaataacatagactgagtggtttaaattacagaaatttgtttctcccaggtctgaggctgggaaattcaagatcaagatgctagcaaggtagatttcattttctcttggcttgtaagcagccactatttcactctgtgctcttgtgacctcttctttgtgtgtgcagggaacaggagaggaagtgttctgatgtctccacatataaggacactaatctcatcatgagggccccattctcatgacctcatctaagcctaattatttctcagtggtcctatttccaaacaccatcacattggggttagggattcaacataggaatttgtgcgaatgtaaacgttcagtcgataacactagccagccatacagactgttagcaataaaaccaggtgcttatcgttttgatttcactgtcttcattaacagttacagacaactgaacacatatgtagagttttgtcttataataatttgtggaatttgaaagttatactaaagaaaggtaaggaatcaaaaagtaagttttgtaagttgaggaataaagactactactgtgtatggaacagtaacaattattttttgagcttgcctgtatttcaggcactgtgctggtgctggggatttcatgataaacaagatactccctgctgtcaaggaattcccaaatctaatagggcaataaacaattaccctacagttgagtaacactattatagggttaacatggggtattatgaaaacacatagataaagcacaaatcctgattggacacttcttataggatctgagtaaacctggagttagtctttatttactatcaataaatgaaggatgtattaaatgtatgtaaaagtaggaaattaaggagaagaaaattctagtcttagttctgctcagatactatctcctccagaagtcatccctgaacccttgactggcctgtgttccccactctgtacagttctctgttgtagtgtttagcacttgcttacttctgtctccttcactagattataagtactttggacataatacctagctgtagttaaatgcccagtaaatattaaatggtattgatttcaatcccatcagtttgaaaacattaacacttaatcatttaagctttttggctatttaattaatgtatttgttgtcccccatgtttcaaatggggatgaggaaaataaataaatttagaatgaggactataatgcaggtattaatctaagtcattagataataatttaaatcctctttctacctctgaagaatccaaatgaacctgaagcaaattgccttttttattcaaggctccctctcttgagcatatgcacacactaccatatacatgcgcgcatgcgtgcacacacacacacactgagatgtgtatatatataaacaaagggcaaataattcatcagccaagtataagaatgagttaatgtaagagggattaaatgaacatttgggcacaaaacacaataaaaaaatgtatagtttaccatgtttcttcaatttaaaacaccaaactgaatttgtagcttggttgaagaaaaagatactaattttgtctactctttcacttgttctggaacgcatcacaagcttttttccttgttttcttgatgagcaaattaattcatgctcacttaaaaatatgcaagttggtaaataccctattagttcattttcacactgctgatagacataccccagactgggcaatttacaaaagtaagaggtttaatagacttacagttccacatccctggtggggctcacaatcttggtagaaggtgaaaggcaattctcacatggcagcggactagagaagagagcttgtgcagggaaactcccatttttcaaaccattagatcttgtgagactattcgctatcacgagaacaccaggggaaagatttgcccccgtgattcaattaccttccactgggtccctcccacaacacctgagaattcaagatgagatttgggtggagacacagccaaaccatatcattccacccctggccactcccaaatctcatgtcttcacatttcaaaaccagtcatactttcccaacagtccccccggagtcttaactcatttaagcattaactcaaaagtccagagtccaaagtctcatcgaagacaaggcaagtcccttccacctatgagcctataaaatcaaaagcaagttagttgcttcctagatacagtgggggtacaggcattggataaatacagccattacaaatgagagaaattggccaaaacaaaggggctacaggccccatgcaagtccgaaatccagtggggcagtcgaatgttaaagcttcaaaatgatctcctttgactccacgcctcacagccaggtcacagtgatgcaagaggtgagctcctttggccttgggcagctccacccctatggctttgcagtgtatagcccccctcctggctgctttcacgggctgtcattaagtgtctgcggcttttccaggtgcatggtgcaagctgttggtggatgtaccattctggagtctggaggatggtggccctcttctaacagctccactaggcggtgtcccagtagggactctgtgtgggggctctgaccccacattttgcttctctactgccctagcagaggttttccatgacagccccattcctgcagcaaacttctgcctgggcatccaggtgtttttatacatcctctgaaatccaggcagaggttcccaaacctcagttcctgacttctgtgcgctcacaggcccaacaccatgtggaagctgccaaggcttggggcttccaccctctgaagcaatagtctgagctgtatactttagcccctttttgtcatgacggaagcagctgggatgcagggcaccaagtccctagactgaacacagcagaggaaccctgagcccagtccacaatatcattttttcctcctaaacctctgggcctctgatgtgaggggctgccacaaaggtctctgacataccctggagacattttccccattgtattggtgattaacactcggctcctcatgacttacacaagttttctgcagctggcttgaatttctcctcagaaaatgggattttcttttctgtcacattgtcaggctgcaaattttccaaacttttatgctctgctccccttataaaactgaatgcctttagcagcaaccaagtcacctcttgaaatctttgctgcttagaaatttcttccgccagataccctaaatcatctctctcaagttcaaagttccacaaatctctagggcagagacaaaatgctgccagtctctttgctaaaacataacaagagtcacctttgctctagttcccaacaagttcctcatctccatctgagaccacctcagcccatactttattgtccatatcactgtcagcattttgggcaaagccattcaacaagtctctaggaagttcgaaactcccacattttcctgtcttcttctgagccctccaaactgttccaccctctgcctgttacccaattccaaagtcacttccacattttcaggtatcttttcagcagcactccacttcttgtaccaatttactgtattagtccattttcacactgctaataaagacatactcaggactgggcaatttacaaaagaaagaggtttaatggacttacagttccacatagctggggtggcctcacaatcatgatggaaggcgaaaggcgtgacttatgtggtggcagacaagagaagagagcttgtgcagggaaactcctgtttttaaaaccatcgaatctcatgagacttattcactatcatgagaacagcacgggaaaggtttggggacccagccaaaccatatcattaccgaatcaaggaaaaagtattatcctcaatcccatttatgtagtctcattttctaatacagtcatgtaccacataacatttcagtcagcgatgaaacacctgtatgatggtagtcccatagattataaaactatacttttactgtaccttttctatgtttagataacacaaatagttaccattgtgttacaactaccttcagtattcaatacaatagcttgctgtacaggtttgtagcctgggagcaataagctattccatatagcctaggtggatatatatgtatagcctaggtgtggtatagttggctatgccatctaggtttttgtaaatacaccctatgatgtttgcatgatgataacatgcctaatgatgtatttctcagaacatatcctcgttgttaactggagcatgactgtagttgatcgaattctatataatttaaactcttttcacttaatacagcaatagatccattcccctaggttgctaaaatagtcattgtaaacatgttttttttttttttttttttttgctttgtcacccaggctggaatgcgttggtgcaagcatggctcactgcagcctcaacctcctgggctcaagaaatcctccttcctcagcttcctgagtagctgggaccattggcatgcagcatcatgcccagctaattttttatggtagagacgggattgcatgttgctcaggctggtctcgaactcctgggctcaagcagtcctcctgccttgtcctccaaagtgccgggattactgtcgtgagccaccatgcccagcctaaacatcttttttaatgactacatacatatacgctgtacagatatgccgttgcttatttgaccaaccattcttctaatattaggcagtcagcttatttccaatgtttcattcttataagtaatgctatgacgtatgcctaaaattatccacattatttccttaggctagatttctggacttggaagtatttagatgcaaggatataaactttttttttttttttttttaaatacagggtccaggctggagtgcagtagcacaatctcagctcacggtagcctcgacctcctgggctcaatgatcctcccacctcagccatctgagtagctgggactacaggcacatgccaccacactcagctagatataaacattttacagctttgatccatagcacagcatgacagttttataccaaacaacccttatagtacagttggcagtatctacttggactgcaagaatagtaaaaccagaatttcctccttgtagccaacagctataactcccctgccagtggtagtccaggcagcaattttctccatattctgttataaatatagtagtagccttttatgcataattttttctctttgtaaatccttttatttttattttcgacttgagtcgtttctcggggatttaaatgatgggttttttttctttactcttttactgaaatgtttttctactctgatttaattctgctttaaaatactcaggattggttttgatacctaagcaaatcataaaaatctctgccattgttttaagagaccaaaagcatgaattaatctattatcaaagtatatagtatccaaggtaatcattgtaagacttttctgcttcaagagggtgaagagatgaaaaattaaacttaaatgatgtatagtgttcacacagtcagaggtatagtgttgacacagtcagaggagaatctattttctgtgttgctcattctttgaaaaggggttaaaattagctttatacacatagcttctgtgtgaagatgattggttaatgctttgtggcttggtattgcacttcagatttctgcatgttaagattgagtccgaccggacgcagtggctcacgattgtaatcccagcactttgggaggccgaggtgggcggatcactaggtcaggagattgagaccatcctggctaacatggtaaaaccctgtctctactaaaaatacaaaaaattagctgtttatggtggtgggcgcctgtggtcccagccactcaggaggctgaggcaggagatgatgtgaacccgggaggcggaggttgcagtgagccaagatcgcaccactgcactccagcctgggcgacagagcgagactcaatctcaaaaaaaaaaattgagttcatccacaagattttaccaccagcatcccagtgactgtggcagccattgctattgtggcgatctcttaagtagttcagtattacagtgtttgaatcacagaatcattgacagtcaaagaaataagaactattaaagttggctatccaacattgcattctaagattgtggagattagggatggggttaaaataggaagaaaaacaagtctttaaaagtttcccaggtaaaatatttacaaattgagtttattctttatttttaaaatgctgaatgagttctttctaaaagtaggtacattgaaatgaatagagacaagaacaatttgttaaaagttttttgtaaagtatttggttgccctgtgaaacaaagaatcagcaatgagtggtgtatttgttcactattttattgaactcctataatatgctggacacagcacagagcactaggaatacaaagtcaaaatataatgtgtggctccttatctcagggagtaaccaacaggtagacaatatacatgtaacacatattacagtaaatttagatacgtctcctgaaggagtttatgtaccaggtacagtgaagtcacaaagagaagtatctccctcagtcaagagaaggacttcagaaaagaacaccagatattagtttataactgcaagctagtcctttgtggatgatataaaaataaatttttataaagtggaaaaaaaaattattattcccagtatctgaaacctcaaggtagaagaattcctccactgacatacttgagggcaaaagacaagaagcatgtttgtgcaaaaagtttcatgctcattatgaaaggtgtacaatttccttcttccattatttactttgttttgtttgtgtgtgttttgttttgttttacacttaggtatcctttatgaagccatagagataggcctgagagctcttttgcatgtagagatgggcctgaggaacttaggtacctttttttaaaaaaataatggtagggtttcactgtgttgcccaggctggtctcgaactcttgagctcaagcagtctgcctgcctcagcctcccaaagtgctgggattatagggatgagccaccgcacccagccttaggtacccttttgatttggttccagagagggctcttttagttaggaaggccattaatgttagtgttacttcttggtaaattgatcactcctttgtttcactgagcatccaaatcatgctgacaaagttagtctttattcaaggataaaacctatgctggttttatcagttcccccctttctttctccctctagcatttcgtatttctttgttgttgtttctgctccatgcctgggtatgcagcttcccaagaatcacattaaaactatttctggttgttttcttttccgaacaaatgtgacattttcttcatctccttgattttgagctgaagaaggcaaactgtcaaaaataatgaggccagatggatttgaacactgaatagcagtctgaaacagtgctcagagactttgcctttacaatcattattacagaggcaatgagggaaagctccttggtggccatgaaatgaagagaaactgaaacagctcttaggggattagggaaagtcccaggcataggtagcactgacttgttcatgtatttattcactcagcattgtgtggagtgctagatgctgtgatgcaaagaaaaataagtcatggtcctaaccttttttggaatactgtttggaagacaaacatgtaaactgactcctgatgcttcagggtttctatataagaactattattccttcagcaaatatttattcctcctctattatattccagattcttttcaaaagacatcctgtatgaatacttttaaacacacactatctctagcaagactaccaaaatattacttggtggacatctatggaatttgcttccataaatattagaatgggctttctattactgttattaggtaagagtagatggttcttcaagaaggatgcaggttaagggagactgttagttctcacaaatttttaaaatattcatctcttaacttctttttattattaacttgtaatgtcaatgaagaagacatttacaaagtctaacccaaatctgaattatcagaaattctaaattaaaaattttaatgaggttttatcacagtatttgtattctaaaggaaaagctcagtgaccaaatatgaaagcagtttgaataaactcttaaaagtcactcattacaaaaggaaaaaggagacttcaattttcagctatttcatgaattgataaaggacattttgatgtgtgtatgtgtgttttatatgatatgccaataaaatttaatatacagggcattccagaatggtttctgccccactgatggacttcaaatatgtctcatcaactacagtattaaatgccataattaaaggtctcctttctgtgagaagctcttagtcaaaggagaaagtctgccttctgataggatactgtgatatctatgaccatctataaattaatttattttttcaggtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtaagtgtcagtagggcattttaaaataaccaatactttttggttgtataggagtcagaaaaattatttgtgtgtctatgtgttgttaatgttcattattgtgactcaggtgcaatttttctgatactcagtaatgatcccttttgtgaaagaatggaaagatcccataacatagccattcacatgcactaatatttagttgtttgcaagtaatggttgactacatctccactgaagccagttactggagttgtttaaagtacttggcttgttcacagcatttaacagaaacaacaagtaattaagcttacttaatactttctaattttgcatatagtcaatatgtaaccagaatccatccatttctacacatcatcgcactgatactgagaggcttaaatgccctaaattttgcctcagttgattgctttatagaaaagagagtaaatgtaattccctttcaagttctattacatttctaccaagtgagaaactgtatgttaaatttaagcaatataatatcacaatctttgtttgaatttaattgttgcagatgattatattttatgggtttggtgtatgtgtttttatgagggtccagccagctttgtatgccctgtggaatatcaggataacaatatttattgtggattttattctgttctctcgtttatgcacatattattggttagttcattcaaccagctgttaaatgcactcaaaattatactaggtgcagaggagatttcaaaggagattgaagatacagttcttgccctggtccagaatctaataagcaaaatacacacatgaaataactagagaataattaccagaacatataaattggtataagataaatgtatgcttaaatgctgagaagaagcggagaaaagaaaatgtgaaaaaaaggaaagccacatcatttttacaagagtatacttcggagagtaaaaggaaatggagactttcttattatatgacaatacacattgtcatgatgggatggcgatatgatttttggaaagataccttgccaggcaaaggttacagattcctttaatatggaataagaatacaacttactacccaaagatagctgcacagaacacgtagcagcaatcttaatcagaagggaaaatgtcttcaagttcccatgaaggcatccactatttatgtttctccctaattggggtgtggatcctatctttaagaaactcatttccattcttattgcaagaaaggggcaaggtttataactacttggttccttgcaactgtttttgagagtctgactatgcatctgcctgatcaacaggtacatgtaactggtaacaacctccaaacattcttgatgcttattgttacaatgagtgaatcaagagtcacttccccagctatgccaccttctctgtaggcctggattttaggcctgcctgaagtcaactcctctagtccaggtttctcaaccaaagcactattttagaccagagaattctttgttgtgaggagccgtattctgcatgtaggatatttagcagcatccctggccagtaagaccctcacttaaaattgtgacaaccaaagatgtctccagacattgccagatgccagatgcccctgtggagcaaaattgccctggttgagaactacagttctagtcacaagattctaaagttaaataaacatacacatgtctaaatgtttaccaacctcacatgtaggtaggcactgagacttacagggttgtactcatgttttgcttttcttctcccaatcctccttagtaataccattaggcttattctggaatagaaagaaaattttttgctttactattttttttttcctttttgaagttgtactttagaattttggatcctcataactccaattttgacctacaaatcaggatctctgtcacttcatgatggtagaattctgtctaggcttgaggagaatattgttctattactttgtttggttttatgcataatgtcaacttcagtgtattcagaacttgggtccagagaagcaattcatatgaagaaagagtggtgctgagaagactttctgtatccaaaggaataaggctcatacttatatttcacattgttcctaaaaactcctggcagtcaaagtttgcccaaaataatttcactcatttgaacctaagcaaaattaaaacagtatttcataacccaaaatagacttgaatacctcaaaatattttatgttaggattcacaataaaagtttaacagtagaaataccttacatttatatagtgagtagcagtttgcctaatgtgattacctccttatcatgtaccttatttgatgactaaccgctgtagcatttgaaattgtagagtaattccatattcagtgataaatctttgagcttacttgcacctcattatttttctcaaatatttttagtaaagaagtatttagtaaagtttaatgtttttgtagtgtgaatgaaattgtttgcaggattattatgtagattcctttacataaaccaaaattggaattgtttgaaaatgccctagaaatatcttgccatcattgccaatagagcgtgagaaaaagtcactgatgggataaaatgccaaaccattgaccactgatcacagaacaagaaagaggcaacctgtgctgtagagtcaggatatctgtatttgcatccaactttgaccaattactggctgtgtgtccttgaacaaattgcttagcctatttcttaactggtttatttttctacatgtgaaaaaataatagtacctatagtatagagtctttttgaggattaaggagttatgaaaagtaaagcactgcgaatagtacctagcaatacagtgttaaacacattagctgctattattatatatatgaatagttataggaatatctctgcctgttagagacactctatagtatttattttgcagctctttttcacatggcttcatttcagactgtatgcgctcacattttagaaggagcatgaaacgagctagtcaaggcctccattagctctgcttgtggttacgggtaatgcttagggtccgtaaagaagaggaactgttaacattcagcatgtacaatttctctgggccaatgtaccacctcaacttcattttgtttagcttattgaaagagaatattgccatatgatgcgatttttcagaaacaaaagttcttcattcccaaaaggtgagtgaagacttagtatttgaagtaaatgtgtgtgtgttgactttagtgaaattaatcttcagactttcctatatatgtcataagcattctagaaaatggaggaagactaaagccatacatccagaagagtgacagaagataaacactgagaataagttcagcccagaataaaaacatggataaccaactctcaactttcttagatgataatttcatgtgccaagagatgttaggaagtgatccaagtttaatatctccttcataattctttgacaatctttaagttttattcatgtaaactttctgtctcctatacactatcctttcaggaattttataccatataacaatagtgagaaagagttgacctgttgaccatgagctattgtagacaatactgcaggaatgaaatgccatgctagaaggaaaaatacaaggctagatgtttggaaaactgcaggcaaaaatgtcatgggaccttaatcgggatttctcataaatttttagacctatctccctcagtctcaggacttctcatctttcttggttttatatccataagtgaggtctgggaattctctcttcttcaatgaaaaggttttaaaagccaacactgtggctctgctctctaattttgttactattattgctgttaactttcatcagatctgtttctcaaagccaagtttgtcctaaaagcctcataaattgaatagcacagtcctcaggatttaatatgaaaattggaggcaatattagcatttttttcaagtacgtcaagtgaattttgaaagctatgcaactacattctaaaacgttctaccaaatacattaatcctattctgtgttactggaaatcgcctatgtgcaaagcatctcctttgtcacctattttcttatttgaatcttaaatctaaagcaaagaatttatagttggagaataacagcagttgacagcccagttgtagataggcacagtatcagaaaggttttctgaaaatattgcttatcaggttctgggatcaatttttatttttctgaaatctgacttaaaaaatggttgcagatgctcactttaaagactaacattgttaaagacattgtttaaagagcagttaatgttactctgtagtttcagccattaaaagttatcataatacaaaatcctttttttccccctatgacacctccctttatggcagttattacaatactctcatgagcctctcttggtctaattccaaatccgcacgcaattctactccccttattacactttgaatcagattttggaagcccagagggcaaaaccaaaaactacgttaactattccagacagatggctctggacaggaatttccattgagatgtggctcatgaaacaacagtggatacctgttgagagtaccatggaggaaagcacagggtgaaatcccaaggtgtgaactctgtgattacttcccagagcagaagacaagaaaagtatttgcatccacagaggctctatctagcttacaatgctgagtgctgtacagtgcagctgttactgcattaatccttctggtgtttctcacaacaaagaaaagacctgggtcttattctcttattgtatagtaaaacaaagcagattacaggaaaagtgcacagatctctcagccacttccaacttctcacactaggatatcctcctgcccctatctatctattttgacaaaaataagatcccatctactctgagaaagctttggaggcttatgtaaactcaggctacttctaagggatgaaattcagactaatggattcctccccctttttaaaattttttttaatacagtcatatctgttttatcctttggcaggatttttgctgttacccattactgtgtgctttacgatgtactaaaaatgatacagtgccatgtcaacacagaataaagttaaacatactacatgtagccaaccactgctttgcaaaccatggactgctctcagtcatgccacctgtcaagcatcaaacctgagtatggacgtcagctgcaagccttcatttacctgccatgtgatttgaacttttaaaccacgtggtaggtaaggaaagaagagaggaagcatagagtgactaaatgcgaacattaacactatagtaatctttttagccttttgcagtaaattgtcccatggttgatatagacagttttaaaattacttcctcttaatgttatatatggatcttaagggttaaatatcacccatggacttgtgtctccattactgggctggtattatgcctggagcaatattcattcaacagatacttattgagcacgtactttgtggcaggcattgttctaggtgtttatcctaagggaatatatactcaagagcctgaaagagttctgactgtggctctgccattaactagttcctttttggatttttatttttattttttgaaatttacttaatctttctgtggcttagcttcttcatctgtaaaatatgaataataatagtacctcacaggtttgtcataatagttaaatgagttgagacaaggtgagggaagagcacactattataacactgcctgggacataatcggtgctcattaagttcagctgctatctttaatggtcattcttatgagaaaaataaagggccacacctgtgtagcactggtatgcttgcagaggcctacagtcacatttgtcatttttataatgggccacctcagtgtctgaaatctctactattattataatagttatttctttggtttaagaaaacagttctgttatccaccaaggttaacacatgaacaactcttgatagcaaaacatacactaattattaggattatccccagaagaaacaggtctctaagggtgtgggacagggtgcgatgttgtttttatgagagtaagacgtttaagagtggagaggaggaaacacatcacggttcattgtcacagtagagattgtggtcatcctaagagtaacacaaggtcctgcattcctggctagggatgactgaagagtgggtgaagacaccctgaaaagaagactgtcaggtttacccaagactgtctttggtcttatgctatatctttctggtgttacaatatgaacatggagaataagatttacaagagaaaatatatatagcagtttcaagcatatgcagactgcctgggttccaacctgaatttaccacttattagtataaccttgagcaatgccttaacttccctttgacatttgtaaaacaaacataatgatagaattttatggggatgctgaaaggaatctaattacattagataatgtctaaaaacaatgtctgacagttagcaaaagctcagtaaatattagcctctgtcattgttattgtagtttgctattattggagctgctttaattatttagtttcttcttttcctgagtcccacttaattttgcttgccttctatgagcctttggctgaatttgaaattcaaaagttccaaatctttttgatccctattttattatagtctcggtattctaccaatgatctcaattgtaaaatgacattgccaatataatcgttgttgaactaataaatctgaaagcaaggtttctattattttggttctatatctagttgaaattctatcactaaaatttgcataaatcacttaatctccttgtgttttagttgcctatctgcaaaattaaaaatattggggcaaatgtagtttcatttgcaaattatatatagcatttgagaattgcccctcaagttttctgaaattcagattctctaagttgaggtgatgattaacctagtcagattttatttgataagagttaagaataggcatctccatttgtattagtctgttttcgcattgctaaaaagaaatacctgagactgggcaatttataaagaaaagaggtttaactggctcatggttctgcaggctatacaggaagcatgatgctggggaggtctcaggcaacttacaatcatggcagaaggcaaacggggagccagcacttcacatgactggagcaggaggaagagaattgggaggtgccacatatttttaaacaatcagatctcacgagaactcactactgtgaccacagcatcaaggggtgatggttttaaccatgagaaaccgcccccatgatccaatcacctcccaccaggccccatctccaacattggggattacagttcaccatgagatttgggcaggtaacacaaatctaaaccatatcaccattcaagtttttaatcttcataaatgccaaggttttaaaagactgccgggtagtcctaaattgctccactgagcagataagcaattactatgagtagcgtcattttaaatacatgcaaaactattggtatagtgacaataaagcattaactaagattaccataactggagatttaggaaaatttcatctgagttgcattgttctcttttcacaatgtataaattgcttaaattgggtgatagtttagtttaactttattactaagcattaacctcaaggattgaagctcagattgtggaatttcacctgctatccagtgagcagagagggtattctttggacatagggaccttttaagtagccttaaaactatagtaatcagggtgatgcatttcctcaaaggcttgcccagtttatgtcatccaagcatgccactctctacacagcacacttaaaactttttagaacagaaattgccgatgtgttttagctcacttgccagtgcttgttgattgtcagtaattacatgaatctctcttgaaaacagttctgggagcggggagggatagcatttggagatatacctaatgttaaatgacgagttactgggtgcagcacaccaacatggcacatgtatacatatgtaactaacctgcacgttgtgcacgtgtaccctaaaacttaaagtataatttaaaaaaaaagaaaacagttctgacaccaagttataaattagcagatgagaatgtgtgattgattaacagtgtatgaaggaaagggaccatcagcatttatttgtgttaagtttttttatcctaatcctaaacttcaaattctttaagggcacaaactatgtcttactcattttggtatcatgagtgcctagcttggaccactgtgtatgtagctcttaataaatgtttgttaaaattaactaattcatattcttaaattcttttgtactatatagagatagagagattttaattgtaataatctttcgtgagtttttcttctttatttgaaaaaggatccagacacagagatgaagaatgacttgtaccatcttctgagaacaaatggactgaaagcttgtgactagaatccactacttttcaacctcttactcctagagcccatccttttggccaagggcttttagattgctgtgaaggagagtgtttatatactaacaatttcttttaaattctttcccaaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaagtttctagaattttatatcattggatgatatgttgatcagccttatgtggaagaactgtgataaaaagaggagctttttagtttttcagcttatttactttgttttttttcctgtttctgatatagtaactaattcttaactcagagacattggtccattttaatactgaaaaccaattttcattggtacacattacaaaattgctaagaacactgtttgggagctttcattctcatattttggacattgttttaattgagtgaaataatcataactccttgctcccagagaagctatcacctccatttctaaaaccatttcaggtttgtttggtagtctttcttaatgtatttattatcgctttttgtgagtagggtcctgttttatccaggaaccaatttctgccctagcctatcatgccctgcttttgagagtaccaggtatctttgggattgggaagctggctgtttcagaagtatatgtctcatagtgtgcagaacttggtgaccaagtgagaagcgggaccaatgggagactcacaatggactgagtcttgggattatcttttccaaattcttccatgttagaatcacttcagaaaataagactttgatgctttgtctctgagcatcatttttctcctcataaaaacacttccttattgtatgtagcctgcctcctacagaggcctggtaggtgttactgcattctaaaagaaaaatgtcatctctgtaggagcgactatcaggcctagtgtgaaatattagggatcctaggcagaagagctattagtcctggccttcatatcttcaccaaatgaaaatactgtatataaaatttcaccaccaaacttaactaaattctttttctcaagtcaagcctcccaaagaaaaaagaaattaacttcctacagtgtcagcaagcaattttccatttagttttggtacaaataaaagtcatttgaaacaa

SEQ ID NO: 2209 - DNA, 733315 bp, Homo sapiens
  source 1..733315: mol_type = genomic DNA
tttttttgcaaagattgttggaaataatccttctcttgtacctagaaacataggtgcaaatttctgatatctttgttttatctgcattcctgcctttcatgaaagtccctcttgattgtgctgaggctgtggctcagcgaagacactgaataaatacgatagccactgttgcttgttgcttgtccaagtcttcctggcttctgctgcaagagggggatatggagaaggtgggccagggtgtgtggacccgggcagaatctggggaagaagcctgccattcgtctttctttcccacaccaccgaacccactgcccttcccacccccacagcccttttatgaaatcagacaacgtggtaggtggaaaacagcagggcctttcctctgggttttcaaccagaagtgatattccacagttttaactggttactgtgaagtccaagcggccagaattgtgaaaatgtccactgaaacactgcaagcggtgtacttaaagacagtaggccttttagattttgttatatattttttgtagtgctcttcacaagtggaaattttttttttttttttacttttttttaaaagatttttttgtaaagaagggttgtatttagaggccagtagctagagatccaaccagtggacctcttgaagcactaccaggccttaaggccaccatccgagggagactgggaaaactattattcacccaagcctccggaaatgtaatgtaccagcaggcaaaaaacagttcttcatgtagtacaaaatgaaacgaaacaaaaacaaaaacagaaagtaaaaatgaaaccaaaacatttcttaaattctagtgccatagcttttttgtttgtttgttttttgttgttgttttgttttgttcataagaaagagagaaagatactacttatccgtcagacacatgcatcctcatgtggtcgttgaactgctcgatttggtcaaactttgctgggcagacggagcagacgtaagtggtcccctccgtgcaggccaccacgcctggggggccagcgcgggcacctgggggtgtgcctgcagggggggtcccattgctggcactgtgcagggccacgtgtcgctccaggagggtcttgtgagagaacttctttttgcagatgtagcactcgtaggacttctctccccggtggaggcgcatgtgcacgttgagggagctcttctgggtgaagcgcttgttgcagatactacactggtatgccctcactcctgtgtgtgtcaccatgtgcttgataaggtaatcctttaaggagaaggagcgccaacagatgctgcattggtggggcttctcacctgttgatgtaggaagagacagcaagcaggacagagcgagacatagcaagggatagagaatgaaggacaggaaaaacaagacaacaaaaaagaaaaataaaacaattaaaaaataaaatttgattgcttaatggatcatcctcgtttggaaaaatccaggccctcctagcctctcatgtgcagagaaattttgctttatggtgatgccaggacagttttgttttccatttccctgtgccataaaacggctttcttggaaagctaccagatattccccactaaaagtcttcaaggtcactccgtggaaaagggagggctacttttgaagggggtcactttcagtgtcctgattaggggatttagtgtttcccattaacattatcaaacaaatagaagaaataagagagaagaaagatcgttggagacatggggtgctctagaatccttgagaactaaggatattggtcactatagcttggttccttggggtaagtccccacttctagtagtctaagaaatacacctatgtgttgattgtgagtttggaaaatatttgccaacacaggaatacgttattttgaagagctatactttcaagtttatctattttagacagaaatctttctaaaatataacttaagggttaattgcctgttctctattgactgtagtgagctgcagattggcctcatcgggtgtagaggctgagtaggcggtgggcaacatgatgatatcagactcaaatgatcctattcaaatctgggcaccaacacactacactccactctgacaaatcaccaaatgcctctgaggtatacagtcctacttacctcattgtgctggtgttgacataaaatacatatgaaatcactttgcagaccaccaagagcagtgtgggaatacatgcatggtattcttattacaaggatacctcccacccccattaaatgcttccatatgccttttgaactcttgggtcaatttttaaaatagttttcctgcgtcctcctttgctctcagcctgttggcggaaacccttgtttttcctcagtttactgctttggtttggcttagaaaccaaatgatcaagtttgttacaaacagtaaggtaaataataatactcagtgcatgaggtattcttaaagtccatgggtccgtgacatctctttaagatgattacttaaagacttgttttctttgtgctgtttgttctcagctctgctcctgacaggtgagatgaactgcgtgtttggtccatctctaccacctcattcctgactgcccagtgtaggccctcacctcagagaaaaaagtccttccatgatccaaactaaaactgaaagcctctgaaactccttaggataatatttcaacatttggactatgcatcaaggtaagaagtcttttaaaatttgagctaacttccacttaaaatatatgccttgactgtttttcattttttcccattatgaaataggagagctttgatgtattatggtaatagcagcaatgaaaacaatcaccatgtattgagtgcttactatgaagcaaggttggtattaagtgctgactatgtagcagggttggtattaagtgctgtatgttcatgatccattttattaaactttctctcatcaggaatttgttgttattgtgttttcaaacataaacagatatgttttgaagcacactgaccagacagtatgctgcgtaagatcacatggttagaagataattttacttttagattaaaacaggaaaggttagggaagcctcattgctaataatctcaatttgctgaagacttcagtctatgcatagtgtttacattggtaccttttttttttttgaagtaagagattccctaagagagacagtcatgcatgtttttagctgaaacatttctgtcagctgtaaacatgcctggaagtcagctggtctttgctatcctcatgctttcagacgatttatagaggctatgataggctggccaactatcatttaaaacatgtccacctgtcaccttttatgggaagcgtgccttaaattccagatggtattttggctgctaagaagttgaaacttcacctatgttaaaatgctctgctgtttgaaactttcaccttctgtgtgtttttcctcgaggcaaggtcactgatgaagactttattttcacactcttctaatctgtctataaattgattcctcatagttgtcatgtttctctctatagcatatataggtatgttgtttgtgtgcatgtagtattggttctaccattaattatccatgtgaccctgggctttttaagtgttttcatttctctgggtttatttcattttctgtatgtgaagagttggaccaggcagttgcacatggtcctttgtggatttagtggtcctgagtccgtggtggactgcaacccctgaggactctagtcctggccttgtcagtgaatgacccaagggcaacctacttagtcactgaatgcattaacagtctcacattttaaataagacaaagtatcctgttcccttccctgccacagaacaatggtatgttacttaataaagagaaatgtttgcaaagaacttgggagctccttaaaggaaggtgctctctataattattaaggtgctgtgatggtgaagtgtaggtatttcagaaactgtcttactaaatggggtatattttcagattagtgaggtgctcacaactttcatttctgtatgaatttgaaacgcagtcactcagcaggaatgaatgattgtgttttaagaaaattttttttcccactattttcttgcatattacttacagcaatcccaaaatggttttagacattatgcataaaatggatgaggtctgtcgattgttgctctccaagtaaagaaacaaaaagtgaagataaatggtcagagatggttttccaggtttaagcctatggtcaggaatggcaagtctgatttgtcagaaggggacacaaagtaaaaagtggataattgaattataacatcaaggggaaggtcatataagttccttcactttaaatgatccattttgggcctatacagatgtaggagtcagatatgaattccatttccttggctgagtgacttgggcatgtcatttaacctctataagcctcagtttccttatctataacttgagaataatatagtaagtacctgtctcgtgaaggcgttttgaaaattgaagagataaagcacttagtacagagcatgtggtcattttaagaaaaattaaactgttccattcatcacaaaggaaccaaggataaatgaaaccaactgcaaaatgacttgcatggcatatggaagtcaatcctgaatttttaaaaaattatttcagataatcagtaaaacaagtgattatattgcagctatgtaattcagagttaaaggtatcgtctactctctcaattacatatgcgaatggcaagaagtggtatatggataaaatgtcagcacagagcacagacagaggatttcctaggaaacccgtgactgagcactggaggcacagaaaccaaacagcaagggaagaaactgagggggaggcagtgccctttactgccttgccaagggtgttgggcgtggtaaaagtatacgtttttctcaatttttcaatgcctgctcatcaccttcttctcaaggaccagctctgacacttaactctaccatgactgaaaagtgaaaaaaaaaaaaaaaggaagaaagatcctgcttaggttagaagatgcagagggttctgcctgaagctcacaaagttcaagtaaaagccatcctaatgggtaaagacaccccaattttgaataggaacctcttgcactgggggctcagcaagaacccacttattctactgatttttttcccctcattttaaccaaggcttctcctgagctgtgaaaaagacaatgaatgctgttatcaggagatttttcagaagcactgttcctacctgactctcctgttctctctgcctccccatcatctgccctagtacaatgccctcctctttcgtgagtacagtgatgggtcaaaaaaccaagacagggtgcttgatgagacagcaggcagcaaggaaggaggagaaagaggagaaggtgggtagcagaaggtggccactggtgaggaaagcagaaggaacacttgaaagtccaggtcctctgaatggggaacatcaagacacgaccagaaaatggggaaggttccatattaacaatggaagtacattcagatggaatcatatggagcttttactggctgcagagtctagtctccgtcaagagacgtctgtttaaaagggggcccacacggctgggcaccgtggctcacgcctgtaatccctgtaacttgggaggctgaggcaggtggatcacctgaggtcaggaggccgagaccggcctgaccaacatggtgaaaccacatctctactaaaaatacaaaaaattagctgggcatggtggtgggcgcctgtaatcccagctactcaggaggctgaggcaggagaatcacttgaacccgggaggtggaggttgaagtgagcagagatggcaccactgcactccagcctgggcaacagagtgagactccatctcaaaaaaaaaatggggggcccacacacctgagatatcagcggtgtgattgcctgccagcctttctgttcattccctgggatgtgatcctgttgccagcttggactgtgaggctaagagggactgcctattgggaacatgctgcattcacaaaatatctgtggcttcagtgacaactaagatattttagttttaagcagaactttggagagtttcatccatgctacttgacttttcttaaaattttgtgaatagagtggatattaacatccccagaaaatagcatctccaagtagagagttgtactaacatcttgaaggtcatctaagaagtcagtagcacctgagagtataatactagcccaaccagattatcttcctctcccttgttaacaactccttgttctctggattatgctgcaaaatgtatgatgctactataacacatattaatggctttgatagttttacagcattcataattaagtgttttcacataaattatgttattcaattcaaagagcaatcatgtaaagtaagtactacagatctgaaaaactgaggcttaggtcagttacagaacttagccaaagtgactcagccagaaagtggtaatatcatggccttctcactccaagccttatacttgttactttacacccactggcttgatataattaatagtccaagctccatatgaggattaacacattatcttcatatgactattatggcccaatcaccaacattgttatgctactattgttactatgtctatttacactgaattcatggctgaaatagctgaacttctcaaagtaataagcaaaattaccgtatgtgcagaggataccaatgggctaaaaacagtcaccagtgaacgggctgttgataatatgattcagaaaacgccaaaatatttatctcttgtgggtaaaaaaaaaacacgaaagtgtgaacacagatatgtgtacaatatattctatagcaaataaaaaaagagaaaaaacaaagaaatttaaaactcttgctgtgaaaagaatgtatctgtgtataagtcccttgaattaaattctcctggaaagcgtgttcacattttaaaattttcttttatttattttatttcaatagtttttggagatcaggtggttttcggtgaatgtgcacattgaccaaatgaatgggcatgtgaaagtgtgatatacatgtatatatacgtgtgtgaaatgtatgtctctgtgtgtgtgtgtttccgctctcacagagtttacattctaaagggaaggtgtaaagataatacatgatgatatgaataatacaagtcagtcctgctaaataccagaagggatacatttgccatgtgacctatgtaatttggaagactcaacttacctcatatgtgagtgattagtttctgtgatataatttatccactacaaaatcaagctttgatccataattttgatttactttttctaaacagattcttattagtggaattttaaaaaatgttatgtaacaaaagcaacctgatgccattcttctaattacccaggctcacctctctagggaattgattctcaacttcagcatgaaccagggcttgttacacagatttctaggctccattgcctgagtttctgatttaggatgtctggggtgggggtgaagggtgggggaacataatttgcatgctgctagtgtagggatcacactgctccagggttatctttgaatttgccctattgcttgccttccacatccatgttgacaccaaggcttatccttcttgtattctctgtctttccctttcatttccattcctttatttgacttctgcttttttctcttgatgaagggggtagaggggagcactgctttcttccctgacaggatggtttgtattatctttgtttttttctctctaattctgttgctttcaaacatgcccttaactcttagtttcctttctcacaacttttatgaagctgcagtaagtgaatgaaagaaactcctagagataaggaagtcctccgtggtttgtttagcagtggataaagagtggttaggtgagcaattttcttttactgttataaaaattgttaagaaataaaaaaattcttgttatgaagaatattcaagagcaatctaaggagtataaaggagtttcagagtttaaattccaaagaggaaggacacatgtcaagcatgtattattcagagacaggaaatagagcaaagaaactaagtgtctcctgggtagtaggggcgaaaagtaataatgatgaggatttttaatttttctaattaagtaacactttgcctcttctgaaaagctctcacatgcatcatacgtttacatcaaaaggcagaaaaaatcatttttattttaaactcaaagaaatagacagttgtgaaattaactgatttgttgaaggacacacaggcatttagaggaaacaaaactggatccaaatcatctaattacagtacaatcgtctttcatttatgcctctactttaaatttttgggttataatcactatgaaatatgctttacaactaaagcttccttgattcttaaaggtagagcttagctccaaagccaatatgatggactacttctttgtctcaaacagattttttttttttttttttttgatacagagtcctgctatgttgcccggggtggagtgcagtggtgtgatctccgctcactgtaacctctgccttctgggctcaagtgatcttcccatttcagcgtcccaagtagctggaactataggcatgcagcaccatgcctggttaatttttatagtttttgtagagctggggtcttgccaagttgtccaggctggtctcaaactcctcggctcaagtgatccacccacctttacctcccaaagtcctgggattacaggcgtgagccaccatgcctggccccaaacactttctttcatgaatgtggatcattaacatagagcagtacaagattttaattggaatatgaatcttataatttattctcttcaggtttttttttttttttttttttttttttttttttaagagataggtacccaggttggcctcgaaactcctgggctcaagtgatcttcccgcctcagcctcctgagtatctgggactattggtgtgtaccatcacacacaatttatatctgcagttgttgaaagcaactaccatctatattaaactttggagttactgaattgctaagacagttactctgcaggtctattggtttgcatagcagctgtaatggagagaactcaaatttctttttaactttgtcaagctattctttttttttaggactctttttggttagagtatgggtgggaacacagagtccaactctactcttacaagtatccccgtgctttctagaatctttttatactaacatttggactttttgctttgaatttttatcacttccactgggctcttggaaagttttgaggctccatttttttatgttttccctagaaattgaaaagaactttgtttggaaatgcgagctacaatgaacccaggtcttgaattatttccacatgttccggctgtcttgctttttgaaatctagaccaattgttctaaaactttgttaggttaggggatccttcagttagacaatagtcttgaaagactgataggatttccaaactgccactgccaaataattctggaatgaaagggaagagcattacttcttttaaattaggtgcctgattgatatatgcacattattattttcagatggggctatattatacacaccattacaataacattcataatttactgaggatgttcataatttactagaaaactgaagtccacattttaagcataactcagatttataaaatgactctacctatagcttttgcatctgtgtctgagtgcacaaatcctttgctggttttcttatgtccaaatctagttatctcggttaaccacagaatccttcagtgaatccattggagaaatgtatttatacatcacgaagatactttttggtagtacattgaaaattttatgttgcaaatttaaagacttattttattatgtgatctaacagaatgtgtgaattttacatctgataggtctacttgaagagatgtacagaggggagagcagatatgtttatggatccaagaccagcaaagtcaactttggttaaggagatactttcacagatggtccttcctgcacccctcccccatgttccttaatttaatggcttataaatcagctatccaggggaggaaaggatataaactatgtgacagcactctataaatcataagatgctacaaaataaaaacattactatttgattaattcacctaataatggtgatatccataccatatggaaaatttcttgtgatttacctctggttattagtacattcacatttatcccaagtaaacaaagcaactcaccactacccaagtttcttcataaattcagtagtgagtcactctgtttatttggaagtgtgaatactgtgatctttaaaaactgattctcataaaagtacatacattaatttacataatgtcctgacttacattaccctgcaaagaaggcaaagttcatcttaagcaacgttctgtttcagttgtacaattccatgtttgatgccttgcctctatctctgttgctttccttcccttcagtccccaatctaaacttcactgttttatgtcttctctcttggattcctactagctgatctgagaaacaaggttgttttgagaaactaatttgttttcatgtatcagaattcgagtatgtaacttttccctggtaaattatttgtcatttaataagggtattctgaggccaggcacagtggctcatgcctgtaatctcataactttgggaggctgaggcaggcagatggcttgagctcaggagtttgagaccatcttaggcaacatggtaagaccctgtctctacaaaaaataaaaaagttaaatgagcgtggtggcatgtgcctgtagacccagctacttgggaggctgaagtgggaggattgcttcagtccgggaggttgaggctgcagtgagccgagatcatgctactgcactccagcctgggcgacagagtgagaccctgtctcaaaaaaaaaaaaaaaaaaaagaatttcaaatataatgatcatcactgttataggtattcttaggtccaagagaatctaggtgacatcacaatcgcttatgtgctcacttatatggaggcacatccatggaatgcccaattctatgggaattccatatctctgtaccactatggagctatgaaaaaggattggctgagagatcagaagatcttagctctggaatcatagaatccagggatgaaacatgatcttgcccatcttgatgactgaatcctgtgtacaaaatccctaaaaatgttcatccattctctccttgaatgcgtctaattacagaaactcactccatttaaaggcagtctatctgatattagagcagatctgattgttaacaaaatttttcttttattttgtggaaaggatctcctgatagcatccaatcattggtctagttccaccttttggagccaaactatacaaactgaatgtctcctcctcttaaccatcttaataatagctaccacttatagagcacttattatatgcttggaagtactctaaagacttcacatgtattaatttattctcaaaacagcactataaggaaggcgtatcacgattattctcattttatacacaaggaaactgaagtatagacaagttaagtaatttttccaaggcgacaaggtttagtagtagctaagcctgaatttacacccaggccatctggctgggtgtaagagctcaagctcttcctgactacagtatgctgcctctgaaacacaaatacttgaatatggcttatataatgacctgagtcttctcttctgcagtctggacatccctaggacatcccttctccataaagggttcctgtgacggtgtctcttggtggcagggtgctttgttcttatgatgggaggaacacagttggggtttctagaagaggcttgtggtggggtctgtttaaaatctgaaagatgatcccaaaccttcccttctacctgctctcttaccttgccttcccacagccccctcagcccctgctgccaggcctccaggtggggtgacactcacctgtgtgtacgaacatgtgcttgacgtagttctgtttggcggtgaaagtcttgttgcagagagtgcactcataaggctttttttcgccttgcccactggctgtgctgtggcctgcggatgaggccaggggctgtggcgctggcagctgtgcagtaaaggtcgacagaccgggctgggacactgtcacaaactgggtctgctggcctgccaggggctgtggcaggctgaagaggaaaggcttggggccactgcccgcgggctgggtagtgaagagggctggcaggtaggtgttgccagctgtgccaatgacctgcgtgttgctggtcaaggtcagaggcatcctcaggttgctggtgagggtttctgtctggcgtaagtagagctgggtacttggcaatggctgcccgatggacgtgttgaccgaaggctgttgtaggacgctcttgtcggagctgttgctgacagtgataacagtgctgtccatctccacttcattgcttctctccggagaggaagcacctgtttctagctggtttgtctgcggaccaccctcagcgggggcttctgcagcctgctcgggttgggtgggttcagcctggctgtcccgcgccgccccaggcccaaactgctgctccaccgagtcaggctcggtgcctatggaggagctgacgcccgagtcgaagctttcacctttgggctcactctcggtgccctcggcctggtctgtgtcttccgtgcactcctcggattcgttgcgttccaggatctgcaccctttgctgcccgtagtagtcgtaatcgtcctccatctcctgcttgatgtggatgttgcccactagggtctggatgcgcacaggccggggctgcttgcggcagtgcgtggtctcgggggtggtggacaggtagcgctccatctgctgcgagcgctcatggatgcgtgtgatccagctggggtcttccatgtggtggtcgcggggcaggccgagcgcagtctcgtggtggctgaccactgcgccgctgtaaaaagagcgctcgccgctgccattctgcatggagcacgcgtagagtgccgagtagatcctgtccacgctgtgctgtgggtggctctgcaggtagcccgactccgtgtcgctgctctggcctgacgtgcctgactcgggagtgccccgcggcgtgtcctggcccgagtcctggatccccgggaacacatcgcccacgttctgtgacacgatgcgcgtgcactcgtcgatgactgttttgatctgcaggatgctggcggccgtgaggatctgcagagcttccgactgcgagacccgtagcacgccgctgtacatgaagtcaatgagcttttgcactgactgcactgacaccaccgacgggatctcgatgtcgctgtagccaagcagcagtttgtcctggaagaaggggctgccggctgccagcacgcagcggtgtgcgcgcagcatgctcccgtggatgcgcaccgttacgtcacagaagtggccacggttgcgctgctcgttgagggtctcgagcacggaattgctgaagttgtgaaggttgatgctgtgaatgcgctcggtcatccccttgcaactgatgtcacctgcagcatgtcaacgcagacacaaaacagggcatgggtcagatctagctggttgcattcctaacacctaggtttcaggtgagtaatgctcatggctcctagaagcactgcccttacatacgcaagtggggagatggacaggctgcggcatacaagctgtaggtacgatgacctgagggaaaaggaccttgaattttgctccaattccggcctttagtgccgcagccattttgggtatccatattaactccccagagcttcggctgaggtagagtggcctaataaccagatgatttgtttgcctgctattcctacagcttcagcaaagaactgaaaggcaaatggaagacttgttcttatggaacactaaacctccactttatttttatttatgtatttatttactttgccttcactttagacaggcctaagcccagattctttgggaaagtttacatttcccccaacttatcaaagtcccttattttattcatacacagtgaccatattcatagttaacaaataaacccccttcctattaagtcatatggcatattatcaaaacccacaccatgtatgcaaaaattattggaaaattcaacccagactaagatatctaccaaacagtcatgatcatgctttccggatgatggatgggctacagaaagcaatctgctagctaaaggggcactccatggctgctttctgtatctactcattcttcttgtcatctctgacaacctgtttgagcactttctagggtggttgcatgtgatatggaaggttttctgaattttctgaggcttaatgaaggaggaatgttaaaaaggtcagagatggcagttctgacccaggagactacagtacattggtgatcatatttattatgcaaacagggcactttcaagagtgaaagagagcattgttaataattaggccaggatagcaggagtaagccagaagtgggatatatgatctccttgggtaatagggtgctttatgtacttgccacagggaagtattaaacagctcccaggaggaaggcaacagctatgtggaggctgcggatagcctgacccagcgccaccctataacgtaggctgttatggcaagggatactattgataagatttggattcagaatgagaaagaaaacaggtggctacagcagtagatcttagggcttttctatttttctagctcatctctcagatggctctagagaatccccctccaaataattcttcaatcagattccccattcttgcctttacaactgaacaatcagcttgggaaagtgaaataagtgggctttcaaaaccaaatggcccaagcactgattgttggcctggacccaaatctctctgtcttgtgagaagccacctgagaggtaacagcctgcagataggaagaaggcctacctcctcaaactctttccgctctaccttgcgatagaagacttgttcaggaaactctgagttcaatgagcgtttctaccttgcttcactcaatcaccctcacatggtatgagcttaacttaataaatgttcaataatacaatttgcactaatttgtataagagcattctttctcgttctgactctatcaggtctgttatgtgcctaaaatattgtattaggctacagattccatcgtttttacttatataagacaagttctctttgccagattaaagaattaaggtaaatcccctgtaaccatgtgaacacaaaatatggccccaaaagaaggcacaaataacccaggaagggctgttcaggagctcaatcagcagcagaccaaatttcaagttcttgctgagttcgccatacatacataccatgatagtaatcacaagataacattttttaggggttacagttctaactgctttctgtatatgatttcatttaatcttacagcaaccatgggaagtagatgatattattcccattttacagatgaggaaactgaggccagagaaactaagaaacttgctcaagtacacacaggcaattgctggtagactggcatttaaacccaggcagtctggctctagagttcaccctcttaactgcttcattatattgcatagtttgccctttactgaggtctggcccttagggatccacggctctgttgtaaagctgtgtgaaaggctttgtccactactacctccagctacttctatacctatccgtgatttagtgtggcttttatgtttttaggctgtgatgctttgacatagcctcagttgtgtaacttaaaggacttatttttttagatgtcacagtgcaagaagtaagacaactaactggcactatggtttaggattttctatatacaattttactataaccaaggtctctttcatttaagtaaaacaataagcagtaaaactggttgtgtctgtgatcatctctgtgtaggatggatttattacaacatttttttctacacaagtgaaaacactctttaaacatacatttgctcataacattagttacaacaataacactagagatgtcatatatgacagttttctttcagataattctgggaagtagccctatcacaattatcacaataattagtatccatgtagtgtttgactgtgtatacaacttttttacatgtaacatctcatttattccttacaacaatcctatgtgtgttctgaacaggtttttttttgttttgttttgtttgttttttttttttttgacagagtcttgctctgttgcccaggctggagtgcagtggcacaatctcagctcactgcaaccttcaactcctgggtttaagcgattcttgtgcctcagcctctcgagtagctgggattacaggcatgcaccaccacacctggctaatttttgtatttttagtagatgagttttcaccatgttggccaggctggtctcaaactcctgacctcaggtgatctgcccgcctcggcctcccaaagtgctgggattacaggcatgagccactgtgcccagcccttcaggacaagtcttattattgctatttcatataagagaaagtcgaggctctcaaaatgtctaaatgacttgcccaaagttttgcacagtagcacatggcagtgttgggattagaaactatgcctcttaaagctttttccactgcataacagtggatcactgaggaatggaacttgaagtgcccaaagatcgagagttatcttaattctcagcagagaaaaaagaaagacactgaaagtaatgatgaaggttgctttagagataagaaatgaacacagataatcacacacacacacacaattccatgagaaaaatccaaactgtttgaccagattggattgcaaattttgttcatctaaacaatcaagttatctactgaatagtctgagttaagactcttgcgataatattgccaccaacttcattaaaaaccacagagacaaacctaaacctgcacacgtacacaacctgatctgacatgcctggttgaattttatacacacaattcttaaatatctccctgagtacactggccccacactgcagtgaacagccatgaaaagctgaatcgtttttgctgatatgagtacagatgcgaagggggaccctgcctccccattcaagcatgcctcattcctccagcacacaatgctgaggcaattcctttcccaggctttcttttatttttaacactaatacagtgggaaaaagtttctgccacagcaaggcaaagtccaggcttttgtgagcatgtccttttcatccaatgggcattaatgtatagattccaatggaataaatctgaaatactctactgtagaagatttgtcccccattgaaaacaaatcttgattagatggttattcagggagtgtataggaaggaatggtgtgaaaatgctaactctattctttcttagattggcactgaataggcatttgggctattcaagaaaaaaaaaacacacacacacacacccaaaccccaaccctatcaactgtacaaaaccacaaaactttacatagattatgtgatcatgtgtatttggggattcttccccacccaaaataaaaaatgcacagtgttatgaacacaaaactgatggcaaaatgaaatagtgataaaaatagttctctgtgttttaaaataataacttacctcctttttactagagtaaaaatacagagtcagcttgtgatggcattccctcaaaacatggaaggaattgcagtaatgaaagtcatcatgtattctaagagactgttctgcgagagcacaacacagacggggctaaagcaggggtgagtaccgaagggaaaatctgcctgtggggaattggggatagagggcctgactctctgttttgcaggaacgttgctcctgcctgtcccttaagctgcaggggtccagggataggacttagcatgagaataaaaagctgcctgctcacaagagaaaatgagcaagaaaggaaacagcaggcaatacaatctcttttaattaggtgtgaaatccagttctttctcaatcaggagagcaaaaggatatataaaatgagactagtgcaagggtaagatgctacagagggggatggggatttgaagtctctggacttggaaggaaacatcagctctcaaatgaaaaccaatataaatttcggtccagttaataagcctaagtcaagtggcagggccagaaagcccttgagctttcaatttggggcaccagatgaggttagtgggtcttgcacatgaaacagggtgcagcttgccaagttagtcacactaggaaagagccagtcatctctggagaaaggggggatgtattttggtgactgagcccccttattctccaaaccccctgcctggggtaagacttcagttacatgtactttacctcctcatatatgccaagggagtcctgctgaatccctgcactataggaggtatagtagtttcttgctaacaggttccatccacagcaaatgactctgcaccaccccactctctctttctatctcattagtatcatcacagtcttgggaggtggctgggagcactggagaaatcacacatgcaagtggaaggcagcaagcagacaagatctctttctcctatcttggctctatatacctagcatatcccagctgctattacctctgtagtgagactagggagggtcatcagcctatgggagggcgagctgtacagttttacttacccattcttgggtgaaaaggggggtgttttgggccatctcccaataaaggttctcctctatcttccagattgtctaagcccagtgtggaggaaccatcaaggatttcagcacgtttttttagccattggtaacagaattcttcacataaaacatatatcaattgttgaaatttgcagaaatttgacttcgaacttgcagaaatttgactttcaaacatgtttgcaggaatggctacctatgaaagttggggactagctggatgtgcttttttagtcactacttattattttatctagacaaagattaaaaattactaacttgtttacagtatttacaacaccattctatttatgatcccaatactgtaattgggtatgcctttaatattacctgaatttttattcattcatagaacatttctagagaatacttaaaagtatttaaaggtccttggttttatgtttgggttttggggggtatgtatagtttttataaatggacatgtttatacttttataggaataaggtcagtggctttcatcaaaatctcaaaggggtctgtgttttccccaaattaagagctgtggattgagattcaggcatccctctttaaaatacttgtaactactttccataatcaaagcttctaaaactgatgcaaactttgtgattgcattactctgatgcataaggtctgttgaactgatattttccatttacttaagttgagctgatactattttgtatgagaaagcaaacaatcttggccaaaatgagaaaagttacttttcagaagagaaatattttttaaaaagattgaaagggaagagagaaatgtaggtaactactaatattagcagaaatctggattatgacagacatatagtttacaactgttgaagctaactattatttagcaaactttgttttactcagagtaagtcccttttgacagttaagacaaatccacagaagaattagaaaacaccctttaacatcttttgactgttaaaaattagatattgtggtataatttgaataaaaaataaatataaactcaatatacacatctaatcagccaaaaaaatagtttacttgcaagatctatagcacttgtaatggggagactgcctttctttctattttcctccttccctttcttcctttttgctgtcataccacgaagttttactaagtttgaagtatggggaacaaagaggcaaaattgagaactagaaaaacatttgctctgtgattttcaggcccatccccaaatcttgacttatcttccattcctgacttctttttcctctcttcactccaccaaaaaataagagctttatactttatctaaggctgagaatagatttacagtactagtgggattttacaggtccaaaggagaaagtaattccagaaaagtctttttacttggccttagaggtctcacagtctcccttggttagcccaggcctttggcttgcctgattttatgttaagtctgctgttctctctaagaaaggatgagggcatgcctatccatattgtaaaactgtaaatacaactgacttatgaatgaagctgctttgggggtcacttgaattttcaccaattcattagtgaaacatttactgagaataccccagtataaatggaaccataaggatacaaaggatcttaaatctaaatcaatagaagaaatttatccataaggatctttgatattggaaacatatattaatcaatcaacttctcccagacctcagtgctcaggaaaagctgtgttttgcttttctttgtggagcctgtgaatatcataactgatcatgtttccctcttggctctgttcactagggagctcagaataaaaatttaggcccccttttagcaactatgtaggacctcatggtatgcttttctatgtaaaattttcaccagcctcattatattatccattctttattttacctctactctgatttctttttttttgtagttatatagaaatacatttcctacatatttattaacaattgaatattaatttaagctacctcaaatcccttacttatgaggtgagggcataatcaatcaatcaacaagtaattgagcatccactttatgaaaccaattccaaccataagttaaaacttcagtcttgagtattatcacactatatgctttatgaattttttatactttgagcatctgattccaatgaggtaaactgttgaaatttactttacagtacagtttgtgaaaattaagttttactctgtgaataaagaattggatagataattccagacaacattctgaaagacacttacgccgtcattccaaagttgaaatgaaatgagggggagaagacttgctgggactaaggaaaaaagtcaatgaaatctgaggttgatgcctttaaatcctcttatattgtaaaccttttgagacaccttttaggagtttcattttttctctctctaaagcgctttccttacaaatttagctactgccctattgtaaccttttcctttgttcactaaatctggggaacaaaaatacagagatgctacatccgtgggtggtatacaaaaatgaaccaaaggatctacttaaattcacaaatttgtgctgtttgaacttggctttgaatagaccttaaagaaggatctgtatattcaattgtacagttaataagttaggtcttttgttttgcttaagaagcaatcacaaatttaaaaattgagtatatgaaaaccagcatcttcttacttgataatctgttcttgtggtctctacataatcatatacttattttatagaaaaaacagatttataaattcagtgagttcaaagattcagtataactctcaggtatggcatttctttaaagaatatcatcacacactgatgaattatagttaggtaagaaactgattttttgactttgggaaaacttttctctggacttaaacgagtgagaaaacagaactcaatagtgtcattaaaaaaaaaaaaagctttctggcaaaaaatatcattgagttcccaattcatagaacttcctttagtcctctgttgctgtgctgttctgaaactgcttttgaagcaggtcttcaaattcatgctcaaatgttctcttcccttgggtctttctaacaaataaaaaaaagttgcttccaatgagaccgctgtttttcaagagtatctctgtttgttggtaggaggggaatgcaagattttctttttttttttttttttgagacggagtcttgttctgtcccctaggctggagtgcagtggcgcgatctccagctcactgcaacctctgcctcctgggttcaagtgattctcctgcctcagcctcctgagtagctgggattacaagcgtgctaccaaactcggctaatttttttttttttttggtatttttagtagagacggttttcactaagttggtcaggctggtctcgaactccttaccttgtgatctgcccaccttggcctcccaaagtgctgggattacaggcgtgagccactgtgcccggccaatttctctatggacttgagccatgatagataagttcactgaggagtaaagaccttctatcccaaagcaacagggaaaagccaaggaaaaaagtaaatctgttttgttggatgactggttaaaatggaagcactgagatgatttgtgtgggctaggttaagagagtagctgaaattcatctgcgcacctagggtatagaaccaggcacgggaaatcattaaaaaaaagaataggacctaagttcctttttggctcatactgagatgaagaataagtgctgtcagatagaactcaaaaccttgggaggttctggtaaataagtaaagtagaaggcatactttataattattttaatcacaagtaggcattttatctttatgatattctttatatagtcttttgtataatatttattatattatttacatattgtcaaaaaagacattgagctatagaagtctcctatagctatagctaacattcaaattatctgatttcacttcactgatttggttggatttgattttctctaaaataaaatctctgtgctaatccaaaaggttggccattttgctttcctgtgtgtggattacattcatttttacttctcttctgctgaattttccgcagttctgaagttattgtggtttctctcctcaccaattcttatcatccccatgaaccttattcaaactttttccttttctgtgaagccttctgtgattactagagttcacttttcttggtttccactggttggtgaggtaataaactaagacattcatttttggcttgttctcactgaattagaaaactttcttaatgagaaggtatctcccctttcctccacctgtaggaatgaatggccaggtttttgtatactttataggctcctttgcctcagggagttgtggtttcagagcccattaagccctaaagaataaaccataaaacaaagagttttctttcctaatgtctgttctctaaaatgaattattaacccagaatgggtaaggagagtgaggctgattgatgctttggagttagagaattggatagcattactggagagaaaaacaatccactttccctcaaatgcagaaggtagcaaggtctctacttgcatacagctccagttggggtaattgcttggcacacttctggaggctggacataaaaaggcaccactttgagaggaacagtgatcatctgggggctgggccaatggtcaacagcaaggaccactgtggagggcatctgtaaacccagctagtgcagtagtgctggcagtcagaaggacgaggctcaatggcatctttgtggggtggtcaagcaatgtcaatgttggagaccatcatggactaaggacttagatttaatgagtcttgtaccaatctagggatgagaagggagccccaaaacttgtctgtatttcttgcgaatttggtgacaggggcctcaggtttaattttctttagaaaaatacgggaatttttttgtacctgaatgttgaggagtgttggggaagttcacctgaacttcctatacatgtagcacctaagttagttcttaccaatatattattgtttcttttttcatttgtgtctgtcttatctctctaagactcaaagcctcccaaaggctagtatcttgtcttgttataaccacaactacaatgacaactacaaatatgtaactggatccctcattgtgcccagcatgtttctttataatgtgtgggttctatgtgagtgcttgtttggtcagctcttcgctacacttcacaaacaagtgggaacctcagggcgcacatttactctgagatatgtctatgtgatatggtcctgacagggcttttttgcccctgaagttctgtgtaatgctcttcttcttgtcctttatttccctacctacccacagttctattttcaatagaatttaaagtccaagcaattgttttatgtgttcactgagttgcccacaaactctgctcattcatttatgatttctgatacatgccatgctgtctctgtctccctgattccatttccccagagagacagctcactgggtccccctgtcaacagaggattcagtggaacccaaagctaagccatactttgtaataaaaaataagaagagatgaccaatctatgatgtgatagaaaaatgatcaggccaaactccgatcacttttgcctatgttagggaagctaacctgcttggtaacagatgttacagaaatatctatcaatcagcattgataacagggtatttatatgtacattaacagtagtgtcaaggattgtttagaatattttctcttggtggccactgggtgtcctcatttacaaagtaaatatgcaatatttagtgaaggtcactggagagaataaaagacactagttttctctttggcccttcacatactggggataaatttattgctgaactcacaagcaggttatatattagtacagtttaaaaaccttcaggtcaaactgttaaaagtttataaccaagagtaacttattcagggtccagacatgaattttaaaggctgtttcctcaacagaggggactgtgatcagctattagaatgatcccttattcatttgaaaattggcatgggattttgactatctgccgagagagccagcagagaggagcagagaaggtcttaatttattcttgaaagaaaagagaacaccaaatatctctatgggatatttgttagattctgtttttatctcaccttttctgaaaactaattaaaaataataatgagaagataaaatatgtcctttgcctaggaaacctgaaataatgtgaaaaacattacaatgagctgggtcagtatactgattatcaatcatttcacatttgaagacaaagaattaaactattcctttatggacctgttatcccacctgtaaaacaaaggtgtgtatgcttcacagggatgttgtagggacaaatagaatatgaggcacacaaggttcctaggaagagaaactgtacatgagatagatttagggcattactagtattctaattgaggctgagtcacagttgtatatgacttgttcctgctggaagacagtagtcaaggccagagctcacacagccaacaaatatgttctgatttgctgctctcagacactgagtctgacacactgctcagcaatcacttactgctccctaaagtggtattttgcatttctaggattgtcattgtctctaaatttatacttatatacatcgctgatgaggttcttcccttgcaaaaagaaatttcagccttcctccaattcaagatacaggcctactattgaatacataacagtacatggccttcaaatgtcatgcctagccaattagctaatcctttcccaaaataaacttcactgtaatattttttttttcactagcatacatccccagcttaattactattctctggcatgttatttcagtacataaattatcaatatgattttgtgtcaaaaccaacaatttgaccaggcatgttggctcacacctgcaatcccagcactttgggaggctgaggtaggtggatcacttgagtttaggagtttgagaccagcctagccaacatggtgaaacctcgtctcttctaaaaatacaaaattagctgggcatggtggcgcatgcctataattcgagctactcaggaggctaaggcaggagaataatttgaaccctggaggcggaggttgcagtgagctgagatcatgccactgcactccagcctaggcaacagagtgagactctgtctcaaacaaacaaacaaacatcccccaacaatttatgcaaacaacatcagggaagctaggaagctctatgagctattctctgccgttcagatatgttcgattgtcttactagctgagcttaacagccttttctgtttttaaaggaccaccatgcatgcctctagtacagcaatctctaacacttaatcaacagttacgtctacagcaatacacaatagccaggtcactttcaccctgagattatactaaaggctcacaatatgctcagagtgtatggaaaagtgtctcatttcttctaaagatccttaaattccttgcttttatagtattatccaactgattaattagtagattcatttttcaactactgtagccccaaagatacatatcggcagagccctcctgattgtattttacccttggccttttctccttttagtttcctcagtttgcacctgtaatttcacttttagaacttctctaggctcggtggctaaacaccacacagcacaggctttatctgatgtgccggcgcctggtgtggtctaagacacactggtgttttgttcttgaagtacaggattgatgttctgaaacctaggctctaacacaaaggagatcattagctcattttaagtgtctcttttcttccctcccagcctcctcctacccaccccaatacttccttagtcctaagcactggcagcagatggcaaccatattccaaagctgagtatacataaaatagtgccatggagaacagagtggcttcaaagttagcctttctattcaagtgggatggcggggacttctggaggagtgaactcatctctcattcatttaatcctctattcattcagccaggaatttgttttcctacacatccatctactgtccagccagttgagggagggtgggcatgaagcatctctcttgagggcccttccagcaggagggcactaagatttctatgccaagctcttgtttccctgggccagctctgcctgctgctgatcaaatcatgccattcctgtaagaggagcttgggaacacagtgtgtagggggtggatttctcaagaactatctccttgctagactgacagtcacatgctgtattccctagacaaagattagacccaggaaaaagatgaaacaaggaggaggatgtggggttgcagaaaactgtgcaggatgttacagtaacgggaggtgggagtgggaaaacctttcctttttgttgtttcaaggtttgctagagcttttgcctaatcatctgtttgagcatcttgaaaataagtatctatttccatggtatctatcaaaaacaggcaccagattatactacaaagttgacctgccatattgctattagaattaaaacatgtagcagcttacattcaaaagaaagcttttctgtttccccagcatgaaaagcagagggtatttgtgatacactttgttttgtaggtctgctgaatgaaaaaaataatcgggtaaaaaattagtacctatattttcacaaatgggcataatgcttacaaatgcactacatcattattttagcttcattctccccacaacattcatttattcattcaacaaacatttgctgagcacctactcctaatttgtgtaagcactttgctgggtgctagggattcagcagtggacaaggtaaacaagattccgccctcctgaattctgtcacctggccaaaataaacatttaacaagtacgctgctagaattttacttgagaaaaaggaataattcatcttacctagtatttcttctgaatctttcttaaacatatttcttgaaggtccagactcctttaactaagaagttctatcttaaatctctctctttccattgttatattcattcctttcttggttacaatgtggagagttcagattgcaactgctatcatttctggggggaatgggggtgggactgtaaccctgagaatccttgcttttcaaactacacatatattttctctgtaaatattgtaccatctaatttgcgtctttggattttgttgattagccatcaacatgtgatttaaggaatactgcatatgagatgcagaaatcatgactcagtaagttattattttaaagctctattttgggatttatacagacttgtgtacagtctagtttggctttcaatctaatctgcaactattactaggaggcttttagatcaagttccatacccatgtgtctctggaattctacagtgagaagcaaaagtgctcaggagttaagagaagcagacgtccgaaattatctccatgcattaccaaaaaccgtgggcaccacggcacggggaaaacttaccaggtacaatgagccagtgactgttactgaatttcttaagattacacttttcccaactactgcagactgcttcagaatagaagaaggtaagtaagcagggtgattacaagcaatcctcctcggaagtgaaactcactcttctaagtttacctctgttttgaattatttcagacaactctcatgccatcaagccgacggactttcaaaaaaataaaagatgcatttctttacttgtaagtatttgtctttgcaaagggctctctgatatggtagcacagaagtttgcacattctaaggatctgatgttttgccctcttcgggtatcccggctggaaggagctacggtgaaagggcacctaaggtgaatggacagattgtagatgggtgcacacaggaaaatgtacagctcctacaatgtattctgaggtaagagagcacacaagtccattccctataatttgaaaatctctcttctttttttattttttagagacaggatctcactctgtcacccagggtggaatgcagtgggatgatcatggctcactgaagccttaacttcctgggctcaggtgatcctcccacctcaaattcccaagtagctggactacaagtgcacaccactatgccccgctaactgttttgtagagatggggtttcactatgttgctgaggctggtctcaaactcctgggctcaagtgataaatccacactggcctcccaaagtgttgggattacaggcgtgagccaccatgcccagcgtgaaaatctcttattgactagaatgcacttgaagacaaaaaggaacttaacaggttaacactagaatgtaatgctataatattaataacactctaacccttccctataccaagaagacaacattcagagagatttgaaacttctttcagccccagtttccttatctgtaaatggggtgttttgtaataagattatgcatattagtcctctttcatttttaggaaaaaaaaacatacaaatgggggaataaaagaaggcaaagagataatggagaaacttcccagtctattcaggcctgaatccaagaagggacaagaagaagggcactggcttttcctcgaagtgaaggatgtaactgtcttacacacaatctcctcccatagatctagggcttttcagcctcagtcgttctcagggggaaaggatggggacctgcaacaactttcacttaggctgcatcaattttagttcatattaataattttcaagcacttaaaactgtagccgacactcaaattcacggagcgctggctgtttttctggtgctgctttaagggctttacatgtagtgttccatcgaatccttctaataaccctatgagatgcatactatttttattctcattatgcaattatgcacatgaggaaatggaaacatagggaggttaattaaaggcacataaaatgcattcataggctgaagttcatgttaaaaagagcaaataagtagaccatgggggtgagaaaatattttctgaatattggaaaacaacacatagccccagtcttagtccattagcaacatgttcaagaaatagctttagcagtctgttatcatacctgcccccaccctgaaggcatatcggagggacccgagaggacatcaggagccattctgcattgggatgttcacagggacctctcctcattgcttctaagttcactcttgggtgccaggtttgagggtgcagattctgattaggatatgtcctggggaagtggctttttccttctgttagttctctgaccctaatgtaacaaaatctttaaacctgtgtcccagaacaacacgcaggaaagaatatgaacctctaaaagaaaggcccagtaatggtaccagtagagtccaaggcctccaggtcaagaactcctgctctggagcagggctggaagtgggggcacgctttgcctgtatcactgcccagtgaaaccaggcctgctttgcagtgcctgttagcatgtcaacccaggattacttaggccacttcaggaatcccaggatctagtcacccatctgggacctttaggtcaggaagaaaatggaatgggctagatttatgaaaattggaaaaaatccagtcaggtgtacctataaagacctacagtatttccctgagaaaatgacatgtatcctttaccctggggttaacttctaaaagttttagtttagaatttgcatgtgtcttttccattagacacagagttatcttttgtagttcaaacttatatgcacctttctttcattgtctcctttacatctaaatacctggttaagatatgaggcaaagagataatcagtgattatatagggaagaacgtgattacagtaaaaaattgaaggacaaagttaattcagttactgctttttgaaattctttgtagtattctacatgccacaccaagcttttttaaaaattctgtactctttggtctaatatcttggtataaaactgataacataaccaagctaaaactagtgaggataaataagtaggaggaaactcatttttagaattggagaggaaaggaaaaaactcctcaaggtcaattttgacatcaactataaattcatttggccttgtgaaattataaagactcatgttcaacattgttccatgtggttgtttatataattttcagtagtgacaaaataatctccttatttagttttacaggtaatttaatagtagaacaaagtatcgtttgattcagttggttccagatcaccatcctacagtagaagtatatcagatacttttgtgtacaggtgggattggcctttggaatgtcttggaccatcacagaaagcagcatactttaagtaaacaaattgaaaccctccctacaaataatgaatttgaggatgtcccatgacaatgaaggtggccttgagaacaacacataggtttgttattagtaattacagagctacctgaattgggcatatcatgaaagaagtacacagaacatggcttttaaagaattatgctttgtcatttcaaaaacaattgtttttaaaaattgttttaaaaattgttaagatgatttaaatgttcaaagtgtatgacacctatcctctgcttagtgttcagaggttactgagggtaaggaactgagttaatatttgtgaagtaataatacttgtaaaacattatttctcataaaaaataatagaaagcaatgttgagaagaagtagagaaagaaccagtataatataattactgcctcactgggcttgggtagtgccttcaaattcctttcacatatatttaccattccaattgccctgtgaaatggaagatctaattccttctcactttgcctatttaattgcagagtctcccttaacactggtttttctcagtctataatgggctaggaactcttgtatcataaaaatattcattactccacttttgagttacccattcattatttctttttaaaacattaaacttgtactttgtaatagttgctttcccatttatcctatgtttgctcctgaacccctctttatggtcttttttgtgacacatctgattctgttttcttgacaacaatcaggaggctagtaatcccaaaacctaaggtaatcttttcctaggtctctccctcgttggtgtctgtggcacctgatactgactgctgatccttcctctccctgatggtctctctgcactatcctggtttttctcctatcccttagaactctcttttcttttcctctatttattcattcttcattctctttcttatcactcatgtaaatatttcccaaggttttgctttccttttttctctcaacaaagacttctttgaagtttactcccatatttatggcttatagtgctcttggccaaagtgtttgctagtcctaatctcacgcattcctgctgtgccccaggaccctgtttgtaactcagtgttagttgtctccactgggaacacctgtggtagctcatactcggcactatataaaatggaattcaatttgattcctttaaatgcttttcatctttacttgataccttggagttatctttgataactgcctttgttgtaactaacactcagctcccagagctgtctaccctcatccacaaaatctgttgcacctggatcctccccattcctcctattaccgcccccttcaggtcaccaatagtgtgaaatactgacagtgctgtctggaccctctccttcctccagttgctccttctcacatccaggctgccaaattagatcttctcaaaatcttgctcatggtaggccctacttaacacccttccacagctctgcaacagaggtgcaaacccctcatacctagtcctgatgcctcatttccagtctttcaaaagagctcaaatggagccatgtctaataaacctacctagatattactgttaactggattaaaatatactttacaaactttctaaattctcagatactggtgatgtgaggatacatattgttttaagattcttggtggtggggtctgtttttctccacctttgtgtcctcatggaactcactgtagtgacaggcacaaaagatatattctatacatacttgctgagtgagtgaatcaatgctccggtgggtctctgtgtatggggacatatctttaaccacgctgcatggaagttgtttgtgaatgttatttgatcttctctacaagactctaagtctctgagcctagggctccagtttataaaactgcgtcctgcacaatacttagcctgtggtcctccacattgaaagcatccactatattgatggatgaatagtcctgactcctttctgttcagagaacattaagtttgtccagaagcagacttagtaacaagcagcataaatggtgggagaaagggcagggttctgtttctgactctgtcattcattatgctgggaaactttcgttataacacttgtgttatttgggcctcagttttctcatgtgtacaataatgggtatagaccaggtaacctttaatcttgcactgctgataaaaagttagaactggcacacattcctcagagagaacaaatgattcagaggcagaagaaaagcaaaaaagaaagcaaaaaaaaaaaaagggattctgctgatgaagtaataaggtatgtgattatggtacctagtgtgaggtgactggtggaaagatccgacttgaaatttccttaaagcaagaagtccttaaagaatcctcatgcttgctctcaatcaatcctaaatgatccaactctaagggcagtagtgcatgtggcctcttttattttaagtaaggatgtgagaagtcttgacagatatggagaagcactaattttatataatgaaatctgccatgaacagaggaagcacacatgaaactgtcactagcagctgtagataagaattaaagatgtattcctgcatgggatgagatggcaagatgaagaacagaaccgtgaaaatcagcattgggccctaacaattacatgtggataatcatatctatgcactgtttgggagagcaatatgacacagtgtaacttgagccaatgggcattgagaccagacttgccaagggacctgggaggattttataagaggacagactgttagagtcgggaagggccacaaatccatgacaaagttccagcatgacacctgtaggtgactctggctccatgaatgaacttttctcaacaattagttattctgagccaggtgtggtggctcatgcctgtaatcccagcactttgggaggccgaggcagacggattgcttgagctcaggattcgagaccagcctgggcaacatgatcaaatctcacctctaaaatacaaacaaacaaaaaaccccccaaaaaactagctggctgtggtggcacaagtctatgttcccagctactcaggaggctgggtgggaggattgcttgagcccaggaggcagaggtggcagtgagctgagattgcactgctgtactccagcctgggcaacagagccagaccctgtttaaacaaaaaagaaaaataaaaagaaaatttattttgtgatttactgatcaaaatcatcactaggtccttcagaatactttctttttttttcctgagatgcagtcttgctctgtcactaggctagagtgcagtggtgcaatctcggctcactgcaacctccgcctcctgggttcaagcgattctcctacctcagcctcccaagtagctgggactagaggcacgtgccaccatgcccagctaatttttctatttttagtagagacagggtttcaccatttggccaggatggtctcgatctcttgacctcatgatctggccgccttggtctcccaaagtgcggggattacaggcgtgagccactgcgccttgccccctcagaatactttcttactttgactggctgtgtggaaggaagggttcttttgcctattagaaaataagtagatgtcttgctttattatatatttggaaagcaaatgtctctgaaatggatataggattcagctcagctgaattataacaatagacaatgttacccaaatacaaatcttcccatgattaaaatgaggcaaagtataagaaggcctcagtgtcataactgaactgttctgttttctgaaaactctgcgctctgtttgtgcctctatggttttgcttctttctattccttctgcctggaatgccattacttctgccttctactttacaaatgcccactcctttatgatccagtttaatttcatttttggtgtggagctctttccacttcaagaggctctttcctcgggggctctgtagcattttgtgcatactggaacactttaattctgcatttatatttaccccgttatgttccaaagtgtggggatggggtcttattcctatcttcgtccctaatcttagctgaggacttggtgcagaatgagggatctgataacatttgatcaatgactgaattaatgactaaatgaatgaatgaataagaacgactaccagaaattactgcattaagtgactatggaagaaacccagttaaattggtgttgtagggaaataataagttttataaaaagagggccaatttaaaaaatagaggtagattaagatacaaagtttcaagacctgtgcttttttaaaataagtgtgtccccaaatgcacaaagtggaaactctaggaaattagagcaaataaaaaaaacgaactggccttccaatgtataagtgctggactaagcactaaaatctctaaataaagggtataaaaggtaacgaaaaaattccaaagagattatatatcaattaactaagaggcagaaaggtgactttttaaaacgggaaagactatctttaatgacaggaaatccacatttaacagatgaggggcttacttggcaatgaaatgacagaaaaacagtttaaatgaaaagataaatatataattccttacagaacatagaataaagcagaatgcagaacactgggggcaacgagagcacttagttgtaccaaagacactctattactgcttaactgatacggaatttattagaaaattaataacaagccattggatagtaactgtctgtggttgttattccattccattttggctatattttctctgcaaattagtgtgaccctaaaatgttttcaggattgtccaacttgtcctaaattccataaataaactctttcagaggatgctgttttttgccatgtctctattacggttcttcacagatggaccatttttgtccttccaaagtctaagaataactctttcagttatcaagacataccaaaatccagttcagctgctcctgtgggattccagttagtttagacacatctgctgagatacatgcatttgaatccaaatgaagcttttgtttgattatacattttgaacatttatggaggttttctggggccaaaatgtttttcattttttggcacaccaaacagagatcttcagttataaacactgccttctgagcacctccaacagaaatccaatcttttcatgtgaacaggtgcctcaggaagtttttggaaggttttacactgaatcagctttccgattggaaactttctgaacatgcagtcaaatttgccaaagagaccttcaaacttgcttgagcagttttcactcatacagacatacattcacacatacagacagcccaagtaaaagcaaatcagagccctgtaaaactgaagtatttttcttaaaggttaaatatcatatgcaaccaaactgaacaaaaagaaatacacaacaggagacagaatgaacggatagcacgaggttcttcattgagcgtgtctgccttaaagccttacctagagtttaagctatacatcctttcagtaaagttttttatttcatctggtttcaaatatatactcaagcattcgcatttttaaacacggcaccatagagtattgctactaacgcctttcaatcacaaacccgttcaaacagttattttgaaacactgccttctctaacacaaatgggtaaaccagatttaaatgtaaaggaagaaaaaaaattactctttaagtcaggggttctttagcaaagccctcatcttacctgattccctataacttttactttccagtttgaatacagcatagactaaaaagttgttatagagtaaaataactttttaagccttaagcctataagtttttacagagtaaaatcactcccccagtgggcatgcctgcaattcaaggggaaatctgctttcaagttgttctaatggccccgaaccagatgctctaagatggccagaaacctttgtctacacccacttagcagatttctggctcgttatcagggactaaaaggtttattcacagaaatgaataatttccttcgaaatatcccttaccctatttacatgcttgcatattccttccattttgttttccccctacagctttactaagggaattaattatctggaagaacaggaacatacagtaagtacatctgagttacaggatgagacacagtatgtcatctattaggcctggctaagaccagcagctgatgctaaatgggaaggaacatgcaccaaatgttttttaatcacaaagttagtaattaattgctctttaaaatacattttatgcttctttctgtctgtgtacatgaaatgcacatttattacatgccaaaaattacaacattatggtttaaatgtgactggcacggaagtccggaaatcagagttaatgttcccacagcaactttaattctgtccgtgtgcacatgtagagctataatagtcttccgttccaggataatacgtatagatggttttgggagggaagctaaagacccatatcctcaactgtagttacaggaaaaaaatcaaaggataaaagctgtgctcctttccacatacgtggataaaaacaatgtccccacacccagtgttgtgtaatcagggaatgaaagaatctgctgtgatgccagcactcaaggggacagtttctgttgctgtgggaacctgaactttgcatttcctgactttggggtaattaaaatgtcagccttaatgtggcattaatggagtttgccataaaaatcttctgttttgttctctaaaaaattgcttaaaagttcaaaatgagccaagtgtactaaaaattttaatcacacagacttgggcgggtgaagcaaatggttgggagggggaggccaaggaaggtggatggcaagagttggaaaaggaagagcccattggcctctgtgagtgtccagccccagcagaatgatgctacctacggagctaaagttaaacccacccacacaacagtttggaaatgtgtaaaggttcaatgaaaaataaataaaaactgttcatgcgtaagtgcatcttggcaaagacacaaaaaatgagacagtctgatgaggccggtataaaacatgggaaggtaagtcaccatggatatcagcttccaacaaaagaaagacatcagaataggtggatctacagcagaagtagggaggacggccacagggaggaaaatcacttctttcaatgggagccttatttgggggaaaacaaaatggaagaaatatgcaagtaaaagttctggtcgcgtctatcacatgtatatgactgtgatgtgctacagcttgatagctgtcaagaaaggtttttcatatggagagcttcgtctgctttactgacttggtttagtcctgcttaagcatttaaagggagcacttggctcagctcatactcagcttgcttagtgagtaactgctctatcaaacacctagggtgttttttacccttcagattccataactcatcttaatgccttccattatcaccatgtgaatttgcttaccattagatttttagcaatggtgaagaggtggtaagctagggggtaatgggggaatattgctaaaaggaaattgtgttagtaggcgcactgcaaagcaacatacattttagcagcaatattaacctcatcatctcacaaaagaaagcatatctcaactatatttcttcttgttttgaataccactgggatcttttgccgaatttgaagaggctcaggaggttaaacagccaactgagaatttagggggtcagacttgtcatctttgctgtaaaacacagcctgtgtccttcatatgcaaaaaagatggtggcttacccacccatgtcagttcatatgcagagctgacttttcttttgtggcgatgctttatccatcatgttttacaacccagtcaccaatatgagtagttgcacattttcaagatgcctgttcagagccaggaatgccgtctttgggctcagaacagagaattccaataagaaatgctctcacaatgagagcaaatccataaacacccctcggtacccaaatgagttaaccacaagcgagtcttccatctacctgggtgtcaattttctcagttttctcatctgtaaattgggaaggatcatactgacaggatatgggcattaaatcatgactaagaataattttgctaaacacatgacaaataaaaaggtgctataaaaattcaagcacttgtgaaagcttggaacaacacacactggtggaatgtttctgaagttaaagagactaacaagtcaagggcactatttttaaatgccccaaatctgttagttctaaataggaactgaatattttaccttaaagaaattaggcttttaaattaatctatggtaagaatgacatttgaaagtaaaaaaaaaaaaatcctcttgaatgcaagaagagcatccaaaaattttaacagcttaaaataaacctttttcctgtcttctctcaagcaatctccaaatggacagatttctgtgaatctttcctaaaaacaattttcttctaagtgtaggctcaaatcaggacaaactacaatccaaatatatttggagaaaagtataatcaatttaaacaacaggttggaacagagaagacttacacatcttaatggcaaaatcaaagtgactgtctaaaaacagctggagatcaggtttctcctcctggtttgtttttccaactgagctcacatccactggcttccccagggccaccaaggagatgtatggtgacaccatactcacgctgttcctgaaacttacttcatgccaatgctaaggcctggccagaggatgcttatgataaagcacaataagtgaagcccaatgctttttctattcacaaaacattcatttttgctgtaacagaagatttctagcctaaggcaattctatgtaatccatacccataaggtgtggcagaaagctgggtaatgaagacctgcatgtagaaactccaggcccttcaccacaggaacgggctattttcctggtgggaagggacagtgtgcacatgcctatgggcactgtgccactctactttccaattctttctgtcattactattacactgaagattgccaggcaagaaggtccaaggatgtgactattaggacggtcctcagaacacagtccctgcttctgccccctggtttctctatagaagcctcaacttcgactgttcaaatcacataggccacagagatttgtctcacgttacttcccttttcattttctagtgacggctagaatatggtcttagcccaaccttaaatagaacaagctctcttcaccccaatcctgccgccagctcatttccctctctttagagactatcatgatgaagcaagtagagaatggaatctcctggaccattgtctcttgccttctttgcagaattttacatttgttctgtcagaaaaataacaataaaagatttagaatctcatttcctaataatttttgtctttgtggacaaaattttatttttgaaataaaactttgcaggtcttatgttactcattttaaagaagaatatgccagttatttgcatgttaccagacatcctttatggagatcagttcagaagagttgttgggtatgttaagactaaaaggaatattcttttggattcgactccaaagttatttcattcctttccattgtcaacacacatgtttctttttctctgaagtattgggttacatttcagaaaaagaaaaaaatctcctaaacgtgatttatcaacttgcttaaaatagaattagaagaagtgactcccagattagtgggaagatggcaaaaataaacagcaaagaagtgatttcaatagcgacgatctcattaagctgcccatttccaaatttagcccttaggcagtttttttaattaaaaaatatttttaacctggattctcattggctgtgtgaagtctgggtggcttctgaattcttggaagccattctcttttcttctgtaaatttatgctatcctttaaccacttcaaaataaattaaaaactggaaagacagaaattcagccaagctacatgagactccaataactaatgcaaatctgacttgtgttatgtaatttcaaaatggatgtttccttgtgtctaactggccttctgaggtccacatttggttgttcaatttagtaattgtggaagtgccattatccagatcaagaataaatggataccagcaacaaaacttcattttctgggttagtgttatgaaaagaacgtgttttatgtaattaatcagccctttaaggccaaatggcatgtcacctggcttttaaatacactctagctttgcaaacttatagatattggctgaatgaaaatggtggcacattacttttggctgctttagaagaccaaatgcaaagagctcgctctgaaagtagaaaagccagaacccagggtagaagcactactccaagcactgcaaagacaccatcaccttagtggtgtactcacaatcagatgacccggtgtgagcgtgagagtttgtcagtgaatgtgttgagtggatgagggctgggtctggagacaaaacagcttcaaagttcaggcagggaaggcccggcttggcgctggatccacccggctgagtaatctcattctcctcagatgccttctggttttcagctgtcttgggtttcttcctgaaaataaacaaagggccctttgaaggaactgactgcatatttgggaaaaggcatttttagaatctgttaaagataacttgattttttttttctgaagggggatgggagggagtccagtatgtcccttgttttaaaacaagctgattcttgttttttttccctccagtaatggcctaactgggaacacatgaaagcatatgggccaagcaaacagcaccacatttggactctgttggctgcataaaaagaccctgtcccagaactttagacagcttgagctacgtatggctgacattatccaagaaagcatccctcttccccccttaggagttttaacatggtctggaaaaatactagtggaagttttaccgttctagcatttgtcaggaagcttagagacaggactcgtggagtaatgggaggagcactggactgggagtcaggagacttgagctaccgtactagctgtgcctctaacttgctgtgtggccttgggcacctcacttcacctctctgggcttcagtttcctcatctgtaaaataaagggcttggattagaaggccttaaaggttccttccaactttaaatttctactcatggactacattaaggaacattcaactttcctgctcttattaagattttattttaaataaaatttcaaatcacaatttaaatttgcagcctgtacggatgagggggtagtgatgggaggtttctgttagagtagcaagtgaaaagtgaaaagaagagcttagattctagtagctaaagagggaaggtgtcatgcagagatttttctactccaactctttactcatcctacgcctaagatttttgatttggtgcatcgtcctggagtttagggtgtgattgtgtgtttgggacatgaggaagagaagggtgaagggaattagaaagtaattgttactaattgttatatggggtcaggaataggaagtaaaacagcacagctatcagtcagctcaggtctcctctccccaggacaatgcaactgatatgaaattaacaaatacttagcttatactacacagaccctagaccacagccaaactggtttattagtaatagttcctgaacatttctccaattcccttggatttgtgtctttttctatcattatgtggacatgaccagaaaaagcatttattttatttgtagaagactatgtgtggtacagaatttgttgtaagtagatttgtttccatgtttcccttgtttctgtgagcatggtaatgtacttgttatgcagaatattttgtatttaaatttgttgtgctgggtagttaaatctgccctcgcagaatatggtgttatgattagtatgctgtgttttcagtccaacaggttgtgaaataaaatctgtttcttcagagggcaggaggcagagatggcatggcaaagattagaatagaggtgaggctttcagacatctttttcagtatggaggaagccaatacaagagaagcaacaaattataagaccttatcaattgatttttgaatggtgactatgggagtaacccccaaatcttgagtgtctacatggaccctgaaggagctggtattctgattttcagtttaaagatgtagccaagatcaaagttgctaaagcccaactcctttattaaaaccaatgctttctctaaggtccatatctctatcactgttgtctaccaccaggttggaaacctcagggtcactatacaccttcctctgccttaaagccaattcatcagtaagttcttacagttctgcttccttcatattttttctcacatctgtgtttccattccaatttcactgcaatcacctactgctttttatctagctgattgtttactaactggctctccaacctctttcactcctctagtcctgtttctttgcattcactaaatctaagatgactacattagcctgacactcaaggtcagttccgtatctcttctaacttttctcatgtgtcctgtatattggccatactgtaccctcagatttcttgaatatcctccagaacatcctgggaatctacattctgggctctacatctttgctcaagttttctcttactttgaatatcccatatttcatctctgccctgttgaaatcatacttattatccttcatacttattaaatggtgtcttcatcttataactgtcttgattcctctctgccaggtaggacttcactccccacagtgaattcctccctaggtctttctccgaaatgcctaagctcttttttttcttaatcttatttcactcactcaattttatttcaataatggctatttatgtgcatatccctcttgtgagactgtaagctctctgaaggtaaggaaatgtcttagttattttagtattcctagtgttcacctattcttttcttcttccttctctcctgtcattcattcatttacatattcattttacaaatatttatgatgtacccatgatgtgccaacatgggctaaagaataaaacaggactggttccttccctcccagagtttactgccttgtctatactattaagcaatgtagcttagacaaagctgtcattcaataattgattgtggacagaatgaaatgaagctgaaattaaagtgtattttaagaacggtcatagtctgaatcccaattaagtttcctactttttatgcagcaaggtagcaaaactacctgactggctgcttttgctttaagtctgtgaggggtatttaataagagcaggactattttgctcagtaaggctaggctggccctcatgattcatttaaatatagggtcaaaacagtaatgacatatgtcacctagcagaaaaaagtgtttatttttgatattcatagacagggcctaggatactttcagatgtgtgcttcagaaaattaagaaagctttctttcaaacataaggacatagcaaaaccaccaatatattactcttttatttttaacactgcaaaaattatattgttcttcatatcaatgcccttgtttccttccctagattcgctcttgtttcctacctgacatcttgtatcacaccctcctgttgcctcagtgatcactttgggagaatattgatagcacagaggcattggagctacctctataaacaggaaatgttagcaactcaacctttttggctcacccccttatttgtcttatatcactttacttacccttataccactgggctgtttcccaactgtccagataatagagaactgctcaccatcctcagaagcaattcatgtcctgtctcaccctctctaatggttcttcggactcctttttccggagctgagaaaccctaaaacatagcacccgtttacgtctagacatgcacaggtgctgtgaattgaccccatttttgcagttcatagtttattaaggaggaaagaataagccctgtcataattagttgaaaatacattttgaggctgtataaaaagaattataaacatggcacatctgagggcaagtcttttcaagcctctgtggcgatgcactattccctggagcctttagagggcagcagcacactggctgactccagcggatttcagagaggcgaactcccgaccagaaccttcctcctggtcaccatgccaaaggttgatttgccaggctctggcctctcagtctctttcttttcagttctcattctctctctctctctctctctctctctcattctctctctctctctctcattttctctctctctctctctccaaccccttcctcctctctctctgttaaaattatacactctgatgaagtcgcccctcaaccggaaaatgaaagctccaatgaaaaagttagacaagccaacaacaacaaagaaagaaaccagggaaaaaggaaaagggggctggtgacagggaaggacttaagaataagaaaagggcagatgtttcgcaaatatatgcaaagcaaaactgggtgtaccctgaacacttccacagagaaacagaccaatcattgtgcacttcctcccgccacactggtggagctctgcattcaaaaaaagaaaaaaaaaaaaggcaaaaaagcgtggccgcaggcacccgcctttcaacggtcagttctgacattctgactgaacatctctcaattgtccaaggagaacaaaaacattttcatctcctcactgcaaacatttctgttatgagaaaaggctgcttcaagaattgggagtgtgttttaaggagactggcggccgagttagccagcagagccttctggtttttaactctcattgtgctggccccagcaagaagttttaggctgaaacatagcagtgagtaaggctgtggaggatgttggctctttcctaactagaccatattgtatgtggaaagaaatatgcattaaaacatattgatgatatggtaggtattaagcatgttaaatgcatggaaattaaccagatcggcggcatttgatgtatatatttcacactcttttgcacatattgcacacatacagtgatggcaatgctttctgcaacatatggaaaaataaatattttatctgtgtgagctcttagcagtctccagggtgttgagagtgctctcttctttcaccctatcccaattttctctcttcactgggctcccaccctctcttgcacgttaatgtgccttttacttatcagcttggtcttttcctatctggtaagtaatgtgcctgttacttatcagataggaaaaaattagttggaacctcctattggctcatgataatttagaccagtgatgcctcccccaatcttactggagtcgtaacaatttccctactcttttccccaacaatacattaaataggcttagtatctgggcaggagagaaagggtaggtggtaacaaaccaccccaataagggtggtagcggaactgcgctccactacctattagctgtatgtcctgggtagattactccgcatctctgagcctcattttcctcatctgtaaaatgggaataataatacctaccgcttagggttattgtgaggaacaaatgagataagccatgtaaagtgatttgccttgtgctggcacatggtaagagctcaataatggtagttcctctcatagggattgttagttctgtgatattcatcatgttagctttaagaagacatttccgggcaaggggtggtagctcatgcctgtaatcccagtactttgggaagtcgaggcgggcggatcacgaggtcaagtgatcgagacaatcctggccaacatggtgaaatcctgtctctaccaaaaattcaaaaattagctgggcatggtggtgcatgcctgtagtcccagctactcaggaggctgaggcaggagaattgcttgaacccgggagtgcagaggttgcagtgagccgagatggcgccactgcactgcagcctggagcaagaaaaaaacaaaagaaaaagaagacatttcccttcatttcagtaatctgtttagatatctagattttgggtaggggcaaatggattgttattgtagcaaaggcagaaacaatgttaggaccagcaatctcttcctcaacatttgatcttgctgtatacttcctgacatctcctttctgctcacatgtttgtcattgctgtggctacactacaccatgagctccttgaagctgagggttgagcaagctgcacttagcctatagaagcccatcaagcctggacactatggtctattcattgagaccaacctatgggactctggcttatcgtgttttcttgcaatttatcatttctctacctggtctgatgtcctcacatcaatttaagatattttagtgattaaacacattttattttctcaatcttattttttttaaccttggcagggctgatttataatttttttttcagtataatttcctcttaactgtatcagtcaggatcctggcaaaaatagatggcacatgcaaagtttttagctaaagaggatttaatgaaaaaactgtatttggagctgcagatgaggttaagggacctcaagagagatagcaccaggtactagcaatagtagagactgccaggtactagcagtagtggaaagctttaaaccatttaaactgaaggggcaagtaaaatggtgatgaattctgagtccagtcagaattggagttgggaaggagggctgaactaacacatttcctgacctctctcttcccccactttcacatctcctgctgatgtctccttttggccaaattcaaagggaagcccaaggacaagagagcctgggtaatgtagtccagaaggccagtcttctgggtcacacatcagggcaaaagaatggttctggggtttttttgggggtagaatggggtggcaagactaatcaacatatgtgttcttctctcttatactttcaattatactttctggaaggaaagacagaacaaaataaaataggttctgtcttagcttccatgtacctattatgtcgaattgccattcacagagcaagaaaagagaatgctgctcagccgagcagggatttttgtttgttttgcttgctgccatattcctagttcctagaacagtgtctggcacatagtaaatggtcagcaaattttaaatgactgagtaaatatactcacctctgccgtgacagactttatatatatatcatctcattgacttatcacaataatctggttaagtaggcagggccactgagcattattgtgcaggtggtatggggggggtgggtaggtattaaaatttaatatgtgcctccccaacccacttccaagccttgtgactaggcccgaagcattgtcaacccaccagaagagatatacttctgtaaatgattcacattttaattttttatcctctttattgatttttgcacctagcaagtttctgttttattattattatttctcttttatgcattggaaagccaagtttctgaatagcaaagactgcaaagattataacccagtctgtccattctctagggcccatgagaagtaaaagcaggcactggcattctgcacagatgaaatacttcctacgacaggaatacatgctcacttgtggacttctctgtaatctgtaggcaacatcagctcctgatttctaggtctggatctgggttctctgtagcacaggaaggtaagagtgataagaactcttttccctcttaaaggatatagaaacttttaaacccatctgcatcatagtaaggctgtgttatctgtatcagcatagttactctgtgatgaagaaaaactcagaaaactatccagatgtgggaatttctcgggtattccttgcacttgaacttaaggatgaatgaaggtatatacaagtaagttccttgtgtgggtgtggactgaagaaactatgtttgatcttctgtcatgtctttagtccccagtaactcagtcctattagtactatagaacacattcccctccgggaaaggcaggcctgtctatcacctacacagcagcccccatcaactatgattcagttgactggaagcattaaaggtaaaaaagcaacacaaaataaagcaaaactctggcttcatccctttaggtttgatttataccagaatagctaaagacatagaaatatgaatgtaaatatcctacctgaagcctaagagggatgttagtctcccaggtttagcgttttccagtaacatagaagtctgtaaaacaccatcccattacctgcctcataacatataggaaaacttgtgaatataacaactagttattgttttaaaatgtgtaattaagttactttgcatgcagaacttctaaataattcaaatgactggcttttctattggaaaatagcatatattcatctgttatttcagcaatgattaatgaatacttgatatcaaactttcatcagtattttcccataggtatcatatcccctaccccaaattatttctgtacttttccttgcaaggtctctacttctcctacataaatgccttgcatggcgggaactaaatcaactacacagacccatacatccagagagcagaggtgagctggatacaagtggcttagagatgtggtggaaggaggccagagctccaagggaagggcagcaaggagacaacagcatgggttgcagctcagacaacaggtaaataaaaccaagcaaagctgctggtcacagatttgaccagggtggcaagaaatgacaagctaccatgagattcaacagtggcacggaaggatgatgagaagcaaacagattaggagaagctgccaccaccgtacatagaggcacagatgaccaagcagaacagcaccagtccctgcaaggtgtgctcagatacagctcagcacagccatctggccaggagggaatgataatgcacatggtgtgcactgcagccgggaagttgagaaccgctgtgggcacctcaggactgagtctggttaccctgctgatccaagaaatgaagccatctaaaattttgcctgctttcacaattttctgtgtgtgtgtgtgtgtattaaacaaagtgaactaagaagccttttattggagacataatgtactcacagtagtttcaaaatcaatggtgtcactcttcaggtaaattactccaaggcttgggcctagtgcagatgttcattggggcagggagcagagagcggctgcatctagatcagacaaaaaacaaaaataaggttgttaaatgaacaggtgatggtgatggcaattatttattttgataggaaagaactttgggacttgagtgagaggttggttgtttggttctacatctttgcaccagagaatggcgaggtacggaagggagaatggagaggatgttgtccaggctccattttcagtgctttcacctaactgcctgtgcagcctgggacatcaacagtaccctgtcagtgcgggcggagctgattttgtggttctgacttagaagctgagttgtgggtgacagtgggggaaggaagtagaaacagtgtccttcaaccttcccacagttgattcttctagtatccttttcttttttttttcatttattatatttatttattttttattcacacataaaaattgtatatatttatggtataaaacatgttttgatacatgtatacattgtggaatggctaaatcaaactaattaaaatatgcattaccggctgggtgtgctggctcacacctgtaatcccagcactttgggaggccgaggtgtgaggatcacgaggtcaggagatcgagaccatcccagccaacacagtgaaaccccgtctctactaaaatgcaaaaaaattagccaggcgtgatggcgcacgcctgtagtcccagctactcaggaggctgaggcaggggaatcgcttgaacccgggaggcggaggttgcagtgagccgagattgcaccactgcactccagcctggcaacagagcaagagtccatctcaaaaaaaaaaaaaaaaaaaaaagaattacctcatgtatttatcactttttcatggtgagaacacgtaaaacctactctcagtaattttcaatatatactacattcttattaacgatagtcatgaggatgtacagtacatctctggagttattcctcctgtctaaccgaaattttgtgtcctttgactgatgtctcctcagcgtctggcagccaccattctaatttttgcttctataaattaagcttttatagattccccatataagtgaggtcacgtggtatttgtttttctgtgcctggcttttctagtacaaaaaaaagcctattttttccccatatatcatggatgacctctagattcatccatgttcttgcaaatgacaagatttccttctttttgaaggctgaatagtgttccattgtgtacttttaccacatttctgatattcttgatttcatttcagtctctctctttattgcttagttcttaatgtattctagtgacacccattgatctgggcatgttctgagcattccctctgtccttcactgcaaaggctccattttcttccataggctctaaccctgaggacaccgaattaccctattttttcccctatacctcagtctgctattctgccttcttcactggcttattttctttcttctgttctctaaatgtagacattcctctagatcctctcctcaggctttgtctaccccagtcctccctgacctcaacaatcacttctccatggagagcatccacattgctatctttagttctagcttttctacagagctgcacacccacattctaaataacagctggttattggttcattcgttcctttgtccattcattcagtgtttatatagcatctatgaggcacctggatgaatacaacagggtctctaactttgagaagttcacatcgccatcaaatactacacaggcttttctaattcagaaagtttagaacttaattcattgtctttcctttaaaatctgttccttctctagacgtcccatttcctgccattggtattctcttcatccagttacgtgggcctacagctggggagtcatcttcaattcttccgttttttttttcttcctatatccaattagctacccaatcctgtagattctactctgattgtgattcctgaatcaatacctgttttctataccagcccctatttctccctttgctacctactgtgaggacatctatgaaaagctcctgactggtttcacttttccagtttttctttacctcttgtccatccttcacacaaacattacattaatttttctaaagtgcccttctaaacatatcacttctttgcttacagtcctccttgcttattggattaaattcaaacttctcagtttggtattcaaagctgctacaatgtagcccaatctagtttctcactcttatctctacactccattctacgctccagcaaagtcctactctttcctaccatgttcatggtatttcttcctttctttcaatgtctacatgtagcttcttcaagggccatccaaatgccacctcatttatgaagcatttcacaaaggagagtgcccttcttaaatattattagcacattctgtactactccctttgcatattctaccaattagaatggttatttgtgtaatttgtcttccttcttcataagccctttgaaagctgagacaatttttactctgagtaccctatagtgggccatgacttcttgcacgttaagtttgcactaggctgataatctgctgaactgaatttaaaaagaataaaccctcttgccttgagtcatagaaacggggactaaattgaaaagacctaaaagctcatctgcttcaaccccctcatttttcagacgaagagatgaagggaactgacttgctcaaggtcgcatccttgttagtggctgggcaaggataacagacataaaaggccacagactaatatttatcagtgcttacttggcaccaataggcccaacagatcatcagtaatgacaagaccagagagagggaggttggggtgtgtaacctgcaaaaatatattgtgttccaaaatataacaaatttgcttcatttatttgcttcaacaaaccgaactaataaatatgttttatagttaaatgttgtctaaaaaatgagggtggatttaaaaaacaaggaagcaaagttttctaacattaccagcagaaataattatgacaatactgtcaacaccactggggaggaggtgcggatggttaatgggtacaaaaaatagaaagaatgaatacgacctactatttgatagcacaacagagtgactatagtcaataataacttaatcgtacattttaaaataactaaaagagggtaattggattgtttgtaacacaaaagataaatgcttaagaggatatatgccccgttctccatgatgggattatttcacacggcatgcctatatcaaaacatctcatgtaccccagaaatatatacacctactatgtacccacaaaaattaaaaacaaataaaatgttaaaaataccactggggtgataaactcaggctgaaaataagaataaagaaatttctcatgctttggaaaagctgtgtgttcagctggagttcttggtgaaaacatgcagtaattccgtggttaaattcattactttgtagaaacaaactattggcaatctgctattatgccacattaacacttctttttccacctagcttagcctagtactcattctctaggtttgtttaaatgtttacttgtttttctttccttatattactaatttacttgtagaaatgcatagacaattgcctctgagtctgttcaaattttcttgccttgttcttctcttgtagtagaggaaacattagttgtttctcttctctatccttatcctcaaacagaatcattttctctcacccaaagatgaaaagcccaacaaaacatgctgtggggataatagtgtttacctaggtgaggaaaacagacttttccagggaatctcagtaattattacttggccagaaaagctcagctcttaaatgttagctccaatactacaagacctcatctgcatctcccaggtgagcgcttgactcactgttactcaccagaggaaaaccttggtaggtagcattaatcaaactctttttggccagtatggtggagccatgctacgcattgagacatccattaaatagcatcaccccagcagccacacaaacagcaaaatgggctcaagagctcttcattgttctttctaacccatcataaggctggacagattattgacacttcaccagatagaacttacttctccttttgccccctggcaactacattaaaatcataaaggaaatcactcatcaatagtacattgcagtgaaaaattatctggcaaatttacaaatcctttgtgtaattatataaatgtacattttaaatatatctaaaatctgatttacattgtgcattttataattaatacaaccatagtatgtctgtcctttaattaaatccttctttctcagtcccacatcctgctgctataatcttactttcatttttggcaaagtgtcacctagctccatcttctttccccttttgccttagtacacacctgagcgtctattaatcagaaccactgcatggtgtgtcatgttttattgcttaaagggtggttacactctaaaaaagattcggtgagaatgacttcatggggtttcacatttattctcttttaatgactttcatatccagtgtactcggtttttaagtcaaaagataattttgaggggctgctgatgccacaaattctccctagaacctgaaaatccagctgttgtctctgcttcttacatcatcactgtaataaagaatctgctcttggaacccagctggcaagtttcttgatggtgtcagaggcgaacagacagtaggtcacttctctacagcccgtttcattgttggcgtttctgcagatctgtcttggaagcccttagagagcagagctgttatgaaatacactgccacatatcaatgtaaggaactttctgcagatgtctactttgagtatggcctgtcccagtcctaggaaatcacaccacatcgttctaaaattatagatggggggttcatgattaaagtttacaagaaaggtaatagtaacaataacagctagcatttattggatgtctaaattttatcagggactgcaccaggcatttttataaatgagtatgttcttgtttaaccctcatagcaatgctatggtgtatgttttagtatacccattttacagataaggaaaagtgagacttaatgggcttacgtaacaggtcgaagtttagaaagctactggatagtgaggccagaatccaaacccagatctctctgagtctaaatctgtactcttttcactatataacaactgttccaatgcagcatggacacgggacacatttctagttcccgctgtgatcacagtacaaggaagatgcttatttccacgatggttcagagccactggaaagatctgggagcacagactccaggagaaggaactatttcagaaactgccaataagtatagtcccttccctcctcctttctaattgcagatgagaatgtcctctaacagtcttctcaaactctaatgaacaaacgaatcacccagggcttctgattcagcatgtctggggtggagcttgtgatcctgcatttctgagaagctcccaggtgatgctgatgctactggtctgggaccacaggtcttatttctgacactctcctttctactagggttgtttttgaaggagcagttcaagccaaataacttggctaacagttcacacagccagccgactggcttctgattctaggccagtttgtcaggtcatcaggcattacacagaattcaaggagttcttagcatagagcacactgtcaaaaaattgtttttagatccccaagggttttcccctctctctggaaattcaaaatgataatgtctctaacatgtaaagttcctatttttttacattattgttatttttaacaataattatctggtaataattcaaataacaccttccctctgagaaattcaatgagctttactaaccttaattgtctaacagcaattcccaggtgaagataaagctgtctcaaagatcatagtaaatttaaaattgttccacttccctcgtttctttgccccaaatgtagtggtgagttagtggggacgggttactaattggcaaaggcccactatcataatttgaggcacagcaaatttcataaaaaggatacatctaagaaatatttagcagagaggtcattgtggggaatacaatgttagaaaaaaaagagttagaaagtgtaagataagaaaagagaaagcaaaatcaggactagctgatgacctccgatgagacatttaacctctaggtggctcagcttttctatctgcaaaaagaggaggttggttttatgatttttaaggtcccttaaaactctaatagtcccctgagaaggaagatgtgggaattaagtagctcatcaacctgttaaaccattaaacatgttaaggaagtctatttgacttttaactttttagctaattacccgaaacaaattcccaagtctacgtcaccagccccacctctctggaaagtggtgagaaaaccatttaatgaataaggcaccaaagacatcacggccagataaactaatcaggaacaccatcgtcagcttactgatgctgtgataactattttactttttaggttttagttccttaattaaccactagttaatacccatgtccataagaaacacctctgatggcttgaagacccctgggatggccctgccaacacaaggtggaatcacaatcccactgtttgtcacattaaatctatgttaattttctccatagagacctcttgattcctctttgacagttcataaactctgttaatataagttgcacatcccatgccatgagcgttagcattatcagatacagttgattcttgtttaaaataagagatcttttggatcagagtacatgtaaacacacacacccacacacccacacacacaatcatgaatttctggtattaatgaatctggcctggtgatgggaacccctctattatgtcaccggatactggaaccttcttatccagaaagcctgccacaggtcatgttaataagatcgttttaaactttgtaatgagaattctaacatgagcatgatttatgacacagcattttatttggtattatcagagtttcctataccttacctcttacagtgagtatgtgttctgaattaaccattatagtttgtggtaaatggaaaaaaaggtacagagaaacatcacagtggcattactccagataacacactctgtcactgttcccaaagtgaacatcatttccctcttcctgctcccatcacttcaatagtaactttggctattactgactaaatgcttaccgtgtggcaggcattgagccttttcacagataactttattttcttacaattactctttgaagttgggaattatattcccattttatagacgaaggaggtgaaactgatactcaggaaaggtacagttattggtcatcagtcatgaaggcagagggtagcaaagcagagttaagggccaggttctaaccacatgttctagagcttaacctataccaggctcacaatcaccaaaccactgatctgccttcattccactcctcttcatttgtgatccccaccattggcttaggctagattcttcttcatggctctctcatgtcttcttgaatatttcttgaaatttctcaaaaccttctacacttgatttatgttttccctccctgtattaataatttaatccaaaaactcattaacacttcttttcaacagactttatcaccccttttcttagctctcatactccttctaaattactcttttgaggcctcacatttgacatcagatgttccacacccagctattgaactcactttcccagaagcccaaggaacctattgttttcagctggttcattagtaggccccagttggccttaccagatgtatttgtccagtttgatcttgccccatgatcaaccatttcaacactgtcctcagtaaccatgcagatttccttccttttctaactttctatgtgcagtgcctccttttacattcatcaactgtgaatctgtatcaccattctccatttgctcccactctcagaacaaaaggctacacatgcatgctacctggacctatgctcctgcccactgtttccaggtacaacctatggcagtttttcttagtttgttctcctttatgaagtcccattctctttttcagttgatgagctagcatcctagtttaataaaaggatctacaccatgcagtgtggtaagcttattagctctcatctcctctaatatctctgaattttcattattttatttcctcaggatatatcttttcccatgttcccttcgtatcttgaaggttattctctctacttctctttatcttcctttggtttcatcagggatactttctctgtagctgatagcatatcaatttctaatagtactagattaatcatcaccacataccttttttttttttgtcccgcattcaactcctgcccttcaaaaatcttttcagatggtgtatcttaaagtgtgtttcatactggaacttcaagatgcatctcaaaaaaagttcctcagtcaagtaagtttaggaaacactgaaaactatatattctattttcaaactcgcaagtgtacacaggatattaaggtgctggaagcctaatctttgtccaggcttaccggattacagactcccccatccccctttttaatggaacacttatttaacctcagaatatgcttcgggaaaagatgctttaagggattcccctggttccaaactcttaagcctgggctcggaaattcactgactccctatcaaatgagtcctctcagatttcctttccattaatactccacatggtctaaactggttaacttatagggtgtcagaaagactaagcacatttctatctctgagctactgtatataccagtttggctgcttggaatacctttatcacctttcaaaaaattatataggacttttttctccttcagggtccatatataaaaatgtatcctttatgaaattttcccttgtgaagactgctttagcccataatgttttctgccactttttaagtacttcaataaatggttatggtttactgcctgtttgctatattattagcgagggtgtacatcctcttgggtaggaaccttgttttatacactacagagaccccagctttttgagcacagtaggatgttataaccatgtcatcggttaatataaacagaaatggatggcattaagacatgatggtttaaaacccaatttctgtagctattggaatagtttaagatgctaacagcccaggtgaaatgttccatcacaatattgggaagaaacactacccgccatcactgccattgccctgaaaatgataccatgtgtgtctaaggatgtggataaaggctagatacagaagagcaaaggcagctccgttcttaggtgaaagtaagaatttgcattagttaacaccaaatggcgataagattaaaataatctaggaacatcaagtgatccatgaaaggaatcactggaatataccaatggtaaaattaccattcataatcattaaatcatggtaacttgatgaaaagaaaaaggatattttcctacttaaggaagtcagggtaagtattgtctgaggttccactgtgtgctattgtgcctggtatacagaatgtgtagcaactatttacagaatctgctactgccttctagtcacattccaaattctatctctttgaatcagtctggagacacaatacattggtgaattcaaggcagcttggcaacgactggcacaacataaaaccccaaataatgaattccatctttcccataaagctcttttattgacacaacatacaacagcgcagggcaggttgtctcgggctagtgtgtaataactagatgttaaggggccctgagtttttcagattagatgttatctgaagttgggactcagcaggttccctaacagtgaatttttagtgggcctacgactagaagtttggtctcttgatgcttagtcagggagttttattatgtgagagagaaaagtatagctttctttcttaaaactgcagcaatttcatattttagcagaagagaaagtgcattttattagagtataacctgtggagtattttgctaccttcctggatataaagcggtatacaaacaaaaaatttaataaaaagctattttataaataagaatgtttacttgtgtttaccttaaaataggtatagcttgtattatttaacatgtgaaatagaaggataatggtaaaatttcataaatataaaattctgtgtccgtcttcagttaaaattcgtaacagtgtatcagagtgttggttattagtagtaatcaataataagtattttttaaattggaatttttattgcaggagattattgggtgggtgaagctaaatggcctagatgttttcctgtcatgtcaatacttaagaattgtctttctgggcaatttacacatgtgagagtgaaaatgaagggtggcctgcctattgggtgtgtaacaggccaccggggcaagactgctattttctgagagccatgggcagtttctgcaataaagtatctgagtttcttctttttgtagtaaaaataaatagtttacttttatgttctgggtgaagcctgagatctctggatctctttgctggatttcactcttggtgggggcagggagatactattggcaatgctttatatatattgacctagacatgttaaagattatgtggtactttcatgaacactctaaaaatgagttctccctatcatgagttgcatagatgaggagattgaggtggatggggtgaagaggaaggaaagggcagtttaagcgggctagctaatgagtagtagaacttaatctaaaaccaagattttcagcagaaaatgctttttttccccaaaaaatgccatggttgtcaacaagctttgtagcaaatctggggcagagcactagatggagaatcagaagatctgccttgtcttcctggatctggtaagaaccagccgtgtgaccatggccaagtcactaacttttgtgagtcttattgttctcacttataaagtcatgagcaaggaatcaatgaatggcataatacttgtaagctgtaaaatctctctcttgtaaaatggtattgacaataatgtatgctttgcctatcttataaagttgtgaggctaaaataagctgatccatgtggaagtgctttgtatagtgtggagtactgaatcaatgttgtctggaagatttaggaaagggtcccgaatgtgtgtgggaactgacagccagtccacttccattcaggttttaggagaagctataataaagcactggcagcagctcaaatcccactccatcctctcctctcccagcacgctgcagagaatcacttgaggaaagttacttgagtgggtgagccaaatgctcaagttccaacctttctgagtagaagccacagtgaatcctgagccacaacacaggtgacaatcactgttcctccaggtgtgtctgaaacactgggggaccctagggaaggaggtcagacgtcactgctcctgaggacccgttttctcctgtacacagctccagcccacatgatttcacctggcagccccaagagacaaaaaggatccagaattagcaggagcctcctctcctgataacctaagtgctctgattgaaaggcagagggtatcaggagaatggctgtaccgagtcggcattgatttctccagcctttgtctgtgtctggtttctgtctcgtttggaggtggttactgttactacaagcagcatgaatcatgtctctgttaaaaaacagagcttcaattgtcttacataacccctggtaactgaacgtctaataatagcaagccatttccaggtagggaatctgtctacctcccagacacacacacacacacacacacacacacacacacactactcccaatgcttcacagcacagtgagacagacagggaggagacagaaggagaaaggggacagcacaattgaatttttttgtgttttaaaatatattgaataatcatgcatcatgggatctgataaccaatatacttagctgagctagtttaataaactgtagaaaacaagaattcttctttaaagtatttgaaagtatcccaatccataccagacagacaccttctctaacactcttatactgcataaaaaccccaaacccccaaaacagagtggggtgaaaatttcactggattgtctgctagcttgtaccaactagcttcaactttcaaaggattttttttgtcctcttttttgtttgaccagagagtgatattccaaaggttcttggccgagatcatttcataaaattccagagagtgaaaggcaactgaaaacatggctgcagtgttccaccatgcagactatgtaatgtcaggcacttttgcccgagccactttctttgacggagatgactttccatctgaggacttacatttttcccatgagtacactctctggcttgtaatacatgatgaggtctttttatacttgatccccactcagctacccattaaggtggctactgaaataaaaaaaaataataggagaggctgaaaaatgatttttgaaaaatcacaaaggtaggattttctttaaactaccaatttgtttgagaacaaatacaaatgctggataggaagtttaaaagtttatggggaataataatataaatgtataacatatatacgtccatttcctcactgcttcaccttgcccatgctaggaaaaatcacttaaaggctgtattttttgagtgtgcattctcagagtgaagtagctgtacatatcatgtaaattggactggggaaggacttcgcagaaaattacagatggcaatcacatcctgccagtcatttggtctagaaccagagaagaaaaactttcttttctcttttgattgttcagtaacatgaaacagtggactagactagttcaaaccaaagaatgttttagggcacacccactttgaggaccagcacctggctatgctacatgctcttcaattgtttaggcatataaaaaggagtgatgagatggttatatgtcaaaatggctgttctccctccaaacaggatttgattggcttatttgcttttggagtactctccaaatccataaacaaaggagtattgaattgaagaagcaaacaggagaaagaaaaaggctaaaaaggaaaagagagaagaagaggaaggaaaaatactaatttctcagtattcctatctgcaaatctggctggatttgataacaaaactcctactactgttctctaatggtctttgctgcatgccatatggacatggcttctaaaggggatgaattctaggttttcctcacaaatatccaagcacagaacagcagggatcttgacgactaaatcatcctaactcacgacgaggatcacagaggtggaacatggctgttgggactagattcttctgcttatttcatgtgctttgtgaattaaattgttcgtagagttggaaagctggtggactaaatgttttaataaaaacagccatgagacacaacagttttcttcacaaaggctttcccccctagctactgtgaatatattgctgaatggttctgacttctggaagggcaggaggtttgcctcttctctttgcctcaaaaaccaggcttattctatgcatctgggagatgattatacttacccgaaatttcaggatactatgtcagacagttccttcacagtggtgtgtctggcacctaagcaaggacttggtgggccagacacatttaaaatgtaaaagtggatgattatattattttgcattgtaacaatgagagtatttctggattgtagctgacgtgtagatcatcataaccatatgtggcacaacaaaccacacaacattgcatcagaagcttgtagttaatatttttaaatgattgattattttgaaatagagaaatggtggatgcttttttcgacctctttaaataaccacttattgaatgtctattgtcagtgatggactctttcttcacagaagggagctgggctatgccagactctcaccatgttctttctcctctaacactgaacaaaatatcagtaaaacaccaagtacagctggttttgaacctagtaagaaatcagtctgtagtaatgggccatattggtaataattggaactggtgatatcgatagcagtgggaataactgacttacaaaggcacagcagttcaggaacgtctcagggactcagagtgggtaaatgcgtaaatctgctctcacctatttatatgctccaacaaatatctggaactctagaaacttcaagagtctaatatgatcaggccacgtttataggtattataggattcatataaaataaggaggcatacatgttgatctagtgagcgtctccatatttgtacaacactcaggatatgtctgagaacacattttaatttttagaatcagctatagaatctggcagttattataaagcaaacttcacttcaaaaaaattaactgagaagccagatgataatccagatatacaaaacaacattggtgggataagtcaaataattctctaaaatgattatggagaaactgaagaaatgaagggcacctatttatcatatgtgggtccccagccacgtttgtaatctgttgtgtgaccttgggcaagtcatgaaacttctctcgagtctcatttttctcatatataatgtgggagtgttagattagatggtttttaagattctttccagtaataacatttgatgattctaaagtaagaagagatgaaagagtaattcctctttcctcttgttttggtaaatacttgctttctcctgctccgtgcctatgcagtttgcagtgagtattaggtttctggactcaagaagtcaaatagtaaatactgaagctatttttccttgtacacatggacaaatcataggggaataatccttcctttctttgtatatcagtgtctcttctcaaatcagacttatgcctaaggtaatcacgatcattctggtactaataaagatttttcctcatccttcccacaaggccctcacccatgctcatgaaagcttatgtgattgggttatttctatatttatgtcttggctattttttctctttcaacttgtttatgaagtccctggtaagcataaagctgcaaaaacaaaaacaaacaaataaaacaaaacagctctgtttgaataatttacttcagttgaagcagtataagaaaacatcctaacgccgaggggaagaaaacaggtcataaaaataccctggtatcttagaaaagactaaataaaagcttatatcaataatagtttcatatgttattgtctttcattttcaaagagaatggtacatattggctttatagtctggtgtacagacgtggctatttttccccatagctctcaggtcagtgcatcctcaaagccaagaaggcccagagcctgccgagctagctttacataaacaaaggagctacacagaaaacccaatacccggagcttatatcatatcctgactaggcactctggttacccatgactcgctcttttccatctgtgccctgattctctgctggtttaattcccttcacctagaatgccctcagtttgcctccttttactgctcagaattccctctggacacaactcacgactagcataagccccatttccaagaagcagcttagtttgacccaacttagtttgacccagcgaaaattttcatggatagcaagtgaaaattagtccttgtgataactggagtcactgaaaccaggtatctaggaagcactcagagaataccagagaaaaactttcaagggttgcagtgtcctcataggaggaaaaaaaaaatcctagctttaagaacaagcccaatatagaagctgtggtatgtaagagaaaagttgtagccatgtacgggaggaattgtgttaaaacagtctgactttttttttccaataaaggagaagagatcctctgtttcttaaaagaagtttagtcattggatatagcaacatacagtgtcataaagtttaattgcattaattatgaagctaaaatgtctacattttagtagagagaacatggggcatagctaaatggcgaagacataggaatgtgtatacaatttgagtttcacttcctccaaatctctcagttagaggatccctctcagtctgacggtcttatcatcaacagcttcacaaactctgacaacacctggctgggtttaagggatgggccatgatatatcttgagagtaaaagatggaatgaaactcagaaatgctgaatgcttttatatatgtatacaattttatttatgtgtatatttatatatcaatatatacaaacatatatatttgtatgatgtttggcaacctcactcatggtattcctgtgaagtaggcatgtggtaaacataattagcccattaaacagatggtagggctctggcatatctcaccatattctaaaatggtggagctgtaagcagggactaaagagagtgtagtttgatacatggctaactgcaaatctctgtgaattgctactttcctaaagacaatctgggtaggctgcatttggctgagaactggggatagtttaggaagctttaaaaatatacaaagggacaacttttcacattcattcagatatagtatcttcatttttacttactagaggcatttttttttaaaaaacagctttttatcttaactcatctgtgttccaagcaaacttccaaattgctgagcagattaaaaaaaaaaaccctacatgccaagtagaaacactgggtaaatgttattttttaaaattgtcttaacaaagtgcacttttggaaaggataaagttgaaaagacgtttggtactgtaaacacttagctgtcattgtagcacagtgaccaaatacgtccaaaagcacatgtaatgaacttttatccgactgaattatatgaccatggcattgccactctatagtacagcaggcttcagagatcctgttattaaatattctagcctaattctttatcatttgaaataggatctagcagaagtgaaagagttactaaaattaagacttgaatttacaagtgtgtttgaactggcttcaggaagacatgaaacatcaatacatctggagaatagaacttgcaattgactgttctttaccatctggtctcaagaacattttctgcttggaagttgcataagcaatgaaaaaacacacaaacaacttcctgtaccatgtttttggtcacttataatgacgcattacaaagtaaaccagctaaatatgagcaactgcgccttactcgagatgacaacatacattatataactaagatcaatgaaaaagaacatctttattttaagagacctggacttaaaatattcaagaataaacatccttccttctaaggtgtttgtactccttctaaggtgtttgtactgagtagttttggctagacaggtttgtagagtcactactacaaaacaatccctatattttttcaaactgaaaaaggatataaaaaagcaagctatattgaggaataaaatgttccatatattttaaaatgttttttaatgacataaacttgcctttttaagcagtaaaatatattctacacatgtttttcatagaaaacttttacatatctttgttttcttaaacacagtatgttgatgtaatttaatttttttctatgatacagggtcatccttgtgactattcattgttcctgttttacaggaatacacttttcttacttgtggtgagaactggcctcatcccttggctcagcctaacggccacagactgagctatagcccactagccactgccatagccaactggcgtcactgtcccagtttttcagacccatcgcctctaaatcctctctgctaaatgtattttctaatgtgctttggattagaaaatcaaataaataagaactgtagagacaatactgcttgaatgcagggtttggtagaagatttgggggaaactcatttggacacttgaaggtcttcagttacttctttgctcagggttgtaactcagagatctgaactaccagaaagtggattttgaggtattattgtgtaacacagagtgaaacatttatgcacttttattgcaaggcttcttattttaaacagggttgtccagaaatccattcttgattactttacttgataggtctctgatccattatatttcactcccttgatttcctccagcaatgtaactaacataatgacaattgggaagtaaagaaatagcacatttttaggataaggtgagagagtcttggtaactgacttcatcatagtgatggaggcaaaaatatacagtcaagttagaaaacttccctggactgctaatgggaactctggcctgactagacactgggaaaacattaaaaactgtgaagttatttacattaattttcagtgttcagagaagtaacatctgatcatcttttttcctcttctccaaaaggagaagtcagaataattcgcaatctgtgataggatagggattgtatcgaaatttgcctttttattacctctgaaaataggatttctaagcaaactaataaccttaaaactgttgggaggaaggatgggggaaaccaaatgtaacctatatgaggggggggaaacatctttaactactttaacatacacacatctgataagttactgaaaattcttatttattttgaagttagtgctgaagaaactctatctgttaaaacttagaaatctcagttcaaagtacatggaaatattccatgatcacgttttcagctcattctagtcgtctgtctcccagtttatttgaactgatgaaattttacaaaataaacttctttagctttctagagttacgtttttacccatgtaatctatttgttaatttttgtagcatgcttatatgataaaaaatactatgtaagtactgagtttgcttgttatggattatttctggatacagagaatttgcaagaaacttcagtttacagcagccaaggttactgcagactaaagcagaagttcaggcataaacttgtcttctaccagttttccacaactttgctgttgacagcatctgaggacatggttgatgagttctgaaaatcattcacaacattgctaatgtttaggaatcttatagctttgccggacctttccataatcacgagagaaaacctttgacgaaattagaacaagtcctcataccctcccttcctttcttctagtgatttttttttttgtattggaacaatcgaaagattcaatgtttttaaattccatagaagactaacgattgaataattttctcacatctctgtttgcactttcgcagtctggttgcattgatttgtgtctcacaagtagacatttcctttgttggtcacaaatcaatgctacagaacaaacctgccagcacattccacccccacccccaattttttgcagtttaaaaacaaagcacatttatatactttttcttttaaaaattactttcattggttagtaatacactaaaagaagacaaagcctcagagttaaaaatccccgggagaaggagctcctctctagctggtctctgattctctcacactgcctggagcaaagaactgcctagtgggagagcagcgctcgtccgccgtccgctcctggtgtgctctgttaacccaattaaggtcctcgccttcatacatcacaaagctgcccaaagcaacacactgtgatgtcacagtcagatatgatttcatggcaggaaaaaaccaaaaaggcagaaaaggttgaacgtactctgcttttattcaaatcttctaagagggggaaaaagggaagacttttttttttttttttttttttttttttctgagagaaaaagagcacaagctttctgacgtgaatgtgaaaactccgttctgaagataccctggtgcttttaccccaagtggataagcatgaataaagaagcacaaagaaacactgtcatcaatcagaatgctcttgcctacacttagctacaggtggaaagcaagcaggcacgatttgatttacctagattaaaagagcaattttctatcttccttttttccttttaaaaatagccaatcgattttggcctagctattgctgactgtacaggtccattttaatacaccactgattaaacggtatgttcatggctgaaggcactacagcaggaacaaacagaagcagctgaaggaagggggtgggggacaggcgagagctccaaaaaacactccacgaaggccacaactactcggcacttcccccgtagacagttgatatagcacattttaggcttgaaccagctataattctgggagtttgaagcctggaattcatttagctttttaattctgaccttaagaataaaaaaaaatcaaagctatgttttttaaaaaacacaaatgagggaaatattgtgtcctaaactgcaatgacatctgaaatgaagatgtgcctcagaaagatgcttcttatgaaacacttgaaatttcataagttatagaattatctactgaaagaggacctagttgtttagagactttgtttagtgaaattgcatgtaaaagaaacagaaagaaaataggacttttatatagggtgactatatgttgggattcatcaggcagctctcagaagagggagaatatctctactagttctagaaaataaccatcttgattatcatgagaaagtatagcctttatcgaagtctgggtggcaggaaaaataaattagggagggaccttctcaggcaactcagagagagacccaacatccagcagatgtttcttctgagaaagacaaggtccatctaacaggtgagacatcagctgaacaatggatgccaggacatgggaagtggctctgagaatcagcgaactccatgtttaaaaagtcaacccactttttttttttctgtttgcttactgattccttgttcccttctctcctgttttctctctccaattatcatttacttaatttgaaattctggccttaatggggacagaaccgtatccagaggtactattaagataagaaaattcaggaagaaagatttaatgaggggcttaggagtttttggaagaggaaaaggacattagagagaaacgagggaaaaactaagaaattaaatatcagcctcagcacggtggctgtagaagaatagcttctgagagacacagatggtctgcattctccagaacaaaaacaaacaggaagtaacagggccagagccccctctccccttcattcctctctccagtgtaaattggaaaaaaactgaaatgtgttcacatcaaaaagttttccttcaaactctagcaagtgaccacagtaaaagaaacaagagagcgctggttccagcaggtaaaatgctgaaaggatgtcacatcgtgggggtgaggaagaaatcagggattaaatacatacagtttggagaaaaatcaggctctatagctaactaatgatgaatggagcagacaggtggcagatttgaggtccggaggagaggaagggctccattttgagccgcccattttctggaggagaggtggtggccgctgtggaaaatggctactcctggggtgcatagggagacaactgacttagtggagggaagggaagaaataaactagggagtcatccagggacacatcgagttagtgagggttttagtttggatgataacaagctcttaaaacatggctttgactcataaaaaatgtagctgggatggatggctacttacagggttaaaagcaaactgagagctcttctattcccaaatctgaatgctgaagtgctgcctagaacagcaaacatgtacatgcaaaatatcaaaaatacacaaagtgggggtgcagaggaggtgcaggatgcaccagtcacctccttccccacacccttcaacagcacagagctctggcagggtcatcaccagtaaaactggattcttacaagccattccacagagagaaaccatcccaggtcccccatggctccaggcatcagtgaggacagttttcatgttccaaaactaattggacagtaaggagtgtctgtaagaataaaagcgggtgggaatggaggatggaaataaaagggaaaaaaagtgtccttgttgaaagttttaaattacaggctcagtaaaaaactggcattccaccacatccggtctagttaccaaatggaaaaatagggtcattaacatgtttatttgaattacattagtccttctctttcatatttaatttattctgttagaaaaaaacacaacgctctgcatgctggtgaaaggcaggggtgtaatggatcagggagctgaaatacaatgatctttacccattatctaccctgctaaggcttttcagaacttactaggatcattcagggattcttccctcacaagggagggaagggtacagaaagatgtaaggtacagatgctactgagtttgttaaaataatattgaagcacatttaaattaaggagtggaaggacgattttaatatggaaagtttacaaaaagaagaaaagtttgggataaatgacctcttctgagactgaatgtccagatgcaaggttggtgctaggcttacggaacatctccacatgatatggaagttgtagaacattgtgttattagtattcggggtattaaaaggcgaagtctgcaggatgatctcatgaggcttgctgtcatccacaagaggtcagggcaacttcagtacaagcaagtataatgcagtacattcaggggaaaatgaaacaaggtatattttcaggaagatgtccagaaatgacctggctatctttgtggcggtgacatggaaaggacatagacttagtatcataaggccagtccctgctctacaacttactaacaccatttgcacaagtaattcaatcagttttcctcatccataaaatgggaacatgaacagttaccatagagttgtgaggatcaactgagacaatctatgtgaaagtgttctataaagcactgtacaaatgtaagacatttattttctgaagacagtggtgccaagtgtgagccaagcagtgtgccaaatatcctcagaaataggattggaaacaaagcagggaatgctctgacaaagctgaagaggacaaggatctcccatctcagtgtgactgggtgtatcgctcactcaaacctgaagggatttctcaccgggatgctgaccttgggttcatagactaactccacagtaggttgccacccactcataatgagtcatttaaagttcaaatcttacttcatgctagcgatgctagcacagaggcaagcagttttaggctttttttggtcacagatttctgctgccattgtcaaaacagtagccccaacctctaactgcaacctagggcagccagcccaacctagacttgattctggtcacttttagtggaacaaattggctcagaaaacatcgccttctacttcttctttaggatatccaaaatgagcaaaaacttcagtctctagcttttccttaagacaagtttctccctttgctacaaacggaatcacatctttttgttatgattcttcctctatggtccagtttgttgaacattttgccagctgtttctaagctgaactttggcttaaatacaattgcagtcacactaagatcattctgttttgagcccagagcatagagtgtaattttgatagaggaaggggagagttaaattacgatcagctctagtaaaaggtaacggcaactcatgggtgggatactttctggatgaagtacttcaaaaaataaataaataaaaagaataggagaacgttcagtattaattaaaataatcatgacataagatgaagatttctatttataatgataaaatccaggcaaggatatggtaaatgtctataaagaaacaaaaggtctgggaaactgactatggatttctttttcaaattctagtatacgtgaactggaagtcatcttactacttttcaaaagaaacaatttatgacaaactaaagaactactttacacagtaggcaatcaacttataaaattcattaaaggtcgatgacataaatagtatcacaaaggtttagctaaattcatggataagtccatagtgggttattcagagaaactaggctatctggaggaaaataactctaattctttaagttagcaacaaggacaattgtgtcttatataacagtttcctgtccctgtgatcagaaaatgaatgctgaactgaaaggaccataagcctgaaccagaggggcttttcttataatcacatgcttgtaagaaagtagggactaactatagtgctgatattaagcctgctggggccagaaggtgcacaaattcttgaacctgcagtcacatatgtcacattacctaagctgtattatgccactccttctctgcagcaactattatcatctccatattacagatgagagaagtaaggatcagggaagttcagagacgaaaagtaaattaacaaaggtcacacagctggtaaatggcagatttgggatttgaatttaggattatctacttctgaagctctgctaccacactgctgctgttttctgcccagtagcctgatgtattaacagcttaagatgactaatttaacctgttaaagcgatatgaagtcttgctcttcatttgccttgatatctaaactgtgtgtgcagtagcttcttgtcatcaaatcatgtgctcatctatggctttacattaaagatgtctccagctctcattaagagggaacaaaagaagcaaacagatcacgaggaggtaaaaggcatgctgctatggattattatagagtacctcagactataatgtatattaacagaaactcttctctatcaactaatctaaagactcattcttagttttcctaatctaaactcaggtactacaatagaagtaatatccaagaagtgaatgaatatgatgaattccaacaacctccttgctttggtgactctaatgttgaatgggatatcaaaatggaagatgagaaacacaagaaatagctgggttgggggagaagcacgatgaggagaagaaacattagagaagaatccggagtttactttcccagactctaatttaatctgaatgagctttgtttctccacattttgaagaaaatttaagtttagtaataggagattgtgtaatgcaagagtgttgctagcctaaaggctgtgataacatatcttaggagctctgtgtccctcataacaaaagtaacaaacctttcaaaattatttgtggccttgaaatataatacaaaatacctgtatcttaatttctatccttgtaaaatgggaaaagttatttttatatgaaacaacgaatacataaaatactatatatttatataaaatatataaaatataattataaaatatataaaatataaaatgctatatgatagtatataaaatactatatattttatataaaattattatatatgtttacatgtgaataggagctatttgtgagttttattaaaagtctaggtaaaagtaaagtcatctatactcctttctctggggttctcttccctttccttttgtatatttttgctcccctttctctgccgcccccccgcacccacccaggattttaaccacagatgtaatgggtttctgtaacactggcaactcatagctttcacaaatgttcccttggctagggaccacccaaatagtgaccaaatagtgactctcactggctaatgaaaaatcaatgtggtttgatatcattaggacaaggtcaaaataatcctctaagcagaatttccttacattccctcaacaccaatgtgacaatctcgctgcaaacaaggcatagggatgtggcactgctgaacctggtaaagctatgtcattgttaactgaactaaaggaactatcagtgccaaagaagaaagagagtaagagaaaaatgtcagaaatgactgtctagattcagagaaaaacttgatgaaggggcatatagggatggaagacatcttcgactgatgaccagcagctttgaactctgcttctggctcttgatacaaatttgatgtgttgggtggtacaaaatcactacactgtctaggcctaaatgccttcacctgtaaagtgtgggactcctttcaaatctaaagttctgattttgtgtcttgtttggctggcttactcggttagaacataggtttaataaggttaacattagagattcagttttcatataaatcagatggcctgatataatactttgcacatagtacttaataaatatttgctcaatgaataaatgtcttggaatagagaaaaactctatttcatagtcaaggattctaatttagggttaaatggagtggggccaagagagagcacggggcttgatactaatgcatctgaactcctgggcgaaataacttaaaacgtgggtctcactgacattgagtcagtggtatcaccatatagtagttgtgctacaagaacaatcttactattcagactctttgaatcacctgaaagtgttcttgccagtagcctcttcccaaaagagataaccaatcctgagagaattccctgattttaagattgcataaatagctcatcaaatccctacaacattcagttgggatatgaaaattacagatatttttttcctcttcacttttcacatggaaaaacagaagtctgcttccattgcagtcaccccatctcctacaggggtgggaaatgacttagccagtattacagattgagccactacctctttgtaaatactatagttgagcatagaatttgcccacgtatggtacacccagggatttaggtggcaatcacatgccagaattttgctttagataatgagaatcaagtcataaaagaacttgtgaaaataaaaattgagacacttaataatatcaaccacctgatcattgtggtcagacatatgataatttcaattccttagcaatacttaaaaaaaaaaaaaaaaacaactaactaaatagagggattagaacctggaagataaagaatcaaacattagaacaagtaaccttggatcataaatattctctgacattttcaatttgcttgcaacatacagggttttgttttgttttggttttgcttccatgagtgtattgtatcccccactttctccccttctagaagctggctaagtatagacgcagacggtgaaactcaatcgcagagtgctgacagagcttctcttagggtctacagaacagatctactgagtctcacatctcttggtcagcagcgacaggtaaacactagctttattttagcagctcagctgcagctccatgggcagctgtccttactgcacataatcagtccctcttttcagggggttataactcaactatcaaaataccaaaatatgctccggtttgaaacttggtgtatagagtcccaagcccaggaatgaatgtggtttacttccaaatttaagaaaatattgagttttgtaggtcatttatttactattttcaaatatgtttgaagaatcttttaaatgccataggaaaatgtactaaaaaggacacaccattttaatacctttggtgattcattctgaatttcagcacaccactgaaagaaccaaatggtggtggaaaaaaagagtttgttttattttcttaccaaatacagatgttttgaccacttgggtcctcatcagtgttcaaaatattagtgtgttgtaacataataaaataaaggcgttaacttctttgttttgttcttttcagtgatgtgcagaatggattaacgagttcttgtttctggccctcgtataactcaaaaactcgtttcaacttaaataaattaagtaagtaattagttcataatatggcctaatcacctctggtattttgaaacaaacaaaaacacaaaaatggctgttgcacatttgcacttaattacttccacagaaaacactcatgtggactttattacaggtgacataaatttcaaatctaagctttgtttgtgatagaaacctgggttatggtattgtgtagacttccacgaagattctgtaaccgtccctactattttccttaagaaaatgaaaccacagtctatgaaaccacattcttgcgctcttaattggcaaaagaaagtgctttatttcaaaaactctggagaatagtttacttcctacagaggctcaaaggacgttaatataaaaggtagtatcatttctggaatttctgcagtgttcaatttttgctcttggagtctgaacagttcttgtttgcatacacgtctatctgggaattgctcttagtgatcaggacagccttatggaaatccttccagatgaatatactcaatagagcaaaaaatcttgctctgtctttaatgtaaaggaaaaaaggacttttaaacaagtgtgtaattgtgagttctagccttaaaggaactttcttggcttggatttcttctaccctccccttcagatacttaataatcaaagtatatgccaagaaactaatgatgcaaaccagagtattgcacatgaacttggatcgctttcccattgtgtagtgtgtgtagtgaccaagattggacccaaaaagtcgatgatagaaaatagacaatgcaacataatcaaggtacgcccaccttgggtaaattcactaacccatttcctatccttcataaatgcatataatgattctcagtatagattctgaaacttctaggctaatctggccatcagctgtgaaaggaagaaggatcaaccttgattagtaaacttccaggtcatttgcttggcatgaacccactgatgtgttagctgcatacctcacaattctttaggtgttatctgatgttaccaagcattcctgatgccctttgaatttcaatacagaaatctaagtacaactaaacatttccccaagctgtgacagccttatggctattactcattttagaactgagaccaacttttcttctgacatttgacctgggagagtttcttctttagctttctgagtcatgcaaatttattcaaattctgtattgcaacccttgtcagttgtggccatacattcacttagtgatatcttacacacaataggctctcaataaacatttgctttccagaatgaaactagccttatcataagaaaaaatggaatagatttcaatagagttataaatgaactagaagaaagactaatagatcttgagtatattaaaaaaaaaaaaatcaagcagtgagaacagttgggttttgatacagtttcccaagggaagtagtagaagtttcattactcagggcattttaaagtagaatagacaaaacactagtggggtatgttgaaataaaatatgcgtagtccgtctgtgaattagtgtttactttcaatataattataagtgaagcaacactgtaatgggaatttttcatacacaggaaagctatggctactatgtttccacatcgaccatatgttgcacatattggttgctgtggatgtgtatccctactgccctctagtggatgaaatgtaagacctacctgattaaccagatctaacaagctactggtttgggggtatatcaatctttaatcatttagggtagaaagaaaatagctgtgttgatgcattttccatcaaattataaaattgaagggcattaaaaacaacagaatcaaactctgtaattaagactgccatttaatgtttgttcgcacacggtattcatttctgtgtatccctgccaaagatccattgtgtaatgttgtcctcacatgacattaaaaacaccagttccctggaaaatacaaaaaagaaaccgtgctgccttgaaatacacggagttcactttcagaaacataaaattaatacagacacagtaacataatttggaacacaaataatggctacaagaaacttgaaaaccaggactgctccttaactctgagcaagcgtattagcagtctatgggtgtgctggctggtagtcagaagagggcaagcaaaatgggtttcagaacagggaagctgatttgagaaaggactgactaaacacatagtaatagggcaggaaaataactctaaacacacatttggtactgtgggtatatatttaatgctgtcacattgaggctgcttttcaagtgtagcacccagatgctgtactcccaatgaagaaagatagggacctgtacagttctttggcattttgtcattaagacacaggacaaatctgaaggccatcctctttgtataattttaattattttacaggatttagactttaatcactaagttttagtctcacacttagcatataaaataattctcctaaaacaccaagaggaaacaattatacaatctacgttgccaaaacaactgacataccaaagagaataaatgaaatccgaaagaagagaaacataccgtgtgcatgctgagtgcaccagggcaatggcccttattatgaatgtgggaaataaattggctaaatctttaaatatcataaattgttcgaagctggtgatatgtgagtagatgtacacttgaggggaggggaactgggtgggcatggcccagatcgctctctgagttagtgacagtttttacagtacataatttggtaaaaaagtattggtttagtaatgaaaggtaggtcccaatggacttctccttgtaaacttaaaaagagcaacagacttatctagatagagctacaaagcaacatgaaaactctcattacctgagtgatctagaagaaaatctaacttgataaatatcctggaagcattgttttcatctcaactagatttactgtatagcaattagcatctctatagatagatatggggaagcccaggagagctgggggtaagcagtatgggccaaaaggaggaaatacagccaatttcctacttagcaccacggacagagctgtcagcagaaagaaacatccttggagttatccttggtgttaaagaaacacaaagaaatcagtgttgcattttaaagatgcttcttatccccattgcgactggcagtctgggttggaattatgttccagtgcttccctgtagggcacccattggagctgaacgaataaaaaggtgtcttgcccgcctgtgcacatacaggaaggaaaggttgatacaggagaatgatgtctccttgacttttgtctgactcttctctggtttttgaaaaatcatagcactctgaagaatactatccagtctttcccatgtcaagacaagtccctgtgcatttcagccttagggtctctagggcacagggattgctctggggcacaactagggaaagggaataagtaaagacaactctaaaaggaagtaaaatgccttctattccatctcatgttatagaagattacaaataagaccctcttcttcctctcagttctggcctttatgaggtggaagtcactattagactctataactgaataacagattctggaaaattagaactatctctcttgcacttgagaagtcagtgggtctccttttctgtcctgctgaagccagatacagacaaatctagagaaccagttttatgaaagaaagtagcctagcacaaattatttggcattaaaccataccatcatttgctaaagacttggagtcaaagcttttctcatttgattgttaataagaagcttatatttctaaaatatcttgattaccagggaacttgtgggttttggctttaatcaattcttagggcttttcctatcttttgtttcttagacctttatgtccacaggatagtctagagagttgaaatttactttttgccagctcactatgcatgttcaccaaatggtaaagttctcactttaaagcccagcaagacaagatgagctctgtctgcccagcagcctttcagaggcattaagggtaagagagaaggtaagtaattcactatgcgtccccatttctataatggggaaggacgtcttgatacatttacaatactcctctggggatatttcatcagttatacctaaactctaatggacaataattgatttgaactttccacttagcacagagctgtaaacagcttcactgcagacggcagcaatgagccgacgttttgtaaagtggagagagattcagaaaacttttgtactgggtcatgccgtagcctaacagcttttgaatccagggaagaaacagtttgtcctcctggttttaatagctgggctaatcgagtttcaagcctgcagtaggtataggttatcttttgaaggcattccattttaacccctcactattatgatgggtttataacctagccataaaaatgtactcctgatttagacatacatcaggacacattcaaaaacataactttctgaatgttaatttcctggtgaaggaaaaaataagacattaaagtcattttaagactacagattttttttttttttaactctgcgtgggtggtgagcctttcagggaaaatattccctctcctccagtgtccctcatctggttgacaccaccctgtctctccctctcactcaacatcactttgtttcgggctgtatcttagtgcaatctcccatggaatggccccaaagactaatctgctacaaggcatgaaacaagcacaagtatagctctgttccatgactttcttttatagcctccctccagccccgttgaacacacaagtagatgaagtttagaagaattctttcactatttaaatcagctcttctgtctcactacggcatgatagagggtaaaatgaagagaaatgaaagactaactacattttacttagaccactacatcgtctgctcagtctatagctttcctattttgttccacactcctggaattctcacaatgggattcaaagctcacctagaagccactcttagacaacaaaggacacagtcccctttggagttgttgctgccacttctcttgtgtcaaagatctacaaaccttgtggctgtgaagtaggactttatgaacacacagcaagaaagtatattttgtgaatatactgcaaccggacgttacccgccttacatgaatttgacatggaatatgaattttccctcaattcagctgataagattgtaagagcaaaggcataccactgtcagaaaatagatttaccctgcacccccaattgtaattccctttctagaaatctacagaaaaaataggatataatcagacattttgtaagatgttgtccagattctgaaatgcattaaaatcaaactgaacataacttgttccacttggtcctgaaaattacattctgtagcttctagacatcaaacttagttctggttttgatgtaaccgctgattatttaggtaacactaagcaaggtactgaaccttacagagcctcaatttttccatttctcatttggggagaatgacacctgtgtgttcttatttattgatggatgagatgaaattatatcataagctactgaaaaaaatggtgttatatatattttgggtcagtcacctttacctttacagcagcatgaccaatgattggcaaagtagtcaaagtctacttcacccctcctgggtagaaggcaacatggaaagggtattttccatcatttggcagtaagggcctagctctacccatgttcttccccaggcaagcccttttctcccataatcaaagggcaacattttaatatttaatctttaaatcaaatatggcattctcaaatttgatttaaccaatgtctaaacttcactgagctttcagttgagccactaactccctctttcactgtcaagcttccatggaacactctttaaccacaaaattttgtacaatggtacctagtgagctcaaatgactttctcactgatcaacaattattagtctgtaaggagtttatactacagaacatcactctggtgtgtcaggctcagctctcatagacttaactaagcataaaatgtgctttacaaataaaatgcttataaaagttaacaaagaagttaacaaaagttaacaaagaagtggatgacttacattcaccctgtgttttataccttggaattcaaagttccatacttaatggaaatggggaaagcttagcaagggttcagagcaaaggccaaagaaccttccttccttgtttgcccaaaatattaaagagataatttgataatggtcattagtaagatgatgtgttaatagatgttccttacctataactcagattaaacatttaaaaagggggtttatgaagtatgagggattgagttgagttataaaattattacatacttcaggagatgttaaatcctcatatgaaatactctgatgttccagtgtaagttttatgaaatacatttgatccctatttatctgtgacaatttagttaacatgctactagagggcaggacaggtgaaccagaagagttctaggctttggcatctcataaaagttaaaaatgatctgtagagcttatcttgaaatactctttcataaaatgtatgtgtatgattcaatgactgagccatcccacatgctaagttgactacggtcatagggaaccaacctcatgtgaactgtttgatcccattattgaccagtctttatcaatgcttggcagaggtcaaggaagtaaatctaacacctataaaacaaataagcgatttccttgtttgcttttgaaaatgccacttactgattttatttttctttacagttgttagcagctgtacacggtcatattataattgtcacataacaaccttaattcagggacacatcttttgaaacaatgtattattcagcaactttgggtaaacatgcaatttaggagtggaaaagatgcacacagacacaagtaatcatagatacaaagcatggtgaatttctgtgccatgcacttcacaccccaactcatctcgcagggaaactagagaaggggcagaaccatttctattatgataattcacaaagggaggccatatagatatgcatgcaaagtctctccccacctctccatttacatgccaggatttcaactctgcgacactgagtcccttcatttagccaattagtccttccagcttcatgtaatgcacgccaaaaagaaggagaaatagaagtgctgacgttcactgctttgaaagttgctattctaatgccaaagctgcctcttgagcaatttccagaatgtattaacatgggagcaaagcgctattcctaaagacagggatcacattatgcaggggagccccgtttaacgtgtcacaattgcacagaacctccatcccctgcacgatcttacagttgtagtttgcatgggctcaagtttacggtctttacttaggtgaaacttaggaggtcttcctaaagaaaagaagcaatttaaaaatatctagtaagcaaggcatggcacatcttttgtaccatggcattgaccaagtccttttactgtcattctgaagaaagctggtcaaggtgtaaagcaaaccggcctctcagtttaggacagagtgaaggattcttcagtttctttctttctttctttttttaaatcaattaagtctaggttcaattttaattattttaatttggcagacatccctagaattttccctccatattaaggaccaagttgaaaaccattacataattgtgtagctgtgtatctgaatgccctcttatgcacgtgattctgatacttagtaggcaacaaggtgtcgctctgaaatttgaaaaaccattaattcttcagctgaccaccctgtttacagctgaagcagtgatagagattttaatatcgccttctcccttactcttggcaatggatttacaaaagccagtttgtgtcagcctggccctctacaaatttagctgttctttgcttaaatcatgacatttgcaagagatgactggacaagtcccccactgaggcagcatagcagaggtgaaggggcacttgaagtcctatttcttctacacgttgtctctgcttacttcgaccacatctgtcttctaggtctccttttcccaatacacaaaatttgaatactgactgagacgatcctgcagggttccttctagcccttttttgcttttttaccctaaaacgctcaaaatgatttctttctatgtctttggcttctataatttataatcttggctcaatcttctcccttcatttatttcctcaatattaccttttgtaactcttaaatatgctgtccctcaaagaactatcttaaggccatagttttttcttcttatactcatgcatctgaagggctgatgcactcatccatcttttctcataatctacctcttttagttagggttaactaagttagttaacttagataacactttctcttcagaatatctctacttagatggctgctagcccctcaaaacccaaataataaaaagcattctctctttccttttaaatcattctgctatacaaattctgtgtaaccacagtctaatatatccaatgcctcaatcttctgctaaacgttcacattttaatatattgcttctcatatagagccacttatcaaatttagaaattttcttatgatgatgttaactcaaatatacctttttaaactaatattcttggccagctcctaatcacattgtacctaggatatgaaaattgcctcctcagccgggtgcggtggctcacgcctgtaatcccagcactttgggaggccgaggtgggcggatcatgaggtcaggagattgagaccatcctggctaacacggtgaaaccccatctctattaaaaatacaaaaacaaaattagctgggcgtggtggcgggcgcctgtagtcccagctacttgggaggctgaggcaggagaatggcgtgaacctggaggcggagcttgtagtgagccgagatcgcgccactgcactcctgcctgggtgacagagcaagactccatctcaaaaaaaaaaaaaaaaaaaaaaaaaaaaaaaaaattgcctcctcactccaaacatattctcaatggtttgactgtcacagttccctctttagtcctccagtggctttctaccctacttcagatcaattgtgaattatagactcccagcactgaaagccccctccctgtaggtctgcttgtctaacctgtcagcatccggtgccactaaggcccaccttaatccacacagcaagtcgcttttgtcttctggcttccttccgctgagaatacaccctctccatctctgaactttttccacataagcctgcatctacggaataatccctcatgcactgaagaacatctttccttcattcagatgataacttaaacctcacttatgccagagagatttccaagatgattaccagccaactgttaaccctctaaaacaaggtaagaaccactccacccacctttccacacatttcagaaaaaaattatatttttaattgtgtattgtagttgtttataaattattttgatggcagcaaaatatggtatttaatacagtttatttattgccttgcaacttttaagtcttgatttcaaattggtataaaaaacaaaaatgaaaaaagtcccattttgttactttaatatatataaagccatttaagtctcatgctttttgagatctgtcaaccgctatgcacatgataggtatcactaaacacacacttgttgaattgaattgaggaggaaccatcttaaacagtttactcacagaggaggaaggaatcagaagactatgaacataaatattccatagcagcatctgagtgtaacaagaaataataccaaaatgagagtttcccaaatttctctcaccctcttgattgtttaatattatattcataaaactatatttttaaaaacagctttgattttaaaacgttaaatttacacaccaagaagtagacactagcaaagtctcatagtctgatttatttctctgtaatatatctgtcttgagaacatcagcaggaatacaccaaagaaatatgtccctcacgggatcaactatataaaaagacagaacacatcatcagcacaaaaatcattatccatctaatttctcccattctagatggctccagtgagcccctcgatcattactgactagggttaagatagagcttaatggattaattaagccaaagcaggactgcaatgcagaccgaagaggagaaggtcctgacacagatgagacaacaactctgttcctcttttattcaaatgtgcaagacttgcccacccccaagtactacacatttatactgtaaatagtctccaaaaataagatttggtgtctgctgtctgggtcttcccctcagcactcaccaacatctaatacttgggtgttaatcaaaatgtatcgtgtaataagaaattaaatgttaagactttctttttcttcagaaacgtggagaatgattgttaacagaggtaaagcagtagaggcagagcactcgttttggcaatcaaggagcaccaactaagggagaggttattgtttgaatgtcaatgtgactctgagagagggccagggacacagaatattcacaaagagctgaaaggaagaagtgcccacagccataaagtcacggggactggggggcatgcccaaaggcatctgtcgtaatagaaaccttgagatttgttcatttaaaggggattttgaaattcaaatgtaaaaagagaacaagataatccaaagggcacaatttggggcctttttcttcttgtaaaaagaagagaaaatagagagaatcccccataccccccaacaaagtactgtaccatagtggcagtttactctcacttttacgaaccaaatcaacatattaatgacttaaaaaccacgttcacaatggggacaatcagactctatcagacacaacattaaatacgcaggtattaaaagaaaaaaatgcaaactaccaagaaatacctcactccggaaatggtaaggctgacgaaagcagactatgtcattaataccaagcacaccagaaaggcatctatggagctagactgggagggacaggcctcatttgcaccaaagaggaagtgccctgaaggggcccagaagtggggaactgggtagattttagtctttttctttttttggtaggtggggggaatgacagaaacctggcaggctcctgtggaggtctggctgcccccaccatgttgagtcccagtgtctaagtaagtaaagaaatgaaaagacacctatctcaatggttgtcctgaaacagttttaaaagcaagtacaagtccccagcccctagtagaatacaaataatttcatttgtgattcttgcatcaaggaaaaaacttgtgctaagttcaaacaataggatacctctcaaaaagatatgacttctcactagagagaaagaatcaaattctggagtgggaagtgttttttaccttagtgatcttttagtcattttgtaaatgaggaaactgaggacttgccaatggtcacagaagttaattctgtagttggcaattctagcagtaatgaatttacagatagatttggggctatgaggaatccagtggaattgggtccttcaaggccttttatttaaacaattatacatatatatacaaaaaaagatacagggggagagatctatagatatagataagtctgtataaaatatattgctgggtagtaaaaagaggaccggtgttgtagcattttcactaccatggtcaagaagccacggactagattcatttgttcagtgaacaaacagttactgaactctgtgtgcaagtattataaaagtaaaaaagtacgattagacatagtttgtgctgtttcaaaaagagttaacagtatagttgttttatatctacaatacaacctcttaaataatcaagtagtcaaactaattcctattggattaatacaaatcataatcattaattttgaatcttgagagaaggcataaactctgcattatattttagttagacactggaaataatctggaatgtttctggtaccccacatctaaagattggatttcagctattcggtgcatttggatgtttttttccctttagaatccatcctaaattcaatgccctaactcggtagctcagaaacagagctctctaggcattgctgctctccttctgcccagtctctgagagggtattgaggttgaggatggggatgaaactaagaataaggcagagaacgttgctaagtcatgcttctttcagatctaacacatttgtagtcagacctctggccctccgtatccatgggttctatatccgcaaatggaaaatatttggaaaaaaaaaacctccaataaaaaataatgataccacaatgaaaaataacacaaacaaagaaacagtgcagtataacagctatttacatagaccttacattgcattaggtattataagtaatttagagatgatttaaagtacacggaaggatgtgcatgggttatatgcaaatactatcccattttatattagggacttgagcatttgttgatttcggtatctgtgtggtgggctggggtgggatggggtgtcctggaaccagtgccctgctgattggatatcaagggatgactgtacttaatctccaagtcatttcccttacagttatattttagtatatggcaaagcacaatgatttcctttgagatgaacaaaaattgagtagctaaaacctaatgaatacaattagtttaagtaatctggttatggagaaaaatcactagtagtaaagaagtgatcatattacccaagcatttctcttaaaaagaagaaaggagaaagataacatgtgagtgcctactacatttcagtactatgctaggttctttacacaaattagctcatttaattctcataaacatctcccagagcagagattgtttccatttcttctggtaaagaaactgaggcacagcaagattgtgttttgagcagacatacaaagctagaaagtaatttatggcactcatatttggatccaagtttgtccatctacaaagcctataagcctgctaagggagaaacccaaaaatgaaacaacaatgaatgccactggcagtctttttattggatatctactatatgatgctaagttatgtgcccaattaattcgaatataaacacacattttctgccaccttgatgtttaaatatatgagcatgagcaaactaacatttggatccaccatagaatattgatgtagaaaattcaaatcactcatgtatttttttaattttagaagacaatttacctgatgttgcaaagttatcatgcaaaaattaatgctaaaaacataaaaaataccctataaactctttcagtgccagggaacatcatgcactgctcctacaaaaacctggcacagtgaattccctgttaactgccagtagatagggttttatccttaaaaatatttaaaggtgagcacatagtctgcttcatttttactccagggttggcattctcactgcctctacttaccttgttttctgtaaagtgtggaaaggaaaacaagtgaatttttctctcatatatgaaggcctagatgtggggaaaggttgtttaaatgaaaacatggagtttctcctcgtgctaagctggggcatttggagagtcccctcctccctgtgcccctccatccacacaaacatacaccccagttcacgttctagtttcacgcgggataggaaaagaaaacgaaaaacagaaaaagcaggaaaaagtacagaagaagaaggaggaaggataggaagagggtctaaggaagtagtgtagtcttccagagtgctccagaaagtgaaacgatgaaaagggtgagcctcaagagcaaggcacctcccagctctccatggatgaagagtctctatcagctccagaactaaaaccctcagtaggcaggatggtgctaaaagaagaaaaactctggaagggggtcagagacggatattgcagagctttctagccccttctacattacgtataaaaacgattattcaagaaataatgtaattttccagagcatgttcaaatgcaagaaaaaggtgcattctaagattaaatgtactacgacagctaatgattcattatgttaaagttatttattatttacaattattttctatttatgacattgtagtctttcattgacacttgataatcaagagttgacaaaataccatttgaactgctttgctaaagaacaaaaaaagagggattaaggtagacaggaagtgcgtccaccaacaataaaaaggacacatgactcataccccaatattaatgacaaaaatatctacagtgagatcctaaagttctgggtatttgtctaatttttccacaatcagaaccaaaggtaaaaacagcattgacagctactgcagtttggtctgtttaacagaccaaatgctgggatttcaaagattcatggctgggattccaaagatttgtccatgttggaaacagcattcacagtagcttttcggtcaagtggcacaaaggagtgaaaaggtagaaaaggaaacattagcaccaaaaatctctagtcatcttttaccaccttaacatgggttagctgaaggccatggagaataacggatgtgcagttgtctctttcttatacagacagcagagagaggggggaaaaccacacacttatattttgctaatgtaaaagtcccagtggaaacattagcactcaaagacattaatgtggatttgggacactccctgaaggattttgattccattagaaaaaaaaaaaaagacagtgacagatataatcctgctttgatatgtttaatgccatttaaagagaaactgtacccatttacctcaggccaggacaccaagagttcaaaaagtgaaataccatttctcagtgcaaagaaaaagcttggaaaatattatgtgaaaattaatttggcatgcttctttgaaattttagatttctgggatgagcaaatgggtacagttttcttttaactgtttttgaacaccatgtgttgagaagaaaacaacagaatggcaattgctcatccaaaatgctaacttgtggcatggcacagtcaagatggcctgccacagccaaaaagcaggtgtgtgctatgcctctcacttcagtagcatgcacgccacatgtccctgcattcggcaacctcttgcatttgcttttggaacctttctgagggggacagtaaacatgactcaacagaatgtctagctgaggagggactggctctctgagcctgctgtgagacagactttttgaggaagaaccaaaggaaaactggaataatgtatttattttggaattctttggtatcacttcctgtgacctaacaccaagacgactggttccagatcattttgtgtggatgaaatttagcatctaatcaggtcggagagtaatggtgaagcttttgtgtgactggagaggacacattaaatcagctacctcatttggactgaggtcaaggttaatgtagctggtacagatcatacgaacctaacctaaaagcttagagtaataaactcctcacccctcaggtccatggataagcttgaaacagggtgtacaaaaccatttggtgtgctgggatgccaaagcttcttcaatctgacattatgaatctgttattatgttactctaggaattaaaatagttttacgtagatataggtccttttcaactatacaacagtcctatgagggagacgaggaaacagaaaaaaaagattttccttctgccctgtaagaagcctgataaagaggccaagttaaaagtcatgaccacgtctaagctcaagtcaggaaccacttggaatgaaatcccaggatatctgtgctgtaggaatagacaaggtctgaagataaagaagtagatgaaaatcaaaattactattttagaagacaggagtgggacacctctactttattctatacttttaataaatacatcaataataatttattaaaaacctactatgtgcaaatgtcaagagtggggaagaatgaaacctataagtaataaactggaaagaaaaaacatccttaagcttttctgatgtaactgagtgatgttctctgcttctgagtagaaatttatggattcagaaaaggtaatttctttccaaacactcacatgccattgttaatttcactcattcaaatcacaacatttactactataccttttatttctgatggcacattctaggtgttgagggggatacaactgtgtgtaagtacagtctctgtatttattaagcttactgtgcagtggcaggaggaatgagacatataaacatgctctagtataagacagtatgtaatcagtgccacaggagacatacaaataagtgctttagcagttcggaagaagcaagtcctcctggctatagaaccacccctccatagacatactgaaatgactcaatgcacagaaaggaaggatctgtacaactttaagtcaacttacaattgatgtgcattaggggattggagggttagctaggctgtgaggggagggatgtgctcactgtgtccacagctcctctcacactgggtcaccccataattaatgtttatcaaaaacatgcatggataaaagtggaagtcaattgaatgatagaccaggtcaatgggtctgtgttagttctagatattttagatgattattaacaccctgctagaagttggcattataagaacatcattttcttcccacactagtgtaaaaagttcagttttttacccattccagagtgatgggaagtaaaattcagggcttcagtcttccaaatgagggaaatacttggcctgtgcaaaatgctctcggtaggggtatcaaaatgtctttcaaaacagcaaaaaatacatttcctgatagcccctaaggagtatgagttggaatccatgttctctagatgtgacgatggagttcgggagaggcaggtatgctaggatccatataagatcgtatttcccatggtagtgggaaatagaatttgaatgtcctggcttctaggtctgggttcttcctacagaaacatctttttcattttgtattcctcttggacactctagtcctttacctcatgaagagtagccttctgcaattggggtgtgtgtgtgtgtgtttgtgtgtgtgtgtgtgtgtatctttctaagagagaggatagccttactgatgtgcttttgtaaaggattcaaggttgtctggatcctcaaataatgcaattgaaaaaatacggtttctttgattcaatggtgcttacatttgagcagcgttttctttttccattctcaaacacagtatttgagactatctgccaacaataaaaaggtttagagcatcaaaagtgtaggcgaaccaaatcagaattaatctctgtgaaaaccgagattcaggcgcatggaaaaagtttaggaaaaaatccaggtgggaggcaatcccatagaaaggtgtctggcatctttcctgattcaaagtgaggtgtagtaggacacatgtggaagagagatgagcggttctagctattcatatgatccattgtctcaccaatgctcacacaacttgggactgtgttatcagggggccatttgatttatcatgtagtccatgtatcctattgtatgtatgatccggagagaggttaataaagggaagtctaagcttaactgggactaaaatgaggtggcaaacagccattcactcaaacaagactcaccagattaatctgtggagtatccagcagcatttccttttattatcatatgaaaagctgtgcattttattggaaaataattaactctttaaaaaaaaaaacttgcacaccatagcagcaaaagggaggaagataacagtgatcacttctgaacacctggtacacgtttggcactgtttttctttatgcatggatttctttacatatgttatctcatttgatcttcataccaactacgaatgattgatattttgcccattttttttgtataagaatcctaaggttcagagaagttacgtaaatatcctttggtcacacagctagtagggactaagctggaattcaaattggagcagtaggacacaaagcctgtgctcctcaccatgccttgccaggccagacttcatgtgcttttcatggcatgaaatcagtgttgggggaattctgcccagcatctctggttagcagagtgaattgcttttatcatttgccaacatgtcacagaaaaaaacaaaacaacaaaaaaattaaaactcctggctctagatttcctatcaacctgaagtttggcttggttacatattatttgaatatctgacaatcttataaaaagtctaacgagaataaaaaaattcttcatttatgctagctcctatgttagctaaaaatctcctattcctacataacaatgtgcctggggaactctctcactgccagaaactcatctgaaaatgctgaaaagtcagaatttggggcctatatactgactaatgttaccagctgtgagtcagcttgaacatcagtaatatgatatttcccgctacaatttgatttggttaaaatgtgtttgaagttcacccttttattaactggaattaccacctcctgtaactggagggcctctgagaacaggctgctggtgcaatccaccttcccacccgccaacggtgcatttcctggcaacaaatactattaaattgataactacagaaataggtcaaaatgtcttttcaatagttgctaatatttctctaatgctccatagcctccctttgattcttgtgctgacatttttttttgatgagtgcaggagcaacaactgttaaagagaaatgaccagaagaaaggaaagctggctggggtggatggaggtgctcttaggagttcccgtatcagacagaaaagctagatctccctagaggcccaagggccccaaactcagctctgctgttgagtttggtgacccagaagaaaacctgtgtcccatctgagcctcaatactctcatctgtaaaaagaggagactcgagatgactgattattcaaatttgcaaaatgcccagagttcacaggaggtagaagccctgacttatcacaaaacatttgggttttaaatttgtttatagtactcttataatgttacctgttaaggccttggctatccaagatagaaacttattttcatacaaaaaaagtaatattgtgttatattttcgtaagagagaccctttgctatcatactgggttttattcactatgtaaacctatattccctccctctctttcctccaggaacaaagtttgcttttctgagttcacatcacatgtgtgattacagcaaagacagaagtttgaggctgcagtgagccatgattgtggcactatactccagcctgggtgattgagccagacttcaacccttaaaaaacaaaaaagaaaggggtggggtgggtatagtcacattgggaacatagctgattgtgagcctgcaagaagaaaagtccccttgctaaaaaaggttttccagcacttcttctgagatgcaaacataccacggaggggtcaagccattcatgccttcatgctataaccacttcaactccaagagagttatctcagtgtaaagcagttttgaactggagctggagggagggatagggataattctggaacaggggaaggtgaaggaagcaatcagattaactaacacaaggaccctaggctctgctggcagaggagaagatgaagtgggtgacaaggactgaaaagaacccagtctctattgcagtttttgcccagggccttgtctggagctggtgaaccactaaaaaaatcccttgagagatgtcatggtttatcaaaaatgcctttggctcttctgttgctccatggttgtgctgttgctcaacaggcggtcagcaaactacagcctacttggttgaggtgagagtagcttaatctcatataatttaaactcacaaagactatctctccatcagatcccttctgttttccttcctttcctagagcagggaggaaaaaatgtgtgaaagtaagggcaaagaaggaggaggaagaggtagaagaaattaacctttcctcagcttccaagtgagttaggctttgtgttaggtaagcatctctctagatccttccaacagccctgaagatattattagtaataggaagtattttatagggttgaagcagctaactagagctcaaggtggccagtcaggctccttgttacacagcactcttttctcagctcctacaaaatatttatttatatgtatatatttctttttcttctcctcctcctttcactcatgggtgcttgaaaacaggtttaggagccagtcatgtggaatttatctttcaggaatgtcgaacaccccttgagttatccaaagcatacctgactaggagtcaggaggcctacattttctggattaaggcttggtcctaacaaactgtcagtgtggacaggcccatccatctctggggtctgctccaggccttacaattctgtaattcacactcatcaatgtggtggcaggcattagtgtgtttgtacaaaactcagcaagaagtagtctccttagatgctacatgtagactgaagcgaggaactgcctcctgctaatgccagttgtgttttgagtaagaagaataaaaggattgatctgagctgaaagcagaagggaagatgaggggaaggccacagaacacatagctagcagtggcattggtgggggtctgagagaggcagaagcccagggccagagctgagagatcagcttgtttttagcatacacggatgtgtttgatcacatgatggttgggaggtacctaggctaagataatcttaatgttaggtgctcattttaaaacatcaatttaatgactgaagcctattttaatgatccaataaaggccaaagccctcactactatgatacaactatttctccctagtattcactccttgccaaaaaaaaacaaaaaaaaccaaaaaaaaacaaaacaaaacttggctgagacagctatagagtttctgattacaaaacaagatcaccttgatcataatcatctcaaggtgcttggaggaaagaaggagagatgagttcttctgaaccacattatgtggacagaaatcttcaaagagtttaatggaggaattaacttttgaggaattgaaaaaggtatcattttcagtaagagaaaaaatgactgatactttcaattggtatgctagggaaagataaattctaggcaagaccagctctataatttgtggggctcaaggaaaaataaaaaaagtagggctccttattaaaaaattattaagaatttcaggacagcaacagaagcacatcaagccaggcatagggcccgtccaaacatgggaccttgtgcaactgcacaggttgtatacccatgaagctggccctagttttagttattgtttttaccaaggtattccagtcccagagctacccagacccaaatggaaaagcacataccacaactctcaaaactctcagttaaccctgtcttcctacggtaaggacacaactgaattctgcaacaaggatcagaaaatcctggggtctgccaacatatttgatagattgcaactgcactggcttctgcgacatttgtcacagtcactaatccgtgtttctgtcacaacctaaggatgcccaggatatcaatgtctgggaattcaaacatattttctaaaaacacaaatttatttaaaaacaacaacaaaacaagcagaagtcactaaaaagaagctgagtcccctggatgaaagtctgctcttaatctctttctggctttaccttgagtaggtcttgggtgtatgcacacaggttcagaagtgcaggtgaattaccacaataactcttttcagttagagaaaaaatagcagaaacagaagaatctggtcatagcctagcagaaactccctcatttcaccaacagtatgctttctccctttcttattatgctaagttgaagcgatgacttcactctccatggaagctaagtttctctttcctggatgcttggaatgggcctggtgaaaagctattggagggtaacatcatgtctaaaaaatgtatgtatgtatgaagaaagtagagatttaaagagctcagaccaacatcaaaagaataacagcagtccaaagtgaaatgaatgtggcctcttttccaatgaccttagggactttatatatacttagcctacttcttgagtggatagaccagtagcttggcagatgcctaggatgtctgtacaggttgaaacttaattccgtcctttctatacatctttgtcccattaaagaaaaatatctaatatagagaaccagttcactcctacagccagaattatactttgacactagaccaattgctacatccttgatttaggattttttaaaagatatctattggcaaagctaatcttttatttggcttaataggtttgtactgctgctctgcataaggccattagggtccataagtagatggaaatgtgtttgaatctctataatcatgcttagatttcaaaagtcttccatttcacagaggtgatgtaggctcagccatcattttcaagtgttttaacaaatggtaatcagcagagaaggtcttacttttttttttttaaaaagtgactgaccttcacaatggatgcacacataaaactctgattcatttattttaaaaccattctcccctgctgtaaatagatagctacgatatatacattaatatatgtgtgcacaatcagccttagcaatactgctgtgaagtagatgaggatagatggttttctatttatttgacaaatacactattacacagataggttaagcgatttgtcctgtaaggaagggtggagctgggggaaaaaaaaatcctcccacatctgctcttacatgataccactatggaattgggtatcctttattgtttttgagtgacttgatctaaataatgggtaatgtaattttcctgaaaaaaatttcactatttctctcattccctcttactttcttcttctctctgcttctcctctgagattattataaactattgataaatgtggttgctctaaatttacacttgctcttcatgggctttgatgggtttcagcttctaaagagagcataggggagaaaaaagcttatttctaaaaggttttaaaaggatagataacgctgggacagtttatttgaattaatgtcactataaagtggatactggtacgagtactgtcttggacccttctctcgcaagagctagtccaaaggctctgaagtgataccatgggaaggaagagctttttggaggcagaacctgctcatcaacactctgctattctcctgggatatcagacaaaagccagagctttctgtgcaccttcctgttgaactgctttaacttggaactattctctacattagggctgtcctctctgagtccctgaccttagatggtctttctctattttggcacatatttgcatatcagttacggtgacatatttgataaataatgggcctcactgttttttggccagtgaaaaactattttgctattattttaactctttattatctcttttgtcgattatttgtgtgactaaaaagatttcttgtctcttatcatgcttctggttactgtttctcaatgtcatctggtaaatgcttagaaaatacaattttattttgataaattctaaacaaaacataattatgaagaaaaaccaacagagacaagtatataatgaattttgaagctaaatataataaatagttctgaattttctgccactccggctcatttagaatgtaacattgctgacaaattagttattcatgctgttttttaaaaatcaggggcaaaattataagtttcaattctcctaataggagttataacccctgcagcatgaaagcacttgagtaatgtttgctatgtgaaactggcttcggtgatttctcctgaaggaaactgcactatcaaaaccttcatcaaggctgcttctgtttaagacccactgcactacgaatgtccctgtacccgtcagaaccttggctggctgtcatcccatcaagcacctcatctgcagttgccactcagacatgtaaagcgtgtgtttggggacgacgcgcggtggaatgagaagggatacagagctctgttgtaccactacatttattgtaagcaaccacttacacggcaactgctttgctcttttatattctaggcaacacaccggtgaatataattcataatgaacatattcaacattttttccatcagttcaatacattattcataaatattagagatggaaagacctggaagattacagagtccaaacctcctttttgtaactccctttcccctaactgttgatggtagctcaaaaaatccaaaccaaaaccaaaacaaaaaaaaccaccaacaaaacaaaataaaccaaacaaacaaataaaatacaaacacacaaggaaagcaacaaatttacaaattttataagtaaagtgaaaagctccaaagctcgtgtttggtgggggttgttgggggcaggatttacactgatggagctcgctgaagactaggagtatggatgactctttgctttgaagacaggccaagggagggaaatgtcagtttcccccttttagataacaattcaaggtaaagcccaagaggcaataccaagttcttggccaagtgttaactatccatctctacagcctgttgtggactcaggactcaggcactcttctcttcatttagaacttgagatattaatgctaatgataaaaagaaaatgtataaatgaatagagagtgaaaactactagagaatgctccctgggattatctgtactatcaagataggaaaactttgcagatgctactgtctctctagaggaataaatgcttgcattttaatattctcagcagctggttcctgttgaatgccatcaggatgattcagccacccaccaggaacaccagtaacagcaagtgcacacacagaaatctgcaaaactttcttctcttgatgccaacaccattactctggcaaagtcaaaatcctttattgaattatcagttctactaaatgtgaccttgttcccctcacaaataccagcttattctcaaataaatggaacttctggctgattaaaatgtaacattccttctgacttgagcacaccctgctgtcagtctctcttctgccatgttcatgtgatctacctctttttcgttttcttgctatccactgaaaccttgaaggactggcaagatccatacatactcagagtccactttgtatgttgctctgcttgctaaacccatacatttaatgttatatctctacccttacatgtctcaagttatttcatcatttccattttttagacattttctatttccacagaatgtgtttgtatgtctggaaaaacagaaatgtgtagctgaactgcatttaccattgacctcattaatacagaattaccatgccatattcaagctagataaaaatgctatacttgccctcttcttcaaatttagaccagattacacactaaagggaagaaaatgccaaagatgacagctagctatcaaaaagatctcactgtctcattttcaggtctccaaagtaaaatctaaggacattcaacacagattcaggtgctctcaacagccatgaaaatatatggctgaagagggaatctataaatgtaatgaatacacaattggcttataacagatgcaaccaaaattaaattcgatatcttgacctgctctccaaagtgaaagtttctagtttaggctacagacagaggtgtaacaagctcattaatcacatgaaccagaaatataagctgacacttctggggatgctgcaaagagcagtcttaagctgttgggggtctgtggggaacctgaaaaatcatgtggctctgacagtccacagcaagcaacaccactgcattttacaatgtatgtgggtcaggcactggccataaccaccactattttaaacttccaggacaggatttaaggatctttgtagggaaataataggtccaatatggacttttataaaaagattcaatatatttttattaggttcctgttacacaaaaatcattgtgttcattgcatgagaagacaatgaattaggtcaatctatgacctcgagaagtatataaatgggaaagaatcagaggcaggggaatattaataagtaatagtagcaataacaataacaacaatgatgagtgataaccttgagctagtcattctgctaagcactttatatactacatttcatggaattcttatagtatcctaggaaggcagatatcgtttttctctttacagacgtggaacgtgaggcccagtaaaattaagtacattgcctaaaattatgtagacctgttctttacattacaaataaatacataaatagcttgcatataaaatgaaatatggcaaggctcattaaaagatacaaagtgttgtagaaataaaggaggcagaatgtgtttctatttgggaatactaggagaaaaggaacatggatgggaaaatgtggtgtgtgcttaggaaacaaggattgttccagtttgtaatgttataaacctgttgaatcatcaatgtctcattagaactcatactttgataagatagtaaaatataccaatctgtacaggaatatttctacaaagaaatacttctttccaaaagatcttctgactacaatttctcaaaacttttcttgttatttattttttggtggcgatagagggagaaaaaatgtgagatacaaggctatggaggtctgggcagcagtgttaactccagagtctctagggagtacaatgcatttgggtgcattttccttcattcctcagaatgccttatcctcatcacacatatttgtccctgccacatccgaggtgaggttactggcatagaaatagaaaccctgagggtctggtttcttccacttcttcaaagtgggatatcacttactttttatttttataaattagttttagtggtcagccttttggcataggagtacatcaagaaaacgtgagttagaaaacttgagttctggtcccagttttgccttgctcatcttgaaagcattttatctcttctctgtgtttaagttttcttattggcaaaatgagtagtttaagcctgaatatcatttcttaatctgttggacaaccccctcatcaaattttttttgataaaaataaaaccttgttttaatgtagatccttctattcttctctatttaaaattcctggttcacagaatgcaatatatagtaccattagtccagataattttgtagagctttactttctctattttgttaagtttttctcgtaaattttgttttccaaatataaaacattgtaatatatatgtattttcaaattctacatggtcctcgaccagatattccaatattccattctgaagagttggttaacccactcacccatattgagatatctaaagccccttcaagctccaagatacagtgattatgatgctctgatgctgacatttgctttgtcaacgcttaaagcagagcttttaaacttcaaacaatagcataacaagttgctataacaattacacttacataaatctttaagcagatgtgcataacagctctttacatctactatcacactggacaaccaaagcttatgatgttgttataaatccttgcaatagtaaattctacagttaattataacctataggaaaaagtactgtccatatttagaattgattgactcttattttccacatctgttaattttgcacccagctatagggctttaaatagctcccataactttaatcattagcccccactcagtcatgacttctatgtctcacccttctgaccttgcccactgagttcactcttactgatgtaatcaaacatgtttcattgtagttgcattcgtcacagtgctcattagaattatcatcattcctacagcacctcagtgcaatgaaattgtgtgcctatgcaatttgttgttattttaagttcttcagctggaattttaaaaatctagatggacaattttattttatctgatcgataaatatatatccagttaagtgcctctgaaaaattggtaagaaaattatttattagagcaaaatcttaagtctagagagatttttgtaaacttggacagcagcattcactgaccttgaatccacaggttcaaaatttattagtgtcaagttagtcttttaaagcaatccattaaagcaataagtataaaatatatatggtttacatttatgtatgtgttgaatttaataaattagtcaggagtcaaggtatttttaaagaaatattaaatctgttctatattgatcaattaactgactttctaacttaaaatattcttttgctgtagttaaaacctttttttctttttaaaacaaacagagtacataaactgtaaggtggcaatgtagttcactgcgacaatctatatattccttaacgtttgttctttttatggtcatggtatgtagaaacaaataaatgtataatagtttaagtccaggagtttttgcctgactaaattctaaacacatagcttaaataaagggttgaaagcctggcatctcatcattactgtttatatgttataaggtttgcagggccaccttataaaatatatagttgtttattttcatgttcaataaataagtagtgtggggtttcagactgagaatggattacagattgttctctcctggttatttttggctttaagtatattgatcattttatcattttcttgttttaaactactttaaacacagcacaaatgttattctcatcatgccagaaatgggtttggaattgattctgagtttccatcaattttactctttgctctttgtgagaagttttgcactgcttaaattcgaaaggatagttttgtttaaaagatgtcacagtacaacatttagagaaccttagctgcccagaaaaactcagattttctgctttacaaaagaataaaaatcatcgaatttattaccctggactttattgaaatcagtgaagaatattcatacaaatacagtttcacgaacttcctctctctctttcttcatgtaagtgtttgacaaaagcatgtatcttctgagaagccggcctgattggtccaggttggcactgtttcagtgtttggcctacggcggctgcttaggaataatttcatctcatcctctctattttcctggactgtatcaaactcagacacgtggtatgcaaaggaaatccaagtcttttaaaaatgctatttcttttggtactaaagccaagaccagttctactttggccaaatgatcttatcaagatttaacaagagatattcagtaatatctccaatctgtgagaagacattccactaaggaagataatttattacatacagtgtacatatatttctccacttggtaccaggaagagacatgatcaaacttattctattggtactgaaaacaatgtaacactgacaaaaattctgtggcaattattcatttcaattaatttaaaaagaaataaacaagtagctcttcccccattaaaacagatactggaaatctattttcagttattgctgaaaatattttggcttccacaaaggcaccttactaacacactactttgccctccactgtgctgtcacaattcagaacttgtaacattttattcaggtactctagactaattagatgaaacaactgcattacagtattaagatgcttttgtagaattaaatgaaaggagatctgcacagttcagatagcttggaagatttgcaatgaatatcaccaaaatcctgcatgtgcaatatatttttctacatttacaaattagctaatgaataagtgtattccacaataactgctaggatttaatttcacacttaagaatatcaacaaacacagagagaaatttagataggtaaactccatttcccttcccaccccaccctagtgctcccctgcactgtttgcatttcagaacaaatgcttcatgtctcttgaaaagcgccaggaaatctcttctctagctatgcaggcctcaattttatgtgtgtagtatgacacaccttaaaagagagagccccacaaactagagtgggacgttaatttaaatacagacttaaggagaagagctccatctactgaatcagttagatcatagtgtgtaccctatagttatcccattcactactttcaaccacttagaggctctggagggaacaggaaagttatagacctgagcaaccatgaaaaacagctttgagcctaatgccatttgggatatttctcggataccctgagcccctttcctttgcccctccaatttcaaagctttccatgttgcaatataaaataaaaatggatgttttgctatatgaaccatcccttggaagtagaaagtcattggttgttgaaggaaatgtctcagacagttgaagagaaagctacagaaagaaaatctctagctggcaggttgggcagcctaggtaagaagggaaaagaagagtagcctacttactcctcctgccttgcaccattgctggggaagcctgcagccacccaggatcagctcttctggcctctccccggctgcacagtattgttgtggcattgggaatttgctgtggcttcgtaagattatggggatgtgcttcagcaagccaaaaaagtcacaaacaaaattcaagaggaaaaaaaaaaagtataaaaacagctgatcttactggagaagctcttggcattttcctacatatgccacaattttctctggtatttcctggttctgtgatcagaaaaattatcgtatcatatttattactgttgtttttttcagggttgctggtggtgacgggtggtacagtgagggcaaacagatggatcaaggagaagcaaagtaaagattacttctcccacttgtttgaaagctttccaagagattgcaggttaaaaaatctcttcttcagaatactgaagatgtatagatatcacatataggaaaagatggccatactctttctagattgggaaagaaaaaaacttctaacacagtaacagattcggaacaaagcaaattgtatcagaaaaaacttaaacgttcatatagctgcataaaattcagcagcatataagacttataaaaatacttcataaattaagataaaatatttgaatataaatgggtgttaagtatatatataattggatgaaagcaatagttcagtgaattttttattacagaaaaataaaatataatgaattaacaaaagttttacagtaatgctaaccttttctcttgtaggttaaaatagaattaatgtaactgtaaagtggattcatgtttccctgtgggtgtgaatgtatatatatacctgcccaggtattactgactgacactgaaaggtgatatgttgcaaagaaattcaaactttgagcattattttaaattgggtatttaaaatatcagtattaacctggcaggtttctttctttttctttctttctttttaatacatttaattttcagggtctgttttaaagcacgaaaagaaaaacagattagaaaagcattgcacatcaataagtattttgtaaaataatccatttgcatttattagaatattcagttctcaaaaaacggctaattggattttcttcaagccttttcaagacaagttcagttctgtgtcaaggataactatgagaaatttcacctcaaaaggtaatttgtttggttagttataaaagcctgaaaaacaagattatctccaccataactataacaaaacagctaatgagtaagtacattctggtaagaatcgataagaatggcaaagcctgagagggtcatcgcagacttgagaaaggtaaccaagtgaggaaacatcaaacagagttaaagcattctgaaaaacggaaagtgttaataatcactgacaggaaagaatattcttcgatagcgatgacaacaacaaaacaaaacaaaacaaaacaactaaaacaactggaaatacatatctccagaggcaaactatgactacttattaagcaagaggagaacctgcttctttgtcattccctttggaagcctagctttaaaaaaaaaaaaaaaaaaaggttgcacaaaagatacatgtgttccttttctggtattattacaggcccacctagatttagctttcgattccagatgagatcaggcatgttcagactagcacatctttgctctgtaagcacagagctgctatcatttcactggcaaattctcgtatccccaaatttatgcacaatagataccctttaaaatctgcaaattttctatttcagtgaaataactgattgagttaattttttttcttaatttacgctgctcgtattaagctgaaaagttaaggcaggcaactcctataaaaaaggaaagttgaacagtacttaccctaagtgtaatgtgcaagccttaatggggcaatttacttttgctctatgatatttagaaaggtgtccaggtctaaactcagctctcgcctttttcccttctggaaaactgagtagactcacagaaggtgcctctgcgaaagatcatacaaatcaacagccttacctgtggccattcagaagactgcactttggtgtgtgtttaaaactatgaataaagtcagatacagcgcatgctcagcaggcaatttaaaaatatttataacattgttgtttcaaaaacaaatttcctcaaacaaagcaaaactcaaatttttttatccatgccaagtttaacgttctgagacaaagctgttttggagttttccgctgaaggaaaaaaggcttttaaaattttttgttgaacgaaaaatagttctctcttcccttttgggtacgcttaaaggggtggaataaatttttctccaagtttcaacaaaattcacctctggctatgataaggcattacaaatttaaggtctgtaaaaaataattttagagaaactaacaagaaactaaaaactatgggtttaaagaatgtaatggtcatctgaactttcaaggcagtcttgcatgtaactatacaaaaattatatcctgatacaaacaggatatattatatgtagataagaataatgtgtatacaaccatatgcatacctagagaagttttatttttcttttgctaactaaaatcagaactctctaaagccgaaaaagaaatacaacaaaaatttaggagaaacccagtaataacatcggcacaattcatctgtttttcatagcaagcgtggaaaagaaggcaatcataccaattgattaaattttgagatatataaaataaaaatttgataaaagaaggtttttaaagtatgaattgcagtagaaatgcctgtttcgttcctggttgaaaatttctttctcttccttgaatatccctaagcattccattttaccatctatcaccaaaccctgaacagctcacagatctcacagatcttatttaaatctcttacttaattcttaagtctctgaatgaatttcagctcctgctctactttccaagggtgctcagctggcctcacaaaagctccacagacacatcgttcactatctctgatgctttcaagcttaacagaggatgccaaaaaaaaaaaaaaaatcaacgattaaaaaaagtttattaaagtgaaactaggagtgcaaatttgaagaagttgcttctacttttatttctctctcaactcagcacaggtgtttcctaacttatactgctgtgcatgctgatgaaggggagggttaaattaaggtgagggagtgggccaagggcagaccaacaagcatataggatctccagcctcatgtgttaatggatgtgtttaaaaatggaccccccaaaaagcctagaatgaggtttctttttggcaaataattaaaccagtatactgaaataattaaagctttgtctttaaataaagcatcagatcaacagaacaaaaacaaagataaaaattgcacacacatatgcatgtgcgcacacacgctatgacacacacagatacgcaaaactagtgggtgaggggagaaggaaattaaataaaagaaaacaaacagagtcctaacaggccattctccgaaaaggaatctaaataaaaagtcatatgatatctgatagtgcaggacacgtcgccaagaactggagcggattgcctacaggaagaaagggccagtgtattccagctcaaagagcttttctttcctcctcctctattttttttcccttttctcctcgactgtgaatgtgtcactctcaggtcagatccacgaagaatcccagaatgacagctatcacctgtcactgtactcttggcggcacaactagctgataggagctgcctgagttgggatcaagaagagctagtgcagctttcagtaacagcctgttatcccagtccctctgcccctttcaaagatccccttggtcacatcaaaaacagaccaaaaagaaaaagaaaaaagaaaaaaaagggggggtaccaaatgaaaaattaaaaatgcagggacaacagcccacagcaacaaaagaattcagggagaaaaaatagaacacaagcaaaaaggaaaaaagcaaaaccaaaacaactcttgtcttcaatataaaactttttaaagactgagtttctcttatttggatgacattctttttaaaagtatttttctccttaagcactattaaaagcattaaaaaattctacaaaaatacagaaaagtctgaaagcaattcaagaatattcctaaagaaaacatgtaagtgtaagaagtgagttaccctggaaaattctggatttgccaaaagttcccctacttctaatatctttcagtgagttcaagtgctaacactggccacctagtacttgttttttatctgaggatcattactgaggcaacacatacatagtaaggtttcccgaaaagactccttgttatcaagttacttcaaacataaggcactcacacctcccagccaggagggttttttgatgagcatcacactctgccctgatatgtattacacccttaagaagcagttacataaatgcattctataattatggaaaatgtatatatctatattttcccctacattttccctccccagggatatgaatagattttattttcagttaatagaaaaaaaaagaaaagagtttctgattcttgaaacaactgttgtagctgttttctacttagcaaaacagttatctgtagttaggaatggtacataatatatatttaaggatttttgtagagcttgagaattgttccccttgtttagtttcgtgtctataatgtaccttaaaaagatttctaagtgacaatcaacatataaatgcattaagaggagaactttaagaaagaaaacattatcttgggtttacaaatccaggatattagcataaagatataaatgtacagcatatataaaagataaaattgtttactacattttacacatacagctcacatctgatttctttttgcttttgttggagcattaatttgaaaatgataagcattctgaaatgtttgctacaacacaaattcatggtaaaaatatacatgcataggcaaaaattgaaatggagaacacaaagctacgtggcaatcagaatcgttgacaaaatctccatctagactatattttgcatgaactagtgtatcatagaaggggcaagaaatctctctgggggttttgtcatttacataattagaaacaaaaataaaatacaaatatctgctcccttactaccttttcttaataactgacaagtgacacaagtggtaccttttaaacagatggatgcaaaaacttgtgagatcgaatgaactgatgtaccccattggtattttgggaacccaaattccataattaactttttacccaagtggcaaaagtagaagatgttctagtcaccaaattgattatttgatggacttttgttctttcttccacaagattttggcgacccagaaagggtaaagacatgataagagaagatgcatcctgaacaacttttattgtgagtagaaaaaaaatagcataaagtgagcataagaacagttggatttggaaagattaaaagaggagaaaagagcaacatatgcaacttaactagtctttttctttttaattttttcatgtacatatatgtatatattgggatgatggggagaaaagataactggatttcttttgaatgtctttgtgtctttatagagtgaatgttctgttcctgtctctttctttttaggcgaaaaactaataaaaatagaaaaacatatatcagacattaagctcactccccccccccccacccttccctttgtaaagaactctttgttctctagtgaaaatgctgaaaaatccccgggcagctactccctgaaacaagtgcaaaacacttagaggcttttgggctggctgggagccagaaaccctcccgctgtctggttagaagaggaaaaaaagaagagagagggagagggagagaggggaagagggatggggggcagagagagaggaagagagagaggaagagagaggaaaagagaagggagagagagagagagagagagagagagagagagagaaattggagcttcctttaatagacataggaagcagcgtttttttctttcttttttttcaaaactggcggtcaagcgttaagtaactcccgtctaaatccacctgctagaaatgaacttgggtaaccccccaggggtgcacaaagacagggaagacagtaacatactccatactctttcccaccccccgttgtactgcttccattctttctgctctcatacacaaatgcccacagcttctcacgccgcccctcttaccccccaacaacaaacacagcaaaatacatgctccctcggtctcctaaaaaaaaaaaaaggcttttccatctcggttgcgacacagtgataaggggtagcgaacatctcatacctggtgtgaatgctaatcagtcaggagttctccttttcccaagacagggaactgtttccttccaaatttattagaacctcctccactgcctctttgaaaaaccttctttgtcaccctctcccaagtcccgatacttctttaaaaaaaaaatggcttcggagctccttctattcttgatattgattctctctctctccccccacccctcctcctctctcctgtctgtgtctcttctgagtggtctattgataagtccctggaggcactgggtcagcctgcccgtaggaaaccagacacaatgcacaaatctccgagtgccattctgccatcagcaagcagaccacgtttaggagagagagagaggaaaaaaaaacagtagagcaagagacagagagagagagagagagagagagacaccaaccgagggagggagagagagactgagagagaggaagagagagggggaagagagagaggggggggagagagagagagagagggagagagaggagagacggagagagagagtgtgtgagaaaaagactgattggaacaggagggagagagagagaaaaggagaaggagagagagcgcgagagggagagcggcactgccagtcaggttaatcatccctactttaattagctgttcggcttagacataaaacaattgaatttgaatgatctgtcagcaggctcggctgaaccaaaggggaaaagcgaatattacaaaaagactgttggtgtgttctgataagcaatactgctcgtactgacaaatcctcaaagggggaactattaaaacttacaactaaacaaaaagtgcaaatacaaatggcactagatagaggtctttaaaaaatggagttttctcctctagttttatgaaccatagatatttatgtgcaggtgccaacatattaggggttttcgtgtaatgtgtgaaagtttattaacgatggtctaggagtgtagcagacagatgctgcagagaacaagacaggtacagtcagatgccgaatctagatcttggagggagaaggatgctggaagaagaggcaccgtggcaagagatcagcacagacaaagtcagtgggcagataggcagacagattttaggcacggcacgatctcatctaaaaaggcaaaagttctgatgcaatattaggtacaaaacaatccatccatcctcctctcccgggtgcactccaaggtacagttaaaatggattaatctttgtgacaaacagagctggcaaggcagacactgaaggcgatttgcagacccagagaatacagagctagaaaaagccccagagatcaatctctccccctcccaatttagtagagaggaaactgaggcccagagtcgacactagacactaggactccaggagcccaccaggccagtgctctttccaccacaccagctaacctagagtattctttgaagatctggcccaacaggtatgaaaatcacccttacctcccaaataagaagattactccacctatatagttagtgcacaaacctccaatttctcaaaatgtttaaatagccaaatggaaatataattacatatataaatacatttccactttatatatatgtgtgtttatgtatatatatatatatggagagagagagagagagaccattttgaatgctaggaacaagggatttaagtctttaattcattctaggagaaaagcagaaaaatataatattgtagaggcctcgtctcagcaagatataacttgtgtcacattttcaagctaatgaaggctagtggtttgatctacaaagacctcaccctgaatttacaattcgctctatgaacatcatctgctatatatcaccaagtgagaagatgtggtttttctcatacacctcgtttctaaaatataggcacattgtgggtgaaagagattgagtctttcagcatactatgtagttttaaagcactgatgagattttccacctggagaattaggtatgtacaacctttccaatatatttcaattgaaaatgagctactaaaaaggggaaactatattttccgcccatgaaagtgatggtatctttttcgggacacatatgatcatgttcactaaggattcccttttgacaatgggtaattgaaggtccagtttttaaatggtgaaagaggtgcttatgaagagaacagtgccatcagatgttactggagagattaagtttcttgccctaaaacaagactcaggatgtgtatgaaaccgaaaactatctctcagtcatgcttcagcaacaacattgctacttagggagaaagaagaaaaccgaaagaaatgtcaggcacgtgggagcccactcaaagacaagtaatctgagagaagtcatagccagagtaatttagtttatttgcacaccaacctctttaacaatggctgctatgccatgcctaaaacacacggcctacagttgactgatttggaaagggggaaggaatcagtgattttgataatggcagatcctttggcaagccccaaaatacctgataggccagagcccagaagaaagcagtggagtgcttagtaaatgtctgttggtgaactgagaaaaaagaacaagagctttggagcaaacacatatttatatataacactgcaaaagtcacagctactctgaaagcctcagttttcctttctgtaaaaggtgatgatattggtcccatagagttgtcttaaggatgacatgaggaaacatataaagtacacagctagtcattacacggtagttattatggaggaaggtgtgtaaacaaaagtgtatattatggatgtgctgagtgtgttatattcaaagcatgtaggttcaagacatgaaagcatatagcaaagcaaggatctaatatacagatctctactagaaaggattggcagtagagattataaagtttagaactaaattcctaaaatctaaacttcaaggatgttaggtcatctggggttgtattatttctttgttcccagattttactatatttcctggctcataataataatgatggccaacatattactaattggcttgccctaagcagtctgctaaggactttacattttaaaatcatactttagcatcacaagaatcctatgaatgaggtactaccaatatccgcatttcatagaaaagaaaactgaggtatagaaagattgtgtaacttgctcaagatcacacgcctagcaagtgaggagctgggaattaaatccagccaatctgattttaaagcccgcattctcagccatggtactaaactggcacacagtaggtattcagtcaatgtgtgttgaatgaataagcaaataaaaaaaacactagaatttttatttcattggagatcagtaataatctgtgcaaaaccacttgagagaatcttgttttcgaattatagaatctgtccttcttctgtagctcacttcaggtgtagtcctttgtcagaaaccagggtgagccatgtccctgcatggtgctgaaaatggatgaagggaagagtgctgaccatgaccacccagggcatttaaatatctgacggcattttcagcactttgaggacagtgttagcacaagggttattaattggcttaattccagttcggataattacatcgtgtctctttaattttcccccgactatgccattcttcacttcctgtcacaaatgtgctctttaaaaaagcatacgaatacacacaaacatatagttatatttaaggtttgcataatcatttagggtgcttttttttctaaatgatcagtgtatagtagctatgtaataaatgaatgggcaaaagaattaaagtcattgtaaaataaagataactagttgaagctttttgtttggcaatgaaacagatttttaaaacatttccttggtgacagaattccaatcacatttttttctcatgggcagatatttccagagctgatgacctgctcatgataagctgattttcttacactatgtagtttccagtataaaaaaataccaatgaaaacttcgatattttagagtagaaaatgagactaagtcctgagtggtagagcatactgaacgtacgggttttcagtgaattattaacccatttattagctctgacttacttgacaggttttttttttttatctccaaacatatcactagaataatcttcaaattatgaaagaaaaggacaacatatcctaatttaataagcttaggaaagtttgacagtcataaacagacacaactccttttcctttttccaaagaattcttggcctttgaaatactgtgcctgcattatactaaagaaacactcccagaaaaatatgcttaaaacatgtacacaaataggtaaatgcacccatggtagaccatagtttattaggcctttttagtgtacatttgtatgaataagtcatcaaatatagggagtgtggaaaataagagaataaagggttaatttatttattatgcaggaaggtttctagatctttgctccttcagcttttagttcaaaattccatgcatattctgcacataataataaatgccataattcaacgtatctcataatttgatttactttcaagcacctttttttctggttcagctcttgaagccttccttcttataaacttcctccaagttattttttgtagcgctctgtaaaatatcatttaaagttggtgttcataagataaccctcatgctatagagagatttgtatcaaactagtccatatttccttttgagaaccagtggtcaagtcccatgctcttatctgagaacaagccacaataaatatataaaacagccctttcccacctgtttgacccctgtaataatgatagcagtctctcagtgactgccctctggttagttactcattccttaagactgagctcttccaggacaaggtctttccattctaccttgtatatttaatgtattgtccagcatcacacctgccatggtggtagatgatctcccagaaaagctggaagcaacaaattttaattccctttgttcttcatgagtaaatacaaatttttctctctgtgtgtcaagttttcaacatgtaaaaggggcatactttatcctaagattagtgatttgatgttcagaaaataatattggagggtatagtatttaagaattagctagtgaaaagcacttgttttggttattttcatagtatcgccactatttttatagcaagaagtacttagaaaacatgttttaaattcaaaatttaggtgaattttgaattcaaaagaaaagtggacaagatttatcctgaatattagagatagtaagcacttggtttttaaatgccatttaggaacagcctgacagattttatacaagcagaaggtatttaggaaattctctggttctctcagtttacagagaagagctgagtggcagagatattttatctgacaagcttaaggtaaaaaaacttggtagaagtgaactagtgctggaacccagtctgtctgtccctggttccacactcttctcactcatactttgaaagatggcttttatactcttgactccagatcccctcttttttggacatattttactgacggaactcttaaattctggtgctgataaaggggtacaatattcctaatgtagtctgataaacacactacaaaggaactatagtaggctgaggaatggccccccccaaaagatatccatgtcctaatccccagaacctttgaatgttaccttacgtggcaaaggggtcttgcaaatatgattaaattaaggctattaaaatgaggagattatcctggattttctaggtggactctaactgtaatcacaaaggttcttataagagagaggcaggaggatcagagttagcagatgtgatgacagaaacaagaggttggggttatttgaagaaggggtcatgcaccaaggagtgcagggtcctccaaaagatagaaaaggcaaataaatggatcctcctttatagccgctaaaaggaaccagccctcccaacacctttactttagtacagtgaaactgatttgagacttctggtttcagaactgtaagagaatacatttgcattgttttaaaccaccaagcttgtggtaatttgttataacagccataggaaattaacacagggaccatcagctaccttgatctggacataatctttcaacacagttgaaatatttcttagctctttaaaaaattattttagcagatatattaccttactggttcaaactgagcttgtgatacaagaacccttaccagtcttcagaaaaatattgactaggataagtcaaggagggtcttttctcctgacactaagagcttccttctaagttgacataaagcaatcaatctaatgattattggttaattgatcagttggctgcagatccatctaatcacatttgcccacctcctgtcttatagtaactcttcactggtggtttggcaattgtatctccaagttaatctacaacagtagttctagttagaagcaaagagaagggtttcagtgtccatttcttgagtgccagagacctgaactcattcagaagtgagtgctctcttgctagacccccaccccacatttttttctgagctttcttaacagaggtcagaaaaaagaagcatgaggcagcttaggcaaaaaacaaacaaaacaatctcctcccccccccctctttttttttgagacagggtcttgctctgtcaccgaggctggagtgcactggtggtgtgatcacagctcactgcaacctcaaccacctgagctcaaggaatcctccagcctcagcatccagagtagctgggtgtgaccacaggtgtgtgccaccatgccaggctaatttttaaatttttgtagtgatgaggttttgctatgttgctcaggctggtctcaaactcctggcctcaaatggtcctcccacttgggcctcctaaagtgctggattacaggtgtgagccactgcgcccagcccctatccaaactttaataagactcttttgccatagtgtatcattgccattcagttaccgcttacattctataggatagtgctcctaaaagagtagtccttgggccagcagcatcagcattgcctagaaacttgttagacacgtaacttattgtgtcttattctagacctactgaatcagatgctcagaggtggatgtctgagtgtgtatattttaacaagccctttaggtaattctaaagcctagctgagaacaattgtcataggacaaatctgtgaggctcatcaaggctaatgaaaaaacacgttggactcagagtgagatcacctgctaatctaggtgtcatggtgactctgtcatttgccagctatgtgactttagattatgttcttagtctatttgtctcatctgtaagatggaaataataataattaataataataataaattgctttatgtgaaaagttaatgtagaagttaacaagatcatgcatatgaaaacactttacaacctcagggttattattgtagaagaaacatcaatttggattgcaagtatcctaggaccacattgttggtgatattgccttgatatttcatattaactagggctcccaggtagtaatactgaaaaaaagttcaagaagctccagatgtccaattctccaggccaaaataaaggctggaagtctgtagatgtttaaagggtgtgatgctgaatggaggatctgctggcattattagtctctagaaccaagtgctaaatttcttgatttgaaagtctacctttctatttatcaggtagcagaatttagtgacagctttgaattctgtatgccagtgaaagtctatggcttgtgggattcagaaccacaattttttatcaatttccaatgacactcagttttagtaaagtggcccatgatctcttgcatttccataccatattctcaaataagtaagaagctccagggagctcgctcaacaattgattatggtcacatattttttcaatagaaaatatgtatatcctggtaggtgggaaggatggtcctgatcaggactgagatctttttagaggttcaagtccaaactcttagtaggttgaagggaactcagatgcaaccagattagacacaactatgattttcatggaaaatcatcagaattttatccaatctctgagtaatgaaaatttgcagtatttctcaacagctctatatatgtggagaaaaccacctcataagaaagctaaccatgtcttttccttctttcatgaaataatagtgacgtatgcctcttggcctgaggactcgtccttcctctgaagactaatgtctgcacgtcaccttttggcaacccctctgtgccttgcaggacagttgtgtagcaaagattctgtttgggttgctgtttcctctgagccagtcacactggtgcatcaggagatgcagctgcaccttttaagagctctgtgtccttaagcaagtcatctgtccttttacatttcatagatttttcatttgtaaaatatgaataatatgtgccttaccaatcttacaaattgttctgaagatcaaaatggatgatgtatccaaaatgctttgtaaactaagaatctcattcggttggtgttactgatgttgttattatttactctttagcaggagagtaaagatatatacagacatattgggtacggtagcttgaatatttttagacatctacgttgtatatgcctccaaggtttccccctgaacttacattaatccctttttcaggttacagctaaggtggtaactaaggatgttaatttcctttaggtccctataggatctctattttgatcatgattagtttatacatgaaatagacactgctgcagaatttacaatgtttccattctggccaactcaactttgaacatattccctaagtaagaacaaattcagtactataacactgaagaaaacatagcatccgaagctggtattgagggagtgaaaatatcttcaaaggctttttcttgattgcttaatataaaaaatctgcttagaaatgtccactagttcaacaagcattcctgaaggaaatctgtaacaaagctactgtgcattaacatttaaaagaacaggaacatgtagtctacctcaaaacaaattattattgcttgaattgcccaaactttgttaaccaaaattgaatttcgcctaagttgaattcatgtgaagagctcataatgcattgttgctatttagatagttgtcatagtatgtggtactcagtaagtcctctaaaatggaagggaaattaactacatggtataatttcaacataagtcattaatataattgtgcgaagaatatctctgaatatattgaactgctatttgaatctttaattgtgcatacaattctaccttttctgctatgcatccttaactagactatatgctccctgaggacaattcctgatttacacatctccaaatttcccgctgccttcagtacagtggtttacaagtagcatttgctttcaaactatctgctgtttaattatattcactttttattggcttttcttggggggcaatttatgcacataaagtgtccatagataaatgcatcattatcactgaggtgaaagttgtgattcttaatttttttaaaaaaacatatacattgggccacttatttttcctgtgtgacactcaatctaattatagaagtgaatagaaaaacatgatctcttttaaaaggcgcactttacgtgaaacaattttaggaattcagcttatgtgtcaagtacagtcattctgcacagtgatggtgatggggaggctctatgtactatggttttgacagaaaatattttaacttaaagccagctacccataaaattacgtaaacataaatatgcactctcccacaaacacatttgcacatctttaaacttagattaatgcaaagaaaagatatattcttttgttctagtggaatacaaatgataaagactaataaatgaataaataaagctctaggtaaccaaatcaatgtctgctcaattctggtcaaggaggtgaagggaggtttccctttgagtcagagaatgtagtggataaaaaggacatgaatagctggggggatttcctgaggccattgtagaccagctcacacactgttaagaggctcattttcatgagacttttggttgcatttgtaacacttgctctaggtcccctagagcattgagtgccacatcacagcactacaataacaggactaaatgcaagaaggtacattacaaggttctttttctttcagctctgaatatccaggagtttgtagatgttctcaagactttttttccccttcgtttttccttctcccccaacccccacacactcccttcaaatagaactaagtggaaaggactgttttgtttttaggtaaaaacctaaattcttgtacttaaaaaaaaaaaagccagttgtaaaatctgtaatataattaattatttccataggtaagagatattttattttttataaaacctggtctgactggtaagtttgttctagattaaggatttagctacagtttggtgagtgtttgttctctgttaggcttggtgcatattaattcgtacatattttaacatttcactactgtattaaattattaataatttgaaatcattagcttgtactgacaccatttttctgaaacagtaccacctgtttcttctaagtttggtccagaacaaaagtctgaaatctaatttgtcaagaaaacaaatgtgtagttcagaaaaaggataggggccaggtgcggtggctcatgcctgtaatcccagcactttgggaggccgaggcgggtggatcacctgaggtcaggaattcaagaccagcctggccaatatgatgaaaccccgtttctactaaaaatacaaaaattagccaggcatggtggcacacgcctgtaatcccagctactcaggagtctgaggcaggagaatcgcttgaacccaggagccggaggttgcagtgagccgagatcgcaccattgcactccagcctgagtgacagagtgagattctgtcttaaaaaaaaaaaagaaagaaagaaaagaaagggataggaatcaccaaaagaaggaggtccaaagtccaatgttaggatgattatgctcatgacacggccatttaatctttaaaacaaatataaaagacaggtattccctgtggcagagctgagctttacctcaggtctgtgtgacagagtctcatctcttctcttatacatcctcaatcttcagacatttaaggtctctgagtatccaggatttcctttgcgacaataattaacaaatacatgtatgtacatttgtgtgtgtgcattatgttttaagcatatatatatatatgcaggaaactcacatctggagtaccagagtctacaggccaggactagatacttagatctctagggaagtgatccaaatatctagttgcagctatgtagatttcaagaatgcagtgaggggagaaagagtatacttaatatatgagtacatatacactatatatatcccatatatgtatgacatatgtaactaataatagtcaaccctcactaacacaatgtgcctaatattattgtaagcacttcacaccccgttactttgttctcataacatctaaggtaggcatcattattattatcatctagttttacagatgagacaagcaaggcacacaactaataagtggcacagtccaagttcctatctgtgatcctgtctttttcatggaccttttcctatctgttgcctccatgagaacatatctgaactttggcctattcttttttaagactttgctccctcttaggagataacaagtagcagaactcacatgttacccagccaatagtgtacttagcttgggaacaaaagactaaatttgtggaaattcctcacatttgtacaagagaacgtcccaaagcaagatactatggcctggaaaatggaagagatagtttgggcaggtggatgttttgggtctcccaaatcacaacacatgtgcaatgcgcaaccatcaatacataaatccaatttaattcagtatatatttaataagcacctgctgtgagcaagggactctgctaggacctaagctctagaaagtagctacaaagattagaagcaataatcctaatatttagaacatgggagaaaagaaataccacataactaaaacacgatgcaaataagttaataccgtaaagcgttgctaaaaaaaatctgtaggtttcagtgacttgaggaatatcatttgctattcagcggtggacactgacaaagttacctgaagcaggcagtgtttgagatggactttggaatgtgggaaaattccaacaattagaaattggagagataggttttaggcaagggaaacagaaagagtcaaagcaagggataggaaagcacaaactgtgtctggggtcaatttgactagcttctagactactcaaaggatagcagtaggagtttgagatgttgtgggtgaaacatgtggaaatgtccattgagcagcaggaaacccacatgtgcagtaccagagtctacaggccaggactagatacttagatctctagggaagtgctccaaacatctagttgaagctatgtggatttcatgaaactgtccacagatttcaagaatgcagtgaggagagaaagacagacaaacttacattttgtgggcagataaagggaggatggatgaaagatcattcagatgaacaggagaaccataaaaacagacgctatagagtgtaaaggtgaagaatgcttcaaatgcttcaagaattagagatagatagtcaaaacaatcaaatcataaacaggatacctaggattgctgtgaggaagaggtatatttaagagctagagtcttcatcactgtactcatctttgaaaggaccacctcttattgctttctaccctttccctaaactcaagcatgcatacaatcacacacataaacaaacattattttttcctaggaaaaatgttggcattattaactctgaagcaaaactatatctggaagtttttagagtagttagcaagatccaaactttatggtttgattttaattcaaaagataactgaatttttatatgcaggttaattattccttggtgggaatgtgaatttatttgtattttattcaggaagtatttttgagcatttcctaactccaaggtattgtgctaaacgctgggatcagaaaaatttccataaatgcttggatggcttttacctgggagcactccttcctatggttggcaaaaagctgacgcctttgtgatgatgagtttcagtcctagcctctaagagtttttgtggtcatgttattaagtgcaatgtttatgtgtattttttctgttccaagattttttttaaagttttgaatatttttttatgtcaccaaaaggtgctttagaagaacaaactaactcaaagccaacacagaaactggttctcttgctttgccaaagtggcagtgtagcatgtgggcaagtaagaatacttttctcaagtatttaaaacaactacagaaatcttattcttcattgtattctctaaagaataaaggtaagaaggaaaatcaggttttgatagagaattaaaaaatagctttagcatatgttcaaaccattaggtcaaaagggactaacaaagccctgtagaaggggacccacaaaagctgcccttgggacttacttattcacttatttgtttatattttttgtatatgtacatatttttctgatactgctttgacacatcactttagctctttttctatatgtatgaatattcttctcctacaacataggaatcttgatgtatacatagtttagtaatctgcattcattctttcaagataaacatttttaatcctacatggtattctattctaaggatataccagcataaaatacaatttaaacaatcacctatttttggacattttggttgcattctgacttttattcttttcaataattctttgtccagtatcattgggcatagtctttgcaatgctattatttaatgaaaagaaaattttggaaactttaacaggtaataccacaagcgaggaaacttaatacaacgaccacaagcaatgaaagaaaagtcaaatgcctcaaggagccagggtggaagagcaaatgagtgaagtaggtgtggcataaaatatggggtgatagggactttgtcaaactggagagaacatggtttgtctgaagtgagcagctgctactcagttccagatattggtgccacatgtggatgcagatctaatgttgtcagatctccaatttttcaagagaagcaaaaaaaaaaaaaaaaaaaaaaaaatctagtttttttttggtgtgaaatctctttaaccttaaaggttggctcaaattattttaaatattctgtggaccaaacatacattttaaaaaattctatctgctagctagatgcagctcataggccactgatttgtaactttctaattaaagaaagggcaagacggtgtttggaaatatatttctaggtagagagttaagcaaataaagttttacttcaagttttcctagtcacaaggaatgtaatgtggagagactgaacctcaatgtgcaaatcttgaaagatgggtaaatactgctccccacttaacacccatgaagaatttaatagaagaggggtctaaaatgcttttaatttcacaaagaaacatgctttaatgatataaaactctaacccagtgcactgtatgatgatatctaatgataatttcccttcatttcccatctgaacaaacatttcccattaacatccacctgcactacttcctttcataaagaggaggtggtatttggctatgttctggttctgattcatgagaaatcagcccaagcccaacatttctgttcttaacagattttggtttttaaatctgtagaacacaatgtttccctgggctgagttctagcatgccaagttttggctggccacagactttgacatctgagtgaaaaatctttcaacaatggcatttaaactgaagaatcaacagacctttaattataacactgcttgtaattccctccctctcttatcatgatgttcaaattgcctcaaatcactaactgcatggacagcatgttatttcatttgccattggaaatatcataattttaaaacttgggggcttgagattgtgcattaatttttgaaaaatcagtattacttattcaccataaattaaagaggcatatggaacgaaggtcaaaattactgattcattagaaataaaaaacaaaaaccactcaccacacaatttctcaacttatctaaaatgctcaagatttagattaaaaacaatatttccacttggaaattaagcattaaagatatagaaaaagggagtctctttttagtgagatttcactaaatacctctggtatctctccataaaatgttaggtgatcatttcttaacagctttttaaaaatgacacagtctcagattaccctatgtttcccttatataataacaaaagacacttttatactactaaagtacattaggaatcctttgaaagtttctgttttagaaactgatgttgaaaaagtacttaatttatatttaacctgcctatctgaatatacttagtggaaaaattagggttaaaaatgtaaatgtggaaaatgtttatttccatgttttatagtagttagttttttatttgcttttaaatatagatcttggttatatgtggaagacaggcataatttcagctcctttttcatcttgaagagaaacctggctctcaatttccaggaaatatatttatttagacctaacaatataccagaattttatgcattatttctaatcttcataataagtctacaagttgggtgtcattaatctgttactgataaggaaattgaaactcaaataaatttaatgcttttaccaaggtgatttagttagtgtctttttgtccatggattttaagtggtagaatttgcatgcaaacccagatatgactccaacggctctgctttctcctttagaagaaaaaaactccttcctgaaatactaacatcttttctttgtgtaattgaccatcctttcttaatacaattggttatcagagctatcatattcttaattatcagtattaccttacgactctaaaattcatctttgtccagtgtatagaattcacatcctaaggttagatataggagattaagtctctgatctcctggagcagacctggtttcaaatcttgtcttttattatccccataaatatgcatgtatttataaaattatgtcctaagtctttgttcagaaaatatgtagtgtctgacattattttgtgtataaaatgctgaaaaggtcacatccaggaaactagtcctgaccagcatacaacactcaagaaaggttctccaaggtagaatcaggggagaatcccaattgaagttgttgaggggagtaaagataataaataatattaacaataataactccatgcattgaactcttaatattcttcatcctatctatatatcatatttaatttttacactactcccattttgcgtgtgagaaaacagaggcttagagatggtaaataactagttcaaggtcacatgactagtggcattttactccagagctttgctttttgtactttgctaaactctctcccagaatatgggaacaaaatctaaagaggtaaattcaaagatcaatattaagatgataaatacaagatgcagccaggaatcaggaattggagtgggaacagatgaggaaacaaggtggtgggtccagcagggttgcatggttgaagtcagcaaatgtctgatatatgggggtgtcatgtcacattgaaagtacagctacatcagggaggtggagcgactgagagaatatgtagagggtgacagatataggactgcttggctgatttcatgtttttcctttacaaatgtaaataaaacattgtgtgttggaggtcagagggcaaaggagatataactgaggactctactcaaaaaaacatctcgcttcatgtgtcattaactgaacaggggaaagaaactcagttgtctaacaagatatttttaaaatatttatttctccaagagggttaaacctcatttacaccttggagtaaattactttaataaggttaccagatcacctaactgaatgtaactaaagtcaagaagctgcagtttgaatggggaaaggaaatggataactgtggaactgaagggtgggagaaggggatgatagtgacacaagcaaggataaaaaggatttccttaggcgaataggagggcaccaaagataattttatgaaaagacagttcagggctaaataaatgtaaagtactaacatcatcattatcactagttctactctgcacttatgtctagaatttttgtagtagccagtgtacagacaaaatcactaaaattggttgctaatttctgatttacaagctgagcagaattccctacttagagtaactcctcaaaacatacttgttgagcaaaatgggacgtcaaaattttgcctggaagttggaaactttcagattttccaaattccaacctgtttttacagtctaggttaatccagtctaacctatcaagttcatctaactgggtcctccctgggaaaaaggaagaaagaggacataggaagtgaataaagaattgatacctcagctgggcgcgcagtggctcatgcctttaatctcagcactttgggaggccaaggcgggcacatcacctgaggtcaggtgttcaagatcagcctgaccaacttggtgaaaccccgtctttactaaatataaaacttagccgggcgtggtggtgcaggcctgtaatcctagctgcttcggaggctgaggcaggagaattgcttgaacctgggaggtggaggttgcagtgagccgagattgtgccattgcactccagcctggacaacaagagcgaaactccatctcagaagaaaaaaaaaaaagatacctcactgctctccttcccttctgtgtggcccaatacagcatgctgttgaccctggggaagcttcagaatgtatgatctaggaaagctgaggcaatgctgtaataacaagagctatgtgaaaggtaaagtatgaaatgtatgatggaaaccaaaccaaagagggtatgttaaagataagcccattaaggaaatagctcacctgttggactggaatctcaactggctcttttatttcacgctaaacctgtgctgagtctgcacagaaggacttctgaaatgcttatatatacaacctgacaggtacaatcagaaacagtacaaggactgcgtgcctcaacaagaatagccagagcactgaaatcaattgcagagcacagacatacttcaactgtggctatgcagacagtccccaggtatggctggtgaacagcacgctttatgtgtgctatgtcccagacttcctggctttcttcccttccgtcctaccccttcggcacacactacatatctttcacattttataaaatcacaggagatttccaaattattgtgtctttcaaatactttaaaaatatattgtcctcctaatataaaggagagaggtggagtatttagctgatgaactgaatttgaaagtaagtttgcatttttgatatatttccttccttatgagtgagtcatgaaaaatgcatattttgtctaaatattgataaagctttagaatataagagctggagtgaacctaagaggttttgtagcccggcaatttccaacccaggatgtgtctcagaatcacatagagaggtttcagattcccagccaggcacagtggaatgtggctgtagtcctggtgactgggaaggctgaggcaggaggatcactggacccccagagtttgaggccagcctggggcaacatggtgagacccctgtctctaaaaaataaaaagtaagtagaaaatacaaatcacagattcctgggccttttccttcccctgccttccccaagtgattctaattctatgtcagttttggctgcttgcaaccagttatggagaccagggatcttgatcaatctcttcatctatctgatgaggaatctgagacccagagaagtaagaggtacagtgatttctctaaggttacacagtgtatgagtccatttgcacactgctgataaatacatacccaagattgggaagaaaaagaggtttaatggactcacagttccatgtggctggagaggcctcacaatcatggcagaaggcaaggaggagcaagtcacatcttacatggtggcagagaagagagagcttatgcagggaaactccccttttcaaaaccatcagatctcttgagacttattcactatcatgagaatagcacaggaaagacaagccccctgattcaattacctccctctgggtctctcccacatgtgggaattgtgggagatacaattcaagaggaggtttgggtgggggtacagccaaaccatatcccacaggaatatgttacaagtgaagatagtctatggacactgtaaaattgaccccattagctatatcccaaactagttcattattttagaatctattttgtgtgtttgcatgcatacagcaatgcttcacatatctgcacaccacttatgtggcattccaaatatggttaagaacaaacaaagtgaaaaagacctgcaagcagccaaaattggtactaaataaaccacacataatcctccaagtctttttaaaagcctcttctcttgcttctctatctagtgaggcataggtgactcaaaatctttatctccaagcccggcccttctgctgcactatagtgtcgtgtctccaaaagcctagtggaccactcacagatacccagtcggcaccttcactcagtgtgttcaaaattaaacgtgtgctttcccctcccaacccttctcctgctttgctgctctgtttatgactctactaaggttcaaaatcatagagatgtgtttggtgtcttcctctcccttgctccccaaatataatggattaattctcccgccacatttcataaatcagtttgccatctctgttcattccctctgcccctgccctagttagtgccttcattgcctttcacctggactattgtaatagtctcctgcctgatcttgtgtcctctggtctctccctactccaatccattttactcactgttgccagattaatcttcctgaggcacagctctgattatgttactctcctactaaaaactttcaatagctccccactgtctcctgaataaagtccaaattccttgccctaataatcaagtcctttcactttctggtcccaatatacttttaccgctttatttcccactacttatcttcacacattccatgctcaagttaaactcaattacttctttgcagaatctttaccctttgattcttccatgcttttctcatgatagagtaatgttctttccttctatctctgtatgctcaaatcctgcttgtttttcaaagcccaaatccagtgtcatcttttctgatgaagccctcagttagccctcctctgagctccaagaataccttatctgtactacttttatagagcatttcacttttcactattaattctagcaaagtagacacatgtctcagctccgttgctagattaaaacttctagggcaagacatgtcttatctgtgtatcctctccagtgccaagtatacaagtgcacgactcacaatatttgtcaagtgaatgagttcatgtatgtactttacacacaatcaaaacatgtttttttgttttattgtctaaagaagattagaaataatgcatcagagaaggaatgaggatcttagagacttgcacaacagaaagtaacttaatagctaaagaagaaaaataaaaactacgaaaagaaggcatgagaactaaagatatagcagtcagagggtaaagaaacacagaagcaaataatcttatagaataaggaccaaatggttaattgagaagcttggaaaccataaaataacattcaaatatgtagcattatttttatacttccacaccctcatcaatagaaacaaatttgaattgtagttcaagataacaaccctgaatcatttagaaaagtttgaattatggtaagtatattcttttttttgagatggagtcttactctgtgaggctaggtaaataagctgcctttattaatgaagaaattcatatttttctgaatattagagaaatattaatttttcccaattaagatatgttcatgatatacaatttagaaaatataggagagtaataaaaaatcttaaaaatcctaaaaaaggtgggattataccatatgtattactatgtatgctgccttttaacttaatatatagtataaatagttcatactattataggttcttcataaacatttactggctcaaaattctatctaatagatatgtcgtactatacttaacacagcactctagagttgaacatctagcttatttccagttttataatacaaatatgtctaacaagatttaccatgggctgacaactgttgaagcagagtgaggaactcatgagagttcactatgatattcttcctacttttgtatatgtttgaaatatctagaacaaaaaggtaaaaaagcatatttatgtcttaattcatttgtgttgctgtaacagaatattataaactggctaatttaaaaagaaaaaatatatttctcacagttctggaggttgggatgtctagtatgaaggtactggcatctggtgagggccttcttgctagatcatcccatggtggaaggcagagggcaagagagcacaaaagccagagagcaagaaggagccaaactcacttctataatgaacccactctcatgataactaatgcacacactcctgcagtggtggcattcattcattcatgaaggcagagccctcatgactgaatcacctcttattaggccccaccttccaacactgttgcatcagagattaagtgtccaacacaagaacttttggagacacagtcaagccacagccatatgataaatatcttgtgcataatggcttttgtttacttgtaattattttcttaggttgcagtttagggctagactgcctggatcaaagtcttaccccatcattacctagttatctaaccttgggcaagctgctgatgctttctcagcttcagttttctcatttgaaaaatgggtataatggtaacttataggggctgttctaaggatcataagagaagatgtgcttctaatcccttccacagtacctagaacactgttagtgtgcaataaatgtcacctttgaaaaagcaaaatactggttgcataattatgcgttgtgcttataaagaaacatcacatataaactgaaaaacatacctgaaataacatgcttaagtgtgcaccatttctatctccaggctaaatgcttatttcaaagatacgaccactgctaaaataatttagatccataattaccattacgaagcattttctatgtggttgatattggccttactgggctacatgtttgatgtgtactatctcatttaatcatcataagagttttctgattactttatagataaagaaactgatgcttaaaggtgaattaatgtgcccaaaaggacacagggtctgttttcaaacacaggattgaacctctggaattcatctctaagctactgaaaatgacctttgttccctgcactttttttttttttttttttttttgagatggagtttcgctcttgttgcccaggctggagttcaatggcacgatctcagctcaccgcaacctctgcctcctcggttcaagcgattctcctgcctcagcctcccgagtatctgggattacaggcgcccaacaccacgcctggctaattttgtatttttagtagagacggggtttttccatgttggtcatgctgggcttgaactcctgacctcaggtgatccgcctgcctcagccttccaaagtgctggcattacaggcatgagccaccgcgcccggtccgtaccctgcactcttttgcatagacttcagtctttctttctttcttttcttttttcttttctctctctcttcttccttccttccttttttctttctttctttctttcttctttccttctttctttctttctctgtctctctctctctctctctccctcccaccctccctctctctctctctctctctttctttcttttttttgaggcagagtttcattcttgttgcccaggctgcagtgcaatggcgcgatcttggctcaccgcaacccctgcctcctgggttcatgagttctcctgagtagctgggattacaggcatgcgccaccacggctggctaattttgtattcttagtagagacagagtttctccatgttggtcaggctggtctcgaactcctgacctcaggtgatccgcctgcctcggcctcccaaagtgctgggattacaggcgtgagccaccacacccagcctagacttcagtgtttctaatctttattcctcagaggcagatatgaattttggacaaagttttggtccaattttggatgtttaactggacctttgggtaaagtacctttctccttcccattcactttaatcagaattatttatttaacaaattttattctagcaaacaattttagagaagaaaaagtagtactccataacaagctgctcttaaaaatgcatatctcattctggaaaaactaatagctatcatggttttaaacaataattttccattggtttgattatcttatgtccactgtgaaacaacagttcattattaaacaattcattatcaaacacacaaacacatatacacatttaataactttaaaacagtccatatttacatattttactttaaatatgtaatctgaaatgtgtatgcatatgtgtatgtgtgagagtaagacatagaccccggaagtctgaatttggaaaaaccctgtgaaagtctgaaaaaggtggttttctacaaaccttatgaaaaattaagtcatagaaggtcacaattttaaaaaatagataccaaattaagtattttattctgggtttagggaggcttctcctgtgcaacatactttagaccaaggcagtcaagaaatactaaaggggatgctgcaattcctctgcctcagacagtacatttatgcatctgtattataaaaaatgtgccagctctagcaagctcacagtactgagcaaagtgctatagttacagctggctctgtttactctttttttttctggtctgttcctctattgggggggggccacagtagggtgttttttcaggatggggggaagaaggaaggagtttttgtgagttctattttggattttggtgaataagaaagcagagaatttgctagcctgttactcagttacactgaaacatgatgcaaactgactcaatttggagcacagaaggtgctgaaaaatttttctaaggaggtcttgaaatatctaagtctgccttcaaggaaggacttataaaaaaaaatcaccatgtaaataatagaagtatgttgctacttctcttaaacctgacctcttaagtcactactcacactaatatactctaaaagtagccagcatgatatttcaaaaattactttgtgtcctttatcctcagtagagtattaagaggaagatgcttgagtgtagacacacatgtgggtcttctttacaaagtcacgtctacatatgtacaccgttagaagtatgggctctaaatgattgaacaagctgtatttccatatttgtattgtccaacctattttcttttttcttattttcctgaatatgtctgaatatatgtgttcagtataaacatacaattgtgtggacgtgtctatgtgtgtttctaattctatactatcttgaaaatggctcagcgttctagaaatacagccacataatttgttttgttttgaaaaactgctcagcaaatgcatacaggtcataatggcaggtaacagaccatttattgaagtgctgaaacaaatagaaaacaaagtccaggacaccatcacagagcagtacttcccttgtgagatactctcagctaagtaagaattgagtgagacaacaataaaacaaatacccataggcttttcaaacagtaacaacccgctcagggttagcagcatttctagaccttgatggtacaatgatgttctcaacctttgctttcagacactggatcactgcttaagtagcctttatcttttccccctaatttttgttgaagatgcccttgaaattagattatatttgttcctaacaaagcatatgtatattgtggcatcactcttaaaaccaacaattgggcttagttttatgaagaaaaaaaatccaccaacctttcatgctgagatttctcatgctagttctcagcacagaagtgattttttttttttaagttgcataaagcctagcaaggtttaagttttcccagcaaggagaaagtgtttttcagctgttaaatttttcagatgctttttttgaatttggataaaactcaaaaacatgtttgttttaaaatgtaaaccttttcatgtacagaggtttgcatatagagaaatgctattactatgtttaaagatacttgcttttgaaataaggaggtcacatgcatttaaaaataacaaactgcatgttgctttatgaatgtcctattaagccctaacgtaaatatgatgttctggaggagcactgatgcacacgtttgctgataggatcacttacaacactgcttgtggatgtatttccatgtgagagcaaagggtggtcaggtttgaactgaagaacatccatatagtcagctaatatgctttttaaagaccttttacctcagttgcaacacacttctttgtcctaaacctgctggattactcaacttgttggctggactaaagctgacacaatacatatttcaagcacaaaaatgatgaggaacacatagggatgtcagcaaagaggcaaagaggatggtaagtcatcggaaggctggtcatttttttttttttaaacagttcaatgtctttactgttttctgtaatattatcattttccatttttcaaacaatggaaagaacaacaattagtttcatttttaaaattattagatcataaaggacaagtttaggaatattgtttctagcatactaatagatgaagttagttgtaaatcaatagtcttatttctctgttttaaaaaaatagcaaaatacagtattctgaggaaagttctgacagattggagtgttacaggatagtctgaaatctgtttcattatagaagtttggccaatatagagataatatattttaaatggcttaagtatatattttttgtggattgcacattctgtaagacggtttgagtgccttgagatccaagtctttaggtcaagactgaactctagaaatggccccatcgaatctacaaaaggatacattaaaaaaaaaaaaaacctcatttcctgtaagctgctgatgctactcaacagagttgaaactcaggtcacacgcatcctactactctagtgctgccccatttactaatccaaacgaggataaaccctgagagatccgttatgtttctacataaggagtgtacaagcttctcttgaaaatcattgcattgggagagacacagagaaataacagaggtgagaatccctccccgatttgcttgctaaatccgtattcattcctgaagatccagatcaaataccacctgactgttaggccttctctgagaaactctattttgcaggcaagtattggaacgactctatgcgcatctccagtcccaatgcatcctttaaataatctgtttcctctctgtttcttgctgcattacagacatctgtgttacacatccatccttccctaatagtcagtggactcttttaggtgaaggactgtgtctctatgtccctatgctgaaaggacaatgggaagagatggtgctattgatgcccagaggcctgggtcaccagggaagctggagtcacagcaggtttgttcagagggagtaaaccacaaaggaaatgtggctggtgatgatgatgatgcaaagaacggtgggggaaatctctggcctatgccttctactgaccctcttgccactcacaagtgtctcacaagcaccaaatccaacttggaatctagctgacatgggtcagccactgttgtagagcaagggtagggtgagggttgggtctgagggtaaacacatccacaatgtgggagcaggaagatgtctttgcaggggggtgtctaggactatggacttaagataacctcacagggtcaccatgccccagcatgacccagaagggcccagagcaaggaagacatgacaaaggagcctgaagacttgaggaggccttggagctgggacaaggaagacacatcagggatctacatggacaggaaactaaagatgaggtgggctctcagacatctcagggaatttgagctcagaagacaacactgagaagaccagacaccatagtgagtagactgtatctaactgctctccaccctcactttcatattgcatttggatggcactccaaggaaggggagaggagaccacctagcagaatggaggccaaatctgagttacctcatagataaggaaagaaggcctgtgatttttaatgggtcagtcactcttaaattttaagcaaactgtagattttctgaataggagaagatattatcttaatctacacaaattttttgttgtttttttggcagggtttaaaatatttttattcatgacttatagtagaaactacattttatattgtgacccagtaactgtttacacacatacatggatgtatgtgtgtgttctggaggtagaaagtaaccaatctgctcaaattttaaatattaagattattcataattctttaagtagtttattgtttggaaagttatagaccaaggtctagaaattcagcagacctctaacctctaatcaaggacttttaaaaattaagaacagtacctgattttctgatttagtctttgaaatgccagtgctattcattctttgccttattcactcataattatttattcattctccaaacatttattgagagcttactgtatgctttatactatagacctgcagcacaaatataggcctattacttcacagctgctttaggatttatagcagtactggtcagatagttcttaaaaaggaaaagttttcagagtgcaacaacctgttcacaataattcctatgtagcagtgaagagccttgacagcatctcttttactttctcattgtggttctagtttaataacataagtctatttttacttttcatatttaactttaattaaacatgctatgagtgcaatcatgagattttaataaattagactatttgaaaataattttcccataatgatgtcttcctcatatctttcatgatacacaaaaagaatatttgtacaaatattttgttgcttcaaatatgcagaaaactgaccattatttacagtgattttgaaaataaatgagtgaaagcatgcgaacttataaggagagtaaataagcagcacaccattaccatctgagacagcatggctgctcccctcttggtgagggcagtataggtacagcaagcagaagacagatcataagtatttactatcagaccttctttaagtgaatatgtcctattccagtagaaagtatcatataagcatacggcctgaatccaattcaattatttacatggctctaccagtaaatggttaacactgtagaccagaaatttagaaaatgcagaagactgaacgatatgtaagtgactgagaacatgagtctctctcctcatcatgtaggacatgggtcgaggtcatagacttaattggtaggagttgctactttcgaagagtgaaatgctttgaggcttttaagagaattttaagttgattaactttttatttgggggaattatgatgtgagctttattaaaatatcacaattcggcattgtttcataaacataattataggccaccttttcaaaaattgcaagagtagtactaagaaggtcctttgaactaaggttcaaaggaccttcttagtaactcttgtaatttttatgggtacagttagttgtctgcataaagtcattccattttccaaagctgcttactctttgcacaaatgacaaattggcacatgcacaatggcacaggaaaagaagtaactgctaaggtcacatatgtgaggacgttgcagcctttaagtactggaggccaaagttaccagaaacatgggcagacagattaaaattttcccttcttatgtttgtgcattgtttctatatggaaaattacatttttctgagagtatatgtgtaaatatgcatctgctagtgttttggcaactctaagttacctaaattagttttgatcaacactgtcggatttttaaacccaccaacgtaataaaagcaagtttaaaaaaacacaaacaaaccctacagtacattgtgtgctctgctgttccaagcctcagcttcaagacaaaaggagagcgagactttgtcattcgctagctgttaataatcaagagaagatctgccagacaagctcttcgagggctctgtctgtctggaccaggtatatactgcaatacacaaagggctttgcagggggagaaaaatgagtgttcatggacaatgatgcagctttcttaattaagattttcattactgatacatacattaagttctgcaactgcaagagccaaagcactgtcatgtgcaggtagatgtccctgattccatcttcaggcagtaaagctaaaacatattaaatgtgcacccagcaaatgttgtgggagccaggagagctccagaaatatttttgttggaatgcagagaggccccattataggcagatttgtaatgcatctaataggcaggagaaaagctcatatcaatagagtgtgtgtgtgtgtgtgtgtgcgcgtgcatgtgtgtgtgtgcgtgagtgcacgcacgcacgtgtatggaagtgctttgaggccctggaccacagacaaaggtaacagtagctgatctagaagtaatccccatataataatataatagctcaggtcttaaaaggaactttgatcttttaaatttgccaatgccgattgttgagacaggaaataaaggattgatttggtagcttttggaagatggtaaggactcctgcatacagccagtcctgactctgcccctcctgggtcactcagtctattttccctggatccgcatgctggtctgaaagtcaatgcagtctgccaaagtggtatactgttcccatgaaataatccaactgtggtatggagaaatctttttttcttagaccaagttatttttacaaaaatacttttgcgaagaaatgagaggaaactaaaaccctacacaatcctagaagtggattactgtctagagtgcatgttttttattccatcttataaagcctaactcattttagggtggctagtgcagttaaggtgcagacatctcttggttgtttttctggtgcttttacttgcatgctttcctgtttccaaatctgcatccatattgggggttacccacagagagctgttgtctcctctctgaagaacatctccatcttttggtcactacttgagtagagatgagtgatgcttaatgaaatatcattttattacaacggtcaaaaattatggattcatttcttattagattatatgctctgaatgttcaccaccccccaattcacatgttgaaacttaattgcccatgtgatagtattaagaggtggagtctttaggaagtgattaaatcatgaaggcagagccctcatgaatggatttgtgcccttatataaaaggtgtgaaggagctgtctctctcccttttcctcttccaccctttgccatatgaagatacagcaagaggtgcgatcttggaagcagagaggacttcaccagataccaaatttgcaggtgcctcaatcttgaatttcctagtctctgtaactatgaaaaataagtttctgttgtttataaattacccagtctcaggtattttgttatagcagcaaaaatggactaacacattaggtacaagcatttatttgacatttaaatgtaatccctcattttctaagaaggaataagccagaatccaacatcaaaatgtttcaaaaggaatacttcaaagtgttttagctgtagttctttgtcgattaaataaaaaaaaattccaaataatggtggtcagtaagagtgtgtgtgtgtgtgtgtggggggggggggcggtgtatgaattcctgtgctaagattcagatctttgaaactgttttctagaatgttatcctacatgtctaaaactttttttctaagtgtatcagagatttgggatggagtggtaaacacataggttactaggaggtggcttgcctctgtacccattctagatgagtaatgttaatgactgatgataatgtaatgatgaaaaaattggttctttttaagtaaatagatagtctacagacaccctgtcaacagatagtgcatgcttactgaggaagttaacagtgttaggattcttcctaacctttactgaaaggtactgttataaaactggtagaggagtatgtgaaagctactggtgaagaaccaatgcagtgaagattattcaagcatggtggtgatggataaaagcatagaaaaaaaactcagaaaattattttgactgaagacttttcattacttttcttatgtgtccttgagtagcttataaggactaggctgaaggctactattaaaagatttaggtgtacctttcactcatgttctttcatgagacacacggttctctcattcaaagtacaaggttaattttaaattagaggtgagaattattcttcatgtatcaaaaagcctagaaatttaccagggattaaaggtagaacccattttagcctatcgaagtgtgagaggtaaggtgacctgtttagatgaatatcttgaaatgattctctggagcatgcctgatctgttctcaatacccacacattagaagaaatgaagaataatatagagactacacaaagagaccatgtaaaagaagaaccctgataaaagaaaaaaaactcttaattttatcactgcaaagacttcttgtacaagatgcctctgcaagtgtcctagtagcatgactccttaaacaagtaggatgcgtgtatgtggaagatatatatatgtatatataacatttaaaatctccctcgaaccccagcttctgagtataaactatgttacagaagcatgtggataatatgtgaagctttctaggagcatcattaagaaaatgagacatttgacactctgagccctaggtacactgagtcagtggcatggtctccaagggcactgctggcagcactaaagcctggctcataaccatatgtgcacacctcaagaggtgtttgactgttcaggtagaggataagccatttcctaggcctggttccttccattctccttagcttgtagttggcctgaagggacttcctagactctaacatgtttgcctctcttttgcttcctttctggacactgtctaaggatttaaaacacacatgactttcatgtccacaattttctgccaaagagggggaaaaatgccccagagcatgtcatcccttaccatctgcaaatgaacttctgtggtcaaggaatgctccaattaccacccagaacagctttgtacaactcctgaccctcgggaagactcgaggaactcactcccagaacccagatgctccctgtcccagaacacagggaagacgccctgtcatcacagtttgcacggcagaggcggaggtgatgctgttagtgtggtatttccaattctctagcgtctttcactttccctgaagttgctgaagaatattccatttcattaagtatgtagtaatacacatgggaatcagagagcggggaaagatggaggacgttgatgacatggcctctagcactttatttatgagaacatccagaaatctctatctacatctgggagaagaataatgtcaatcctgccctggagacatggatcaggcaatgttgccagtgtgtatttttcccttcccaataatttactgattctggagtctaaggcagagcgctgatgataatttttacattcatgtgagtgagcctggccctttgagggctggtgatgccaaataaacataaatgtatgtaaccaggtgaatacttaccacctcccaacccagaaatgtcataggtctctggtggtgctttgcttcccacaacactcccctgaagggcggtgagggtaggtgttgccatcagagcataagaagcagagcttgaggtggccttggaggacttcagggagcactgcctttgcagtaaagaatgagactaagcaaacaaacctgttagacggctcatttgtcttttccaatttttttattgtgttattcatcctttcatcattgatttatagctattcttaaaatattagggatatatcacaaatatttttcctagtttaaaaaatgattttctaccatagtaatttttattttcatgtaataaaatttaaaatacatgtattttttaaaaagttttcaggctttggttttatgcctggaaaatgcatctcatacctccagtatgaaaatattcatgtatatggcaaaaattatcactgaaaattacagaattagtgaggatgcagagaaatgggcagtctctttttttgttggtgaagatattaaccaatgctagaggacagtttagtaatgcattttacttttgcagttccactataattaattgatcctaaggaaataatcatgtaagtgtacaaacatgtgtacatatgcatgtgcatataaagacagttattgtggcattgtttagtaagaagaaagttccaaattcccaactgtccatcaataagtgattgagtcaataaattatgcatatactgaagtgcaacgttgttgtcaaaagataatgtagatctatatttattaacatggtaaatgactattacaatgttaagtgaaaagaatagaatacaaaacagcaagtaacttctcctttcagtctggaaagagaaagacaaagagaaagaaaaagagaaagataaacaggactgtatggaaatataatatttcctaagttattaatagtgattatctctgggctgtgagatttcaaaggaatttaaccttgctctttataaatactatcaatgaaacaaattcaagcaaaactaaatgtatacttttttagaattaaaaattagaacttttattttgggggaaaaagaacttacctaaaacctgcaataaatacttaaaaattccaatatgatcttcagtcattagcaattactaactagctctcttagtagggtgacatcaatgtctgcctcaagtttcccccaagtttgacactttgagatgtacatcatagttcttcccttaaagaattttaaaatataaaatttcaagtagtgaatataacccaaatatttttatctagggcatggttaggtaaattctgggggctttatgtgatattattcagatgttatagtgctatttataaagagtttttaattataccaggaagtatttattatataatattgaattaaaatgggatacaactgtatacatgcaatgtatgctcaggcatgttaaaatctagagaagacactagaaggtgatctaaaaaattattaataatagttggttctgtgtagtggaattatggatgtttcccctttactctatactttctaaatatttcacaataagtgtgaattatagaatcataaaaaaagtaaatattaaaaaaaagctgttttgctcgacagctgccaaattttaccccagatgtatcagcaatttagcttttagtcaaatgaccctaacatcatttcctaaagggaatatcacagaatggaatgtgcccaaataaagataagccatcacggccaccacctctttctaagctatcattttataatgcttaaaataaatctgagtaagggatctttcttctgttggaagttataaacttccacctccttcagaccctctccatatcttctcttgcattaccagcacctggaatttataattaacctatagtaccctggtacgtttctaggtctggaagctgtttttggaggctgatggtgtagatcaccattagggatggaggattatttattcattttaaatgggagttcccttgaataacaaacagggatgagctgctatataagatcttgtgtagttaatatgctttcttacccttcttatatatatatttattgattgattgattttttgagatggagtctcacactgtcgcctgagctggtgtgcagtggtgcgatctcggcttgctgcaatccctgcctcctgggttcaagagattctcctgcctcatcctcccgagtagctaggattacaagcacccgccactatgcccggctaattttttgtatttttagtagagatggagtttcactgtgttggccaggctggtctcgaactcttgacctcgtgatctgcctgcctcggcctcccaaagtgttgggattacaggcgtgagatcccgtgcccggcccgcttccttcctcttctttccatccctcccttctttcttcccttgttccctctctcacctgtctacactcctgtctccagccctcttaaataaatagcttttctgtagtgttagatgccagctcttaacatttagagacaattcacactataccaataccatacttcaagtagatgatctaattgtttctaaatcatcatattttagcaaaaagataatgggagaaatcaaagttgtctctcacatatgtatgatgcatactagaggcttggcaataaggcagagagtagatattttttgagaaagtaaataacaaaacaaaacaaaaagccaaaacacaaaaacaaactgggtattgtgaggacagggcagagggaaggagcaggcataagaaagaaaaggaatgacatcggtctcctggtccttgcaaaggttattcaagtccctgttcctggtgttttggaccagatatcagcctacaaaccaccctggactgtgagctatttgaaggcatagatggtgtcttactcacctctgtattttctgtaccaaacacagtgcctgatacaatatactcaacagatgcctggagaatttaactaagccctttcactgccctttcttactggcctcagctagaaccaaaacaagaagctaaaactcctaatgccacaaatgctaggtgaaaccctatcctaattcaaactcatttcttctgattttgcaccttggtccccaaactgctggagaaaatcccatgacagagcagataggtatcaacatcaacccaccagactcacctgcaccttccacactgccaaggagagtcctactgtatttctctggtcaacttgctgtcccatttgtctcaagaacgatttcaaatctctactttccttaaatctcttccccgcttattcttagcaggaccttgcccctcagtgcccatcacttgggaaacctcttaacctttcagtaccaaatctacacgtgggcttgcatctgctcctttcctttactcctcctttcttacaaaaatagaagatgtgtccctccttccatctctccacttgtactcaggattccatctctctggccttatcagtaatcttatactgccagtcatcctatgctcttctctcttctgcacattggatctctcctctctacggtattcttcccatgaaaatacaaaaaatactagtgtttccatgcttttccaaccttcttttgacctcacttcccccctcaagatattgcagtagctcattttcctttccttcatagcaaaacttctgagtggcccacatttgctgtttcttcacttctcattctctcctcatcccattacaaacacgttattgttttgaccacttcaacaaaacagcttttgctgaggtcaacaataagctcaaaattaatataagcaatatatatttgttagtctttaacctacttgattgctcagtaacatgtcacatcactgaccactacctttgaggcactctcttggcttctgtgcctatgttttctgattttcctgccaccttcttggtggctccttctgagggtattttatggcctcatttttttctaccagcggattaaatattaagagctcttcaagtctcagtttaggtcttcttctcaatctaaccctgtccctaggcaatgttattcatgccaacagattcatttaccactatatgtcgattaccctgaattcatgtctccagccttcatgttacttctgaattccagttttatgtatataaatacctgtgcaatatgctcactatgtatctatccaaagtacctcacactcaacatctcaaaaacagaacttacaaacttctctccactccagtcctcctttggtgtttcatgtaactgtgaatggtattatccttcatatagtttgataagccccaaaccaggagtcattgttgccacttctctcttttatttcacataaccaaccatgaaaaagtccaggaatattttacttctgaattatctctcagttccatcaatttcctcccatttccactgtcaatactctagtctgcctcttatgtggtctactggaatagctccctcactggtttcctcatatccatttttgatccttccaaattatttaccaaagttaagctaccttgatatatatttttaaatttttaatttcaagataattttagattaacgtgcagttgtaagagataatacagagagatttgttattctttttacccagttttgcccaaatggtaacattttatataactgtagtacaatatcacaatcaggaaattaacattggtgcaatccatctgccttactcaggtttcatcagttttatatgcacatgagtatgtgagtgtatatttagttctgagcaattttattacatccatacactcatgaatactaccacagtcaagctacaggacagttccatcacaaaagatcccttgcgttatcctttatagcaacactcacctccatttctatcccaactccctaactttgtcatccacaagtatgttctcaatccttacatatttttttcatttcaagagtgctatatagataagaatcgtaacagtacatcatcttgagattagctttttcacccaatgtaatacccttgtgattaaaaccagttattgtatgcatcaataatttattctgcttagtgctgagaggtattccatggtatagatataacagtttgcttaaccactgacccactgaagaaaatgtgggttgtttccagttttgggctattacaaataaagctgctatgtacattggtgtaacataatgtacaggtgttgtacagttatgtttccatctctctgggataaatgccccaaagtttacccttttaaaaaacaacaatgatcatgccacagtccttcttaagtttgctcctctactgtccttaggataaacacaaaaatccttaacatggcctaccaaggacctgttatcatcaggccttacgtatctcttcaacctcaacctgggctgctagtcacctttttctctctgtgcagctctcttcagggacttcatgctgttccctctgcctggaatcctcttccaccatccatccttactttttgtttttaaccttcaggtgtcatctcaaatgttactatttcagagaagcttctcctgaatttccagactcagttaaatcttcttcttttatttgcccttagagcacatggtacttttattatatagtggtaagcacaatttgtaattacaagttatattgtgagaccatttgcttagtatctgtcttacattccccagattataagctccagaaggagagagactatgttaatattcctttattatatatacctttagtatttagtagacactcaactttgtgtccagtaaaatttggctgaggcttttaagacatagtcctggaatcaagttctatctctaccatttattagatgttcttataaaataaatcaaacatgttaaatctcagttttctgatctgcacaattaggattatagtagcatctacttaatagggtagttttgaaggttaaatcagatagccatgaaaagtatttagtccagtatctaaagcaaggcaagcactcaataggtatttcttattgttattattagttgaacaagaaactagagtttttgtattttttttcctaactaggcttttgtccattatcttcatttcttgcctgttcccccaggttctgattcttgtaacttttgagactctgaaaaggggcccttagtttagatcttggataaccagtaggactactggttcttaccccaggtatatgctctcagaccagatgtggctctggttcccattttcatctcactcagtacttcctcctcttgttttccagtctatggatgtcagtgtgggtaagaatgcctcttccctactcctagtttccagatgttttctaaacactgctttcctcttgtctcattccttataattccccatggaggcaaagtatcccattggtgggaaagcccttggtctatatttctcaggtaggtagaactgatctatccaaatttgtaagcacaggagtttaacctctttgtccttccttttctactgagactatcgggaggtgatgacctggaaagtgttgctcatatgcagatccacattttcctgtaagagagcttttgaaaggtttgactgaagggaagagagtcagcaaacccatttcctctttacactaagctatgctcttcaaccaacctttataaaaattttggttccctagctatcagttcttttgtcttatttttcaataggtttagaattcaagtggggaaaagtgatgctatttatgggccccctcgaagattccaacactttggtatatgattttgcttggaatatgattctgtttctcttcatcttttttacattttagccagttttcaagactcagctgaatcagttttacatgaaactttctagcctgcaaggctctttcatgaatgaaaccctatggtacttcctggactgtatcattccttttggaacttagtcatttattatcttatgtgcatacacaacgctcaacaatataactgtttttcctaactcaattttaaattccttaagagcaagaaagggtcatgtacttatggtatatttatgctttaactatccaataaaaattattctttgtacatagcatgtttttaataatatcttaaagcgtgaatgtgggggagagtggcctactgaccaggctttgatttgaaggcccaaggtacaacggaaatggcttagtagctggatggttcctgaagaggttgtcgcagtgcagtggtgaaagaaagaaaaggttactatgggcatgtccctgaggtgtgtatcagtgcaagtctgtgtatacacacacacacacacacacacacagtctctctctctcttacatatatatgtaaatagaacttaaatctgtcttgtgctgtgttttcgccttagtaatactttatttctcttattaaaaatacatggaactcaccatctgataggtagaaaggctaagagaaatgcaaccagagggaggtaatattcctggctatagtcgattggtgttcagagtgttttgattctctgaatgagtcaaaagattgaaaaaaaaatagccactcttatcactaggaaaagaaatgaggaggaagggtcctgaaaatggtgtctgagcaatgaaagacagtgaatattttaaagatcacaaaatttaatttattcaacctaaatgcataaaagtacaggtggggacattatttatgcaggtatatgcaaatcactttataaaataggcaaagcccttctgctttttataagttgccaaggtggttcctgatattttaaaagctatgcacctttaatgtaatttcctaagagttggaatccctctgtcgaaatcatagtcattgtcagagcaagttgatttttttttttcctatcctctgggacatttacaaggatcttataaccatcacaaaaagagtggtttccacagagatgtgactggaaaaatcccttggaaattgctgaggagcaagtcacagtgttcaaagcaaagaacataggctttgaaaacatgaacccatctgacctcttgaatttagtacagtgaattcctgagctctgaaacatggggcccggctgtgcatgccatattggtgctataagactggcagtaggttggctgtggcatggtctatttcaaactccttcacagtgcccagtgttgcatgttcccagatgacatttggttggcagaagctgggcttccaaagctggcagcctggaatgcagcccactgtgttttgacaaacacataattgaccatctgatcaccagcctacgttctgcactcaggtcactgggggacctgggctttcaataggtccctactcctcgtcttgttcatcttcccaaacctttctccagaaagcaatatagagaaggcttaaacacacccacgcatatcctcccatttgcaaaagagaacatagtacatgaaacataagctgttgaaaatttcctttaaattgtcctggcagcccaaagtgaacaagagaaaagcacacttatggtgaactctaattcagagagaaggaatgaatacactgaattgtttcaacacccggctgtgcataagttgcaattcagttcaatggtttggaaattttgcttagaaaaagggagcaatgagaaaatgataggaaattggggcattgattgactttaggggggcattatttagaaactgtttcattttcaggtgaaagaagagacaagcaggacactgggaatgtcttctccttatctgcctgctcctccctcacacccactatgggcagtaggaggcacgcgagcctggtgaccagggggcagtagctcaaagtgaggtcatattcaaattgaggtctttgctgaagatcccataaggatgtattttggtctgaaatttgactccacacaatgtttcagcctttctcctagaaggcaaagattatgcaataggccaagatatgctggaattacacaaaggttaatgtctatttcaacactaccaaatagcctctccctccatcctacccctactgcacagttcaggcctttggcttttacctttgacctggtctccctattctgagtcagcctctccactttcaccaagtgctctttctaaaacatacatctgcttacaattcttcaaagcctccttgagcctgcaggatcaagtccaaactcctctgcacggcatacaaggtcctccgtatggcaggcaaggtcccctgcctgctttccagcccaatctcatactactctttcaaccaccatgtttcaatcacactgaactattcactcctctgaatctcgctgctacttaacgcctcctgattttgtaaatgctcttacatttttcttgattatgatccccttttctttctgctctttcatatctacctggtaaactgcaatttactcttctgactttaagacccagcctggtcaccttaccacatccaagtgggcactcctccttcattcctcttactacgtcttgtatatacctgcatttcagtgcctatcatatgctatagtctttattcacttatgtatctcccctatcagactgagatttctaacaaaagaaagcatttcttatttatcccggagtttccagaaccaagcacagtgactagctttccataaatgtttgttgaatgaaaactaaataaagagctgtacatgataattaatcaaaacgaagccaagtagtagtgttagcttttataagcatagtaggagcccattagcaatctaatgaaggcagaagatcccagcagtaaggcactttctgatgggtatggcaggggctggtgactggctggggtgacagtaagagtgagggataaattctgtgatggaggaaggtctttttaacagagactgccactaaggctgtaaattaacacccttttcaagacttaatattcaatactgaaagatattgtcctgagaataaatctgaatctgaattgtatagagacctaacttataagaaccaagtttcccaaataaggtaagtctgtgctacctgcttcaaggtagcatggcagattatggagggttcctctttgtttctgctaaacagtaatggaatgggaaattcttgggggaacatctgagagctcttcagttcctattgaaatccaggtcaaatacagattgtgatactggactaaatgcactgctaagagaagatcgaacaagcagaattctgtacctgtttagaggaggccattgaagaggcacttggagtcaaagcactggggagataatgttctgatctgttctcaagggacattggacatttcttttccttttgtcgagcctctggggcaccactctggagccatcaaccatcaactgtgtctatgggatacttgaggacagtaggactgtcataagcccggtcaccctgctgatatgagggcagcttcaagatttggaacaagccaagcaaacatgaagcctggcccagggatggcacaaggtcatgggtatatgaacggattatctgctcattataggtcactcccccagccttatgtgtggttaaaaaataggatatctctagaagctatgcaactgatggctgatgtagcatagaatcagatttgcattttcctatgagccagagacagcctttcaactacactttttatctcaaaagtctcccccttgattcctaattggtgacacaggtcccctgtactgcttgtgtctgaggctcgccctatagcactgacgtcacaatagctgagccgtgcgggcaggagtgcactgtgctgactcatcccggtgatgtgaggattaatgccttgtctaacacagagctattatgtgaactgtttttacacaaaagaactgtaacaaaaatgatttgccagtcagaggactagaaatatgcagtgctaggtaactgaggggagggctgtgcagatataaagtggtaaccataagcatgcatattgacatcctccaaagcatttacagacccactctatcaacactgaaatagagaataacaagacttgtcagggacaggtaggacccacccctgttgtataaatgcattacacacagctccagtctttggggagtttaatcaatctcctttctctgtcaaataaactgtcacgttacactttagccttagcatcctttggaggattctgcctccctaaatatatttgccactatcttctaggaatgttagtggaaggcacgcataaacaaaatagccatgggaacctccattctgtgcaaatgattataatacaagaaataccttggagtgaagagtcagtgaagcaagatataatgttgtgaataaggaacagagctcaccagagagtgagaagcagccagaggataccgataattatttatcacattaggtgactatcactacctgtaggatcttttgggtggtgtctcttataagtgactttgattatttgggttcattggcctagaatctttttcaagcagttcaaaataaaatttatttaaacccattcagtgcagcctggtttgaattttaaataatgaacgttctcttttttttcatataaaatcgtgtttttttttccccccgaatacctttccatcttttctaaaaaagagtggtacctttataaaccttctggcacacgtgaatctgggatttctttttttcccctgtagacttcataattttgcacaaaagtttagtctatttattttacagtcttgtacttcttagtaaagggatattagaaattttgtcaataaatgaaagctctgatctagaagttaaaattaaaaactattggacctagggatgggtacataactgaagaatacataattgcccaatgattgacaggggagcaaaagcccaactgttgctggtatttggctgaataatgtaagctatactttaaaagagcagtgacttttgcaaacagcagctgcagccaagtaaagggcagcctttatagaagtacagtatctgggccactggtattttctgcaccctcatggatagcaacttagtattaccaccaacagcatacactccaaacgcaaaagaaactaatacacactacagaagcactagaaaccacaacaaagtcaactaggaaatatgccagtgaaaaccacaatttcctaaatctgacacttttttttttaaaggtaaagaaatcacttttacttacgtaaagagaaggggcaggtcacagactgatggtcaaagatctgaaaatcaaagaaaaaataaggaattaaaagcaaaccgatatatgatgcaaaaccaatatataaaagcaaaatgatacagtgggaagaaagaaagcaaatctaggcatagatgggactggttgttcctaaaggagcctattttgtcacttctagcctcaaaataaaggagacccagcttcataaaaactttctaaaggtatgaccccctgctatgatgaccaagacagtacttcccagcacaaggagtgcaaagacctttctttgttcatttcattctaatctgtatcatataggatttggtagagctatgttaccatttaacaaaatagccactagccacatttgtctatttaaatttaaattatttaacatttaataaaaagctaaacatttagttcctcagtcttgccagcttcatttcaagtgctcaatacccacatgtggctggtgactgccttactggatagcacagatagaaaatgtttctattattgtagaaacttctattgggcagcactgactagaataggtaaaagctttactatacagtacatgaccaattttagctaattttgacaaagatgagtcaaaccctgataaactttgtctcttttaaggtatatttagtatgtttaatgtccagaagttcctctgaacaaattcaatacattcgtgtgtagctaagaactcagtcctaagtttgccccggacttgccttctaaaactgcctctaccccttctcaccagcctagaatgtcccctctatggtggaaaataatctgataaagtgattttaaacaaagcttctctcccaccaaacacaactctgtttggtgatgaaaatttcagatgaaatgatgaaaattttagattttggagaagctgaccctaacagtgttcttgttctatgtttaaaatctgatatttcactctttaaattacaagccaggctaggcgcggtggctcacgcctgtaaatcccagcactttgggaggccaaggtgggtggatcacttgaggtcaggagttcgagaccagcctggccaaaatggtggaaccctgtttctactaaaactacaaaaattagccaggcatggtggcgggcgcctgtaatcccagctacttgggaggccgaggcaggagaattgcttgaacctgggaggcggaggttgcagtgagcccacatcacgccactgcactccagcctgggtgacaagagcaaaactccgtcaaaaaaaaaaaaatcacaggccaaaaaaaaaaaaaactattataggactggtctgcccatcattgtgctttgtttttttttctttcttttttttttttttttgagatgaactctccctctgtcacccaggctggagtgcagtggcacgatcttggctcactgcaacctctgcctcctgagtttaagcgattctcctgcttcagcctcctgagtagctgggactacaggcacgcaccaccacacccagctaatttttgtagttttagtagaaatggggtttgccatattggccaggctggtctcaaactcctgaactcaggtgatccacccaccttggcctcccaaagtgctggaattacaagtgtgagccaccgtgcccagacccatcagtgttttgatagcttctcttagaaggataaaactgaagtaggaggagagccatgacaaattaataaaccaaaaaaagatactgagaaaacaaagcaggtccccctacctctagcccacttaaatatatcaagaatttaatacagggtgattcaatcttgcctctctgacaccatgattttaacaacttcacataaggcctccagaaatatgcaaaacaaacttcactaaaggagatcaagtagaaggacctgattaagtatctttgcattgaaaaggctaaagcagaaaaccagcaattaaagacatcacccttcctggaaagtttctgggacaactgcactattgtagagatttcttcaaagaaatgatttccctttgtggtcaatgtgaaaccttgctcaagtacatgcaggtgtacttgatgcaggatggtgacaagacgagttaagatgaaaatctccagcctggattattataatgctaatacaagagaggctggagatctccaatgctttcaaattgtttcacaaaattcatgagtttaatgaaaattttaggcaagagaattagattatgtatgattcattgaaagcacatacaaatttgaaatatatatataacactgactagtcttcaaagattttaaagctctaagttttgctatattctagtcttctctgcaagccaggatattagactatggcacaggggcatattttcttaccattttcctccctccctctctcctttcttccttccctccctccctccctcctttcttacattcctctctctctatttctctttctttctttccctctccttttttgaacttgctgtcttctctaaccttggggagaagaagaaaatattattagcaattttctatgaaatatgttcaatgatcatttttctgttgcatgttataaacccaataactctcaacaatattatgctcttctaaaattatacctagtgtttatgttcttatatctaaacacataactttcttttctaaatttcaaggtgcatttattcataaaattagttaaaattaaatttttgatgtgatcaaaagagatcaatgtaagttgtacccaaattgactaacacatccaatgtctggaatgaaaaactatctttcctggatgtcaaatgacacacaggatggctgtcaatgataggaatccaaaatggagagaaaaattacagtgtgtatgtcacagtctaaaacaaattaaagccaagttagatggaagttttattggatataattgttgtacttatatgttaatataaaatgataatatgatcccaaacttaatagtatggctaaaaatttaatctcagagttcttacacaattcataaatgttcataggcatcaaaagacacctacttcttgactgaattataatctgctatgtaattctgagaatatgtattaatctacatagatttatatttgctcaattcaaattgttatttcattgatacatgctctttccacctaagtgatattcaccttatatgtctataagttgtttttatctgaaatgcaaagaattatctataaaagtttcacagaggattaaaaacatttgcattaagcacactttgttcaaagcataaatatatctagcaaagagtataaaactgtaaagcccaagtaattcaggacgttaaaatatcagggtggaaggtgggggatgagcagagagagggggatgacgaggggtgaagtttaatcttcgtattataatgtctgagtggaaattattatatagtgtcaatctccaagaatcaaaaatattattaattataactttaaagtcaattctagtgtagtttatgtaaagttctacagcagtggttttcaacattttgaagtgataccgatccctatgagaatctctttctccagaaaactcctcaaaaacaccaagtttcaaggaactcctagactccatgaaggccattcatgaatcccaggttaggaacccctggcctaggcagacaggggagaaaaaccctctttcaatcccatagctactcacctctacagagttttcatgaaatgctataaactaaagccagcagcaaagaaaatgtataaaaaagagttctaagtgggtaagggtatgtggttagagccacacaggcttctttgaaggcctgccagactcctaccttcctagtcctttataatttcttttttaaaaaaatctacaaagccttagcaacaatggagtagaggagtaccgagcagagagatgataatgatataagaatcactatctactgagtccttcaggtaccttgagaaataaatccttcccaaatttggatatgagtatacccaggaatgtgagcagtgtaacgggagtagaaaaagccacaaaataaatagtaaatacatggctgtcttcctggagggtcagtattccttgtgggcaagtaatttaaagtcttatttgcacacgtgttcatttatccaataactacttcttcaatgttataccaaaaagaaaacagatactgttcttgtcctcatggaacttccggttgagtgaaacaaacaagaatatattgaggagctgaaaggaaaatctgtgtatatattttttgggtgaaacctgagacttcactgaaaagtcttgtttgtggcagactacttcaagcaatgtcctggcaggcacccttagtattggatcactcactctaacttgaggatcacccaagtggaagagtttgagaagcatggttagcagtgtatcatttaatccccactacaagagaaaatactgttacttccaatttactagagaaaaaagagaaatttgagaaattaggaaacagctcagatcataccgctgctggcgtctgaataagtgtgtgccattccaaaatctacatatttttaaccactaaattacactacctttaggagtttcccactttatgtttccccttgaatctgggctcattcaggattacgcaggctagtttaagcttctctttggaagcagacaggtttggcttgatttgcattctaaatatttcacagtggtaagcgaaagctattattatacccattttatggtgaggaagctgaaccacttgccagctgaggtatctggctgggttaaaaacagaatctgggtcgtcagactctcattcctcttgactaactccaagcctaggcactattactgtccatgggcttttctgaacatgagattcacactgggtgataaagagtgagacaaattctgctaagagaaaacaataatagtgcaattgaaaaaaagggaaaataagtaatcataactcacaccaaaattggttactttcagcattgtgaatagaaaagggagagattattcatcacaaatgagtcagaaaattagaatgtgtcactgcactgatgacagagctgaggaatttggatgaactgaagtttgacacttatccttctagctgaagagggtaaatggtgtgacaacaggacagaaatgacctcttatttccaatcttaattaatatttccaatcttttttccttaactactctgtctaaaagttagatgggtttatatgtttgttttctatcggtagagataatgttttaacatccctttaacgttctagaagtattgcgttaattaattcttatgtgggagtcattccaaatagtaggatgatgatttttaccttattgattttcctaatacctttctggtttccagtgttttcaaaggatgaggcactattagatttttagatttatatgtctctcaaaattaagtgcctgtcaactgatattccatctttactctggatacatgatttcctttatctgacagattcaaaaaaatttgtactagatttaatgacatttcatgcatcttgaatttgggagtttttaattctctattttctatttggcaaaaggtttacaggagaaagccagatgcaagggtatttatatgtgcatacagaacctgtgccatcactctctaggtactttggggtttcctgcaggacagattcttgatgtattttcattccttttggtcaggaagaagaagactataaatgccacaaatggtcatacatatcttggggtctgctttccaaaacgcatattattttggatccgtctcaagaagaacaataagagaatgatactgagatctttttttcttaagatgctatgataacaatcctaaaaaatggcctgccttcaaaattttgatgatgaaataaggttataatcaataaagagagaagattttaaagttcagcaattaggtctgggactgcttctgcgcctgagacattgccaagatacaatgtaacactccatcccaccccatatgaatctccctgttccttcttgattcttacggggatagggtctgacagactagaatgaaatgaaagcagtagtgctgggaggggtggcaaggaccgaatttgtttaatacatttaggatggttttttattgctgctaaactagacacaattccttagcatgatgacattcaggaatcctttacaatctgattccaaagaactttctcttctatatcttaaactactgaaattgtagctctataaattccaaagggattgatgtaccaggacctttgacttatagtaaactgatcttaagggatgctgaaaaggtttggcactgctatcatgtggtctaatcatttagacttgtcactaccaactatttgcttaagagcctccaagacctttcacaatctggccccggcccacctctctacttttaataaaaaattttcccactgctgcttctttatatacggtgacagcctatttgctcttccctgaacatggcctgggacatctatgtctctgagtcagctaacggttcacacttgaatctcccaagcctagcatagtgtgtgaaacacagcacgacactccaatgtttgttgaataaatgctgtccgtctattttaggagacagagatgacagaagaaagttgttaaatcagtaaataaatagcaccagagagaggtcaaggaaaagttaattttagtgcattttaggagtgggggcaagatgagcttgaagattaggaaaactgatgctctttattcttgggtctagccaatgctatgagtcagttactttttcgggaacaagtttaaacctcaaggttaaatgaacacaaatgccctgtccatcagcatataatgaaaaagttgtggctatttccacatcagcacagtgaaattaaaatatgcagtgcctctctaagaggcatcacatatgacagagcttttaaaaatagtcccctttgccactcaggtatagaaagagctatagaaacaaaagcaaatgtttgaaaaactgagataatttagcttagggaagaaagagctgaggtgtgtctttatggttttttgactataagaaaagttgttacaaagaggataatgatcagcatttttgtcctagggcaaaatgacattaaaccgtccagtgcagaatttaagacttaaagatgaacattctaaatatgcaagtggtaaataatcaaatagattgctaagagcagttctgaaatttctttcttcctgactctcttaaaataggaaaaatcttcatctattttggataaaataaatgcagctctgcctccagtcaggagaatgaattcaataacttttctagtcttgtttaactctgtatgattctataaaattctataaaatgttcaccctaaaaattatacagaatcacaatacagttgagtaaaatacattctacagtttaaaaagaaataagcaatacagatagttgataagttattacattcaaaatagtaatatatggtgctcacgttttttattcaatttgccaagtgcatataacacaaataaaattgggaaaaatgtacttgaatctactaaggctttaacatagcgattatctagagtaaaacagtctaacaattaattctttcatgtctaagaaatttgctgaatatttcataaacctcatattgaatatgtatataaactcaatttccaattaaagaaaaagttttttgaaggtccagaaagtaatatatgaactcactattattatttcctggaccatcttcaaagacaacaggagaaccactaaacaattcctttaaatgaccaaaatgtgccccatatgattaagaatgtaaatctaataacagactcacagataaggtctaacaggggtggcaagttactggctttctttgtctatttaccttttagctttggagctcagcagaagtgtccattacatacagcacagggttagatgaacagctccaatgaccttgtctgaaccaaattcatttaaagcagtttgccacttttcttaaatagaagatgagtccattctatctatggcccagatttggactggatcactgaactattgcccaactcttataagcaaagcactaacatgtaccaatcaacaggcgaaggcatcaggaaggtaaaaatacacatacataagaaactggcagtagattaaagaagaaagctatatctaaagatggactttggcttttaaagcctttgagtgttattcgaatcttgttaacaaaaacaaaaacaaaatctgcattccaatgtaacttgtagagaagatccagtaaaaaaatgaattcaagagagagagagaaagaaatgtagttttattttgcaacccattatttccataagaacatgaatcaaagagtcagctatgccaatttcttcatagctgactagttataggatattgttctagtcttcactaatgacttcttgaggttggttattactgtgatcaggagttgggaggatagaggtctaagacctttcaaaagaaacgttttgtttagtatcactacagaaaataaagtcagcattaagctaactttgacaacctaactaggataatggttggtgcatgtagccattgcttatgctgcttcataatgaatggaacagtaaaggtgtcaagttaaccagcaacttgaattttgaaaagctgtggcacaataagctgataacataggttgttagaattagcaaaacttactttctgcttcccccaccttctagtcctacttatttccacatccacattcctatcaccaggcagttaaagaaacagaaacaaatgcggctgagactgcttctttggggatactcttagtgagctctccatctccccaaccacaacttgctctcagtttgctaaaaatatattcatttaattgttttaatgcctctacttaggggaatttgcattttcttaactgttgatacaagatctacattcagtttttttcacaggtaataagcaaagtatttggggagtgtgtgtgtgtgtggtggtggtggtggtggtggtggtggtggcaaattccgtcctagatgcttcgagttttccaagtatactgctaaaaggggtcatttgcttccccacctcaagaagccaattgtgcttatagttttacttcaaataaagatatatacctataaatgcacacatcatacgtgcacacacacatattcttcttctcaaaagtcataaacatttggtgactctctgtatactccatgaagtgctgttactactaaagtcagagtaatttaggcagaaacataagaaaccccaaatggtttgcactgaaattttattaacatatttgtcagtgttttcctcatggataatctccattggttcctggctccttgtcagcatatgctccaggagcctctcacaatatctttctgccctagaaatcctggcctgtgagatttccttgtaaatatctgaattcttgtattcacctattaatgatccagggatcgaggatgttttctatctgctccttaacctcccacttcaaggattagattgtaaacaacctagtgggaacccttcaggccaaaccacagctgaacgaatctcagcaggcagggaacccgcagcagtctgtgaaataccgtgaaacacaattacgaaaatataaagtattcacccatactttggggaagaaattatgttgtttccaagatgagacctcaaaaataaggctagtatcctaattgagaaagacatgattttaaaaagtgtcagcagaggtaaatttttaaaagtaccagatttgccaggtccttctcaaaccatagattcattttcagtatatgacagtggcctgagccgacacttcaagggaagtccattcatctctgaccaatgaagcccaaagtactcactgcatgaaagggttcctttcttgtttccaaaggcaatcaatttttgtcctagagtctgaaggttcatgggctttcttttaattttgtcagtctgcacatgcatggttcctcctgcatgatttggtctggaggaagtgacccacccacaacgccacagagctaattaaccccacactgagcttttttttttttctcatttcacacatccactcaatgctttaaatgacccagcagcagcatgatcatatgatttcttccccctcagtgaggaaagcatggtgatgggaggagcagggatatatctgccctaatcaaaacagcagtgtgatcctaaaatattatctaattgcattgcatccgagggtgcaaaatactaagaaatccctgaacgaatctctttcatgtcattcatttaacttcttgcagtgtccatttgaagtagcaaataatacataagaaacactgaggtagagaagtttgatctatactcagaatgtttaaaaaacatccgatcttacagggggtaaaagaccgagagctccttccctatcccgaatagcttcaagagaagggccttttttccatttgaaggaacagactcatgtttttccagatttattttttccaaagggaatgccttgaaaactctaagatgatcactgttttctaacttttcaaaaaagaaaaaaaaaagtgaacatgatggtggtgggtgatttaatggaatcagcttgtcaacatgatgaaactgaaaaaagcttttatagactctgtccacatgctaaaaaaaaaaaaaaaaggcaacctttaaagttatgtgtatagtatagagtggtttttgtcatggcaaagaaaagaaatataattatcttatgcagtaaatgtaaggctctgctaagaatctcattggataaatcatagaaatacatcctggccagataaatggagccagacaagttctaggtcttgtaagaagctttcaaaagaatcatcatattgtaagtctgtcatctctgtaagtgacaagaaaaattctaggctatttccctcggttctactagtaacatggcttcagagttttaaagatttagacttaaatggacaagaaaatgacttctgaatatcccatcttaggcaaactatcggatttctctcattcttacaagtaagtgtagcaaattggttcaccttggaaggacttggttagagatcatatatgtcttatgtgaacttttaacctctctttcctttgcaaagtgatttatgcatacactattaaatacacaggaattctataattcttagttcagtgaacagttagtacaagggaaaatctatctaatattttaaatttttgtttagtgtcttaaatcctacactttagaactggagaccttatagataagttctataaggtcttcagtgtgctgaaaaacacatttgctactgctccctaagcttctcttaggtaaggctgccaactggggtaaattgatggataaaactagctcaataggcaaaaaacaaaggtccagtgaagcacagtttatttttatttatactggtcagaaatatcacagttaacaaatagcctaaatcaagctcttatatctagggctccagcctttggctgaagtgtctcatctggtaattctgaaaaaaatagggttgttgtgatttcaaagactctcctgcccagtagactttttcaggctcactgatgcttaggattctaaagcctttactatggtctgttagaccaatacagtatgtcccttactatttctctgacttcatctcctaacattttcatgcaaaattggtccaacagacaataaaatagacagggataggaatatgaatggggactaaaaggaactaattaataaaaattagttgctttatgtccttgttaaatatcaactctttcatgacagcctaataaagtttctgaacttatcttgagagttggttaagataggggagaatatacaaagtatttccaacaccatgcattcattcattaattcaacaaatagttttcccgagtctattattgattactctgccaactggattctacttctgccctcaaggaccttccactctaatgtatgttttggagagtttctgtctctattatcactgacaggttattagcccactttagacaagttataaatataaccacctgccatgatgattcctcttcttgttctttatttgtttttattcatttgccctgtaacatccattaacctttcatgaatgacctgatcctttgtgagctatactatcaacacagctaatttttatataaatgagaaaccccttctccactcccaactaacttttctttctcaaacagccatgaaaatataaaagtctacccagaattatttaagtttttgaaatgagtccttacaatctgatctgaagcaccatttttttcctttcttttttgaaagagggaatggagcctcagcccctaagatacatatctcaagttacaggcaaattacacacaagttactggtctcccagacgtagtactcactactctctggggtagaacaatttctgcattgaacagaggaccataatctagctcaagtaatctcaatctcagagaacagttaaccaagtgcatatttctggtccctatattctcttataaggagttaccctctccactatattttggtattttctgaacctggctaccttaggtaaatgacagtggacatggtaaaaagaacactaactcttcctcaatttgttaaacttgtttttcctcctcatatgctttataaacaaaaatgggagaatttaatgtatgtatagagcagcaaatgttctctctgttgctttcagacatttttatcttatataaacagtggtgatgaaattataaataccattattccacctctatgttaatactcttattatcttgcatcaacagacgtgaacaaatacgtacatgacaccaatcaatcccttttctaaaaatgcagtttttgtatttctaaacagtggaggaagaattttatgaattcaacatgtagtttacctatttatattttgaattttaataaagtaaaaccaaattatcgcttatgttctttcacacttacatcagccattaacactctccatgctggcatggggtagggggtgtgtagaactaatggcaatgggtccaagtcccctgggtcaggtggttaggggcttggcaggctggagaggatgtttagatgctggggcaggatatttcaacctgcttgacaggtaagagatattttctggcagtaagaggaatattttttatggaacaaattgctagggagaggtcattttggggcactaggtgagagaaatatcaaaaccaaacctaaaagcagtctaagggaactcgggaaaagaaaatcactactttttcaatctcctcactggtttcccttattccatagtgtgccttctccttccatcttctagcacttcatactcttttctcctccatttcttcaggttttctttctcctacctctttattataacaaaaaaaagcatttaggaagaattctaggagacagggagacaaaaaaaaaaaagaatttagagaagacataataacatactgcataaatatgtatgtatgtatgtatgtgtttatgtatgtgtatatgtatgtatatataacagatattcgatttaccaagaaggataaactgggacttttgagatttaaaaaattcatggtatgtctggtcatattaatctccaaaccagcttgtttttagcattgctagagctataacagaatcaggagtagaaaacaaaaggaaaaaaataaaatttaacaaaggatttatatttgcaaaggaaagaggacttatttagagttgtttattgaaattcccccaaagctattttttgaacttatatattgacaacatcaagagaaggagcttaggaattctcatagggtttaggaactactaaaccttgtatattatgttcatctcagtccactcaagcaagtaaaggataactagaggatggtatctcacagtgcataacatggttggttactttgctaggctgacatatggagacagggcccataggagcagagcttttcttacgaataccagagagagacacccaggttcatctaaatgtatagggcatgagggattagtggtacagtgttatctgcaaagtacctaaaagtgttttctaaacaagcactaacttcttagcccagtcttcttggggattaaacaaaatccaatagtaagtaatggggaatactttatttggtcactgggttggggagggttgctgagacatatgacaacattcaatccattaagataggaggaaatgaggagaaagagaaaacaaagaaagggagagcgagggccagaaaagaagagtgtcacctctgtagactctctaacagaataaatcgataatcttaagaaaagtaaaagagcatgcctagagggaaacctcagcacacttttggaatccaaggcaaaaaataaaacaatttgcttcttgtcaagtttattgccattgacccatgggaggttcctatttattctgctcttacatgcacaggtatttcttctactcttacattcttttcctaaggattagcattctgtgataatggtggtaatgacagctgccttaaattagtggcaagttaggaatgaaacactgaccaccaggctatgttcttgaatccagtctatgccctgtaatgtgttcattctactttctgcattttctctgagacctgtcgcataagacttgttttgtaaggccgggctccttacggggacacatatggctccagaaaacaagtactctactttctcaccctgactttttggttttcttgttttttcctcttttctcccagactattattttccagtttcttctctaccagtctggacgcccatggttgttaactttagagatacccaccagctccatcaattccctcatctacagttctcaactgtatttacctagttctggagctcagatgaacccacatgtatgttctcctcagcttccaggctgctgatccttgctggagaaaaagcacaaaactgtacagcttgatgctcctgcagaattacggtttccagcataagttcgaatttcagaattagtttgcaattttaaaatttgctcctagtcagtttcctttttcactccacagtttcattcattactctatttaactggttataacccatcccctacccttcactctcagctagtaaccttgcctccttttgcatagagaaaacagaggccatcaaatggcacttcctatcactccacctttgccaccaatgaatccgcctgtaacatttcagagatctttctgcctagcactgataacctcatccaggatcttattatatcagttacttttcctttcttttgtattttcaattttcctactgcctgccaacatgctttagctgtcttcatttaaggtaacaacaataacaatgataataaactaacaaacaacaaaccatcttttgcagactttatctttccctcttttgtgccaccttcaagcttcctaagctcccgtttattcctcaaaccattacaatctggtttctctagctgtgtttctaattaaacaatttttttttttttttttgccaaagtcaccaaacacttctgaattgttagcttccaaaatccattcttcaacctcattgttttctttcttttaaaggtcaggttcactgaggtataatttacatacaataaaattcatccttgctatactcatttaccattcaataagttttgccttatatgttggaggcctgtaaaatgaagcccaacccccaagccgctttgcttcatatacaaatccctttggcacctctcagcagtcttccccacataacccattgtctggtgacaccacactactcagcattcaaggatatatgccatgtacattcatgccccttgtactttctttatgtttcctctctataaacatatatgtcttggtataacacagtaaatgctatttaatattaccacatcaatttccatatagaatcataaatctatacgttattttgagaagctgaggttttccaaatagaagtcatccatcaaaatgctactacctgaagatctctattattttagtattatgggttgattatgttcccttaaaattcatatgttgacattctggcccccaattctttagaatatgaatagatgtgtgaatagggtcattgaagatgtgattaagatgaggtcatgctgtagagtgggcctgcaatccaatatgactagtgtacttataaaaaagagaaacttaaacacagacatgcacacagggagaacatcatgtgacgatgacggcagagattggggctgatgcttctataagccaaggaacaccaaagattgccaggaaaccaccagaagctgggtgggagtcacggaactcacagccttagaaggagccgaccctgttgatactttaatcttgaacatctagcttctataactgtgagacaaaaaatttctgttgtttaagccactcagtttgtggtagttcgttacaaagccccagaaaactgatatactcagtaaaagaaaaaatcttcagtatattggaatcagttctttcactcatcaggtacttactgagtgcctactatgtgctaggaactgctctaggatattgaatgaatgactaagaacttcatcacgttactgcattttttgttcactaataagtaatcaatctatcaatcaatatattaatagatgaaatgcctatcatttattttatcagcaaacatttgttgagtatctcctatgtgtcagacatcgttctaggcacagaggataacattattggcagatcaagttctccaccttgtatagtttaaattccagtagagggaacatatattaaacaagaaaataagtaaataagatatgtaattttactctgtttctgacactgagagtcataggcatttatcctctaaatcactgaacaaagcttggaactagatagcgaacatgttacttcacagtttacaaagtaataaggaagacaatgaggtctcatactagaggcacgttaaaccacaggcagtgtgcaggcttaaagtgtttgggaaggacatcccaaaagctaggtttcttagtcagttcgtcagtcaatcaacacatatttcttttttttttttttgaccaaatttctctctgttgcccaggctgaagtgctgtgacacgatctcggctcactgcaccctctgcctcccgggttcaagcaattctctgcctcagcctccctagtagctgggattacaggcacctgctaccatgcccggctaatttttgtatttttagtagagatgggatttcaccatcttggccaggttggtcttgaattcctgacctcatgatccacccgcctcggcctcccaaagtgctaggattacaggtgtgagccactgcacccagccatttgacatgtattttttaagcgcttactgtataccaggccctatgctgaagatagtagaactgtggacagagccaacatggtactattacccactgagctcacattctaaggggaaaaatttgaacaacaaatctcacagtccgttctttatcatatatcctcataagaatacataaagggggttaggagatcacctgggtcagaggactggcccatgaggggtttccaaggggccttccttgaagatgtggtgcccggacactgctttagggctggggtatgggtattggtttgagcagggtcatgaagttttcggtttcttcttcctcatcccctttcaaccatgtacacacatttcaaatacttaaaagcattcttcaaatatactaagaacaccaagaactaaacacaagagaaggactctccagaggaaaggggccaaaaatagaagagaaaaaaaacccctaatctcaccatttgttttgaaaacacccaaaatgattaaaacatattataaactaaaacatatgaactaatcacttgccaagtttcatttttaaatcaaagccgttttgaggttcataaactgaaaaaagaatcttcaaatatgaacttgtgtttttcttttcttggccctcagttggcttgaagcatttgctgttatgctgtgtggagggaaggggaacctgctagttaggaacatgtggcatgcatgtactagaaggtaagctccacaagatcatgactcttcacagtggtatccctggtaagtagaagagtgcctgaaagataacaggggctcaataaatacctgctgaatgatcaactagtgaatattctgggccctttaagggattctccaactctcttttcttacccaagctgcatcttgctttaggccagtggttctcaacctggggctaatttttgcccccagtcaggggatatctgtattttttgttgtcacagttagagaagttcctactggcatttagagggtagatgccagggacgctgctaaacatcttacagtgcacaggacagccctgttccacagagatttatctggccccaaaggttaatagggccaaagttatgaaactctgatttatgccctttgtttctattgggctgtacctgggagtcagatcctctgcatatttggaatgaagttcagtcctaaaggaagcaccccagaaaagcctcattgcttcatcctcattcccttcaagacctaatagaactgcccccactctaaggcaggctcagagagagccaattttgccttttgtcctccctgggtcaacaatgcaattgctagggaaatcatctgaaaaagtctgtctctacaatgcaagtaaataatttttacagtacattggtaatttccctgagcttacctaagcatatatactaatttagtaaaattctcttgtttacaaactagtcatgtatctgcaggaaaaaaaaatctcctcaagttcaaccagtttatccatgtctgctcaggatcagtacatgactctagctttattcatgataaataagatcaacttcaagaattccatcaaaccccagtaatgtgcctttagagagactgggcttatagcatttcctctgccaccctccttgccctgcatattaaaatacaggtatctgattccagtttcaatggggaaacttctgtcgtgccagaggagggcatgcgctgatttccccactctgatggttgctctagtaatcttggtgttgtggcatgtttcccagttaccatagagactgcatacactaagactgcagcattgtgattggtgggaaagatacattttgcagaagcttttctggagagataaaggtaagacacgagaaagaaagtgagactgccaataaaggggcagagcacagagaagtcccaaacaaccatacattctagaaaactgggacagcagagattacaactactgctataaaactacataaactgttcactcaatggctgcctgtcaggaaaatttcaagtattgtcagacagaacagacacaagatattctagaataaaaaggtaaacaagtaaacctactgaggttataggggtgacaaaagggaaatggcaagaaaacatttaaaaatgattcaatgctagaaaaaaaaaagaatctcagagagcaataaaatttaaagttacatttaactttaaatgtaggctgacctttggggaattatttaaattctgagtacctctgcttccttccctatgaaaaagaaaaagaaaaaaagaataaagatggaaatagaaagaataaagatgacttctctctcactgtttaacaggagtctctttaaatatctcaataatttgacattatatcagttgaatatgatgtaccccccacacaaaaatcagacaaaaacacttaaagggggtgataaatagggggacgtcattaacaatgcaaattgactcattccatagtttcttagagtaatgagtcaactgactacgtgatctcatgtacataattttgttcggcatgagattttgaggtatacaattactacagaaatcaaggtatacctgcaatgtaaagggtaaatcgtaggcattttaaatgaaagctggggataggatgtgtgttggtttgagggatgagtgggagtggatttaagagaaaatcagtctaggaaaatatcacataagtgtttgtaagttccttgatattcaggtctgtatcttgtaatgctttattaaacatatttcagactaatatgtccattgcctactggacattcatatctccctgtttttaaatacctttcaaatctgtatcttgagccattacttatctcttgacctctaaccctttatatcaaatgaattactagacaattacaattagatattccaaaagcatcctaaattcaacatgtcaaagctgaactcatcttttccttcaaactttctcttcctcctatgttccctatgtgagtaaatattaatagtattaccattcacccatctgccaaagttccatacctaggaagaatcatggttgcttttatctcaccttcaaataatcacccgtgcatatagatgtgcaatcctaataaccaaaggaggccttttttgaatagaaagcaatatttacagttaattgggttttgaactaatattaatttattaaacttacaaattttaaaagcctagttttctttacacctttacctgttaaaaacacacatatatttttctatgtcttaatatagcaatttttgcataaaataagaaaaattactttcaggaagggtgagattactagacaaaaaaatttgggacctcaaactatttcaactgtcagtcagaatgttaaaagaatgagagttagggtctgatctgggaacacctttcaaatgattttgccaaggtcaccagtagacacactgaatgtttttatagtcactctgaaaatgagaaattttacgtctataccctacaaaggaaaatttacaatccaggtcctctatgtttaagtttcattcttatctaactcttttataatcactttccactttatagcctgataaaggtagacaatattttgtgtctccactaaccaggtttcttgaatctagtgccctttcacttcataacgtttttcacatttctacctctctcatccccattgcaccacattagctcagagcatcattatctgtcacttgtaatattgcgacagtacattgtactatattttcttaagtttctgagtctttgcacatgtcaccacctgtgtctagaacacccatattccctgataaacatttactgaatgaaaaaaaagttaataaatgctttggatgttgctgctttgggtgctgaacagaaatagtggcctatctaagattctggataagcctgcataaagcactcttactttcaaaattaattttgaagaataagaaaattttgccatggagaatcatggagcctatgccacaatattatgttttgcatttaataaaacacctccaaacccagggaaagaatcagttattacttccttcaattcatacaacgaatatttactgaacactctctatgtgccaggctctgtactaggcactgaggatttcttagagcatagaacaggcaaaaaacaaacaaacaaaaccgaaaaaaacctcacaatcatggggcttatattccatggcaagaggaaataaatgtgtaaataaaatatatattttgtctgaaggcagtaggtgctatgaaccaaaaggggtggaaagctaaatgttaaatacagtggttatgaaaggccttacttagaagtgaaaattgagcaaagacctgaagatgataagcaaacaagccttatctggggaaaacatttaaggcggtcagaaaagcaagtgcaaatgtgaaatcatgcatggtaggctggaggttaggaagggggtcaatgaaggttgaggggagtgagctagggtggagcgctaaatgaagacagagaggtaatggggaaattgaatatggagggtcttgtgaactactgcaaaggcttttcttccaagtgagatgttgagccattagagagttctgagcagagaagtgatgtggtctgactgaaattacattacatatattgcaaagcatcactctggctatcattttgagaatagactgtaagtggtaaggccagaagcagggaagacaattaggaggctactgcaataatccgggtaagaaatgatagttgcttggattagggtagtagtggtgatgaggatgaggagtggtaagattctggacttattctgaaggtagagctgcaggatttgttcaatggttgggtttgtgagagaaatacaggtctgggagagaaataaatttttgatttgagtaaccctaaaggtggagcgttatttaccaatattggggaggctatgtatttgcttggtaaaataaggaattccatttctggtatgtcaagtttgagatgctcattagacagacgtggagatgttgaataggcagctgaatatgtgagcctagaattctgtgtaaaggcctggactagagatacaagcttgcaccataagcttgggtgcaaatattaagagagtgaatggagctgaagagaagagcttcaaagattgagctctagggccctctaatgtttacctgcttgggaaatgagaatatgctagcaaaagagactgaggaggagtagactgtgaggcaggaaaaaaatcaggagagtgtggtggactgaacgccaagcgaagaaagtgttttaatggagaatgaataatgggccatgtaaaacaattctgagacatcaggaaagacaaagactgccgaatggttaatggatttagcaacatggaagtcattggtgaccttagcatcaacagttttactagactggtaggtgcaaaagctaactagaggggcaaaagagaaccagagcataggattggagagtgtttatagtgactatacgcatttcttgagaagttttgctgtaatggaaatcaaagaaatgggacaggagctgctagggagtatggtttataagggtatttttaggatgagataaattatgtgtttgtatactgataggaaagttttgatagaaagagaaaatttgataaaacagaagaaagatgtgagctttttcaggagcactgtttatgcatgtgcaagaggagagagattctaaggcacaatgagggatgggctgagccaagggtacacagagtttatccatagttgcaggagagaaggcaaaatacatgggtacagataaatatgggagggtaggtgtgctggacagcaagtatttgtgaagttgtcttttgatggtttctattttttcagtgaagtaaaaagaaaggttctaagttgagcgtaaggatgggggaggaggtgttagaaatttgagagagggaaaaatatgaaatattcttgtacagatatggaagagtaaatgacaaggaaacatattatatttgctgggcagcattaacggcctccttgagggatcatgaatttaaactgagagtcatacatttgcttgtgtgtttttctccagccacattcagctggcacacaggcatgaaatagatggcgagttgcatatgatcagtatagttgagatttgtcaagagagcacagttaagtcagagaaggtcaatggtgttaaaggcgcatacaaggaaatgattaaaatcattgtccatggaatctacgctatataatgaagtgagcatatgagaagctatgggtaaaatcaatgaattaggggtcctagtgggtttaaggaattggtgtattaggggtaacaaagggattgaactaccaagacattaggctgtggttggaaaatggaatgcttgaaattgagattgtggaatattgtaattattagtaattaaaacatcagaaatgtagccatgggaatgagtagctatggcagagtggagaatcaatcatgagaagttcaagaaattgagaggaggtattagagggagcgtgtatttacacagtgaataaccaataattgtaatggggtagaaatggaaagagtgttagtgagctaggggctaacgttttcaaggaattgggaaacttgcctggtagacaactgcatcaagggggagttatgggaacacttagcttttctactacctcctcaatgtttcctctctctcactttccatctttccagcttatatactggcattacaaactttaatttcctagactagatagctacatatcacctgtgtctaccctttctcctccctatccaaattatctccaagtcttgagaatttccaatttttttttctgagatggagtctcactctgttgcccaggctggagtgcacagtcatgccatctcagctcactacaacttccgcctctcaggttcaagcgattcccctgccgcggtctcttgagtagctgagattacaggcacgcaccaccacacccggctaatttttgtattttagtagagacgaggtttcactatgttggccaggctggtctcgaactcctgacctcaaacaatccacctgccttggcctcccaaaatgttgggattacaggcatgagccactgtgcctggcctccaattttgaatactctctactctccccctttgggaccatcactactctagcctgtcactctctattttatcactcagattaatgttcttcatggcactaatcgctctctaaacttaacttgttcatttatttgtttgctttttttgttggggggggtgtctattttccttcattaaatataaatttcataaggggaaaagttttgtttaatttgtgcctggaacataatatgccctcaataaatactttcaggatgaattaataaatgccccctataacatgctgatgaatccttatattcttgggttcacacaacagctttgctttactatcctaccagcttctccctcctttcctgctcaaaccatccatttcaccgagtaaagtcatttcactactcccccaaaacaccatgttcatttctattcagatgatttcatcatatttctcccttgtttatgtctattccccacataccaattctttgagtcccagcttaggtcttacttctcggatggtttttctatgattaccatgaggcctgctgatttctccctcctctaaaatcctgctatccctaacaacaccagctgctttatattttctaattgtttcatatgggttattcttaccttttcactttaaaataggtttatttttggcctaaggatcctgacttacaactacagtatactcagtaaaaactaacacagtgtagggcagataacgggtattcaaaaaatactatggcctccttagatagcttcatagacttccatcttcctcaacaaacattttctaccttttaccctgctgttagctaaatctaactattcttcctgctctatgatactgtctttgagaccagaaccaacccctatgtccactacacagaattctacactcttgcactgcaattcccacagctaaatcattgtcattgccattattgttcctggattctcttggcaattttagtatattcaaggcatagctgccaagatcatcatcctccttgattgtttggaatctttatttttttaaatccctgcattttttccatcaaactttaagtgttcctgtgggatttgtttttccttggctccatccttggcctggttcttctccactttcttatgttcagtcactcgatttgccctttgtctcatttgaaggaatcagctttcacaccttcttttaaactaccttgcatatttagaatattttctcaaataatataaaatttataatatttatgaataaatgacacaatgccaagatattctgtctcttctttcaaataacatctgaagatgcacctgcactagtgagttctatatttaagatattgaataagtatcattcacccatctgctttcattctgtcctgcattttttaggacctgcttcagagttgtattttgaggtcttttggacggggaactgtctggcatagttcacaaactggcctttgctctgtatattcatgttcctttgataaataataaataataataatagcccactgtgcatttttacattccactcataaatccctggaaaaagaaaaactaacaaccagggattataatagaaacacagaaacaaaactaaccttttaccaggttttgctacagtaatatatacttccatagacctatattctaacaaataattacctgcttaagtcatttgtaaattgttcctttgccaacattatgtataatagcaaatgtctacgtggtttataggacagggaaaacaactagaacattacagctatgtgggggatcagtgcaaaagcagcaaaataagaggtttactctgttgggtgcacagtttggaagaattagtctcacaagtagaactacttgacagaatatatgcctgctctccagctcccccttctcccctcctccagatcttttttcaataatggaagaagacttactttcttttttcaaatccaggtgggaagtgtatcattttgcgtgaaaaatctgtttttctttgaacataacaaatggtctgattgaagctgctctatgaaaacggcagcatatctaaccagggaggtgggaactatagtttaatgggtggagcacctccatatttagctgcagatgagccacatttaactttaaaaaaaataaaaatttaaaaaataaaagaaggccaaaatgtaatgattgtcttgttactgcagtggccactagatggcaggtccaaaaatctgatgggagtctcacaggagggcaaatcttagggagcagaatgtttctggcactcaatccagtgttggttcatcaataagccttggcagtttgctaaaatatcaggtgggtaagacaatatccatgttatttcacagggctgaagggggcaggaagccctttggtatctaggtttgtagagtattgtcatcacatactcacacatccagatactgctacccctttggacttctgtccacagacattcttggagctggtttttatatatgttcagctgtattccattatctaatggtctgtgcaatactgagccataatctcaggagtgtaaaaggtagttgtctaatctgcctccatggaaacaaatgaaggaggctgtcaggctagggtaagggaacatacagctgtactgtatttaacaacatatatttaccagtaattgcaacttcatgttaaatatgtgtatttcctatactggaggctgaccatatattcatgttaattgttttgaaaaagagaatgttgatatataagagacttattatttaataggataaaataactaaggcctatgattaaaaatgaaatgagtaaatttagaacaaattatttgttgtacacagtagagttttcattttcttttactaggatgggagacttctagatgtgggtcttatgagactataaaaaagtcattcttggaccaattattctgaagatagattgtgtctttcccttcataatttttttttttttttggttactagattatcctgataaaagtgatttcactacatggacaatgcctacttttctttatcttttaattaaagaactgaccttatgatttttaaaagtagagaatcacaagctctgagataatttatcattctcactaaagaaaatgtgctctagagtcaaatttatctttgtacaagagctgtgacatgcattttgatatacatttaagcatctatgtcaattaaaatattataaaaataaaagcaacaaaaactcaattatagccatgcaactcagtcatcactcaccttttgttccctttttctttgaaaatttagatagaataatggtaaacatgttgatttcatctattcttgctctgtatatttggactgtgaaatgtctacatgagacacaggaagagggcacgggtcttcaggataaaaaacaaaaaaaaatttttcctaaagaagaaatatgggctatattgaattatgatagatgttttaaatcagtaccgttttcctttagtttggagtaaaatttaaaatgagatgactgaaataatttacgataaaatatcatggttatttctacatatttaaggtttaaaaatgctcaaacttatactttcctcatagaaagagcactggaatgggaaactgagaggtctgggttctattctggctttgacagtgactcactgtgtgacatccagagagcatgacctccccaggctcctcacttctgaaatgggagggttttgaggacaaagtctctctctgctttaacattcaatatccaagtaagtaaattgctacgtattgcagatttttttttcctcagaaatagactaatttcctccgatgaaagaataatactgttaagaagctgatgttgaaagctaacatgtccctaccaacactgtgggctctacccatgcaggtgaagctagagcttgttcttccttcaatcccccctttccctattctgcaccactcttccacacactcccccatcatctttaagtctaaattctacctgagaggtcctctgtgacccctaggtagttacttgctaattattactaattattcaataactgttttacttttcctcttgagcacatagctaagttccatttcccagccttctctgcagatagctatggccctgtgaccaaattctggtgagtgggatgttggtggaagtgacatacgctgtcccaggcctggtccattaaaagttcctgtgtaatcattgctctctcttcaccagatttctggctggatgtcacacccacagcaatcttggaagctatgtactgaagagcctctgtcaacctgggtccctgaccagtctttacatgagcaagagagaaactcatgttgaaatactgagatttgggagtgtgcgtattatagaagctaatgttaccttaactaagaacactcctaaagcagaaatttgttctctctccgagacattatgtctcttttaccacattttccacctttaataatttatttactgatatgtaagctccttgaggatagtacatttgtttcactagtgtacccacagaactctagttagttgaatgaattcagaatagaacatagctggtttggaaagtacagaagttacagaaggtagtaaaagcagtttgatttttaaaaattctagctttgtgttttatcctataatatttaggtagaaggtagggatgatgggttggggttttgttggtgtggaaatgtattgtgacaaccacagccttttaatatattttgtgtactgcatccccaataaacatgttttccaaataaagtgtaaagtctttttctaaatgctgtatggcttgccttttttatatatttgtgtaaagaaattcgtagtagtaattctctgacactgagttaaaggaagtcctattttttttcacaattatgtgaaaacacaattatgtgctgtataatgacattttagtctacaatggaccacatatctgactgtggtcctgcaagattataagataactgaaaaattcctaatgcctagtgatgtcatagtgatcataacatcacagcacaattactttttaaaacataaatttagtgtagcctaaatgtacagtgcttataaagtctacaggagtatacagtaatgtcctaggtgttcacattcactcatcactcactcattcactcacccagagtaacttctagttctgcaagatccattcattgtaagtgccctataaaggcatacacttttgatcttttatgctgtgtttgtactgtaccttttcaatgtttagatatgtttagatacatgaaaacttaccattctgttataattacttacagtatccagtacagtaacatgctgtgcaggtttgaagcctaaaagcaataggctatatcatatagcctaggtgtgtagtaagctctatcatctaggtttgtgtaagtacactctatattgttcacacaacgatgaaattgcctaatgatgcatttctcagaatgtattccctttgttgagcaatgtgtgactacattttgaaaagttaaaataatactaaagggagggacaagtgaagagctaacttgagaaatctaagaactaggtaatttaaaagaagtgcttttagttacatagggtttttaacatcattaccacctatgaaattacaggtattaactactgtctcaaaatgatcatcgcccttttgatactttactctcagtgtcatggctgacctcttttgagtcaagtttattggacattttcagttttattttttaattctcatcactgcccctccctgaaatacttcatccctggtttccttaataatactggcctaatttccctattctctatctctagttttctctcctcttttgtttggctcctctttctcatctattctttaagtattagaatttcctagtgttctgctctgagtttttctttctctcataatttttccttgagtcatcttatctagtcttatggctttacctactacttcctcacaaataactcccgactcttgatctttagcccagacctttcttcggagcttcaaaacctgtattgcctatagtatcctgggcattttaagaaaatctaaatattttgtgccaccttaaattcaagtcccaaaccaaaagcactccttgccctttcaagtcaaaccttcttcctcctgtgttccagctcttggtagatgacatcaatttagaaacattaaactctccttttctttctttcttgtcccttatctaaattatctaattaagttctaaatcctgtagtgcttttatagtccatttgagattttagcctaagtttgaggactagataagtgaagacagattaaaaataagacttcttttaactcagtgtcagagaattactactatgaatttctttacacaaatatacaaaaaaggcaagacatacagcatttagaaaaagactttcatacccttccatcataccagagttccattatcagcctgaagagaaccaggagagctgtcctgagagggagctttctcacaatcaggactggattgaaacaaaatagaatcaatggaaagaaagatttttggggaggggagagaagttttgcttgctgctggtcctttggtaacctctgcaaaagaaaagtttaaaaaatgaccctggctggcaagatggccgaataggaacagctcccgtctgcagctcccagcaagatcaatccagaaggcaggtgatttctgcatttccaacagaggtacctggctcatctcattgggactggttagacagtgggtgcagcccacagagggcaagccaaagcagggtggggcatcgcttcacccaggaagcacacagggttggggaattccctccgttagccgagaaagccgcgagggactgtgccatgaggttcggtgtattccagcccagatactatgcttttctcaccgtcttcacaacctgcagaccaggagattcccttgggtgcctacaccacgagggccctgggtttcaagacaaaactgggcggccgtttgggcagacactgagctagctgcaggaattatttttcataccccagtggcacctgcaatgccagtgagacagaaccactcactaccctggaatgggggctgaagccagggagccaagtggtctagctcagtggatcccacccccatggagccaagcaagctaagatccactggcttgaaatccttgctgccagcacggcagtctgaagttgacctgggaccctcaagcttggtggggggaggggtgtccaccattactgaggcttaagtaggtggttttcccctcacagtgaaaacaaagccaccaggaagttcaaactgggtggagcccaccacagttcggcaaagccactgtagaaagactgcctctctagatttctcctctctgagcagggcatctctgaaagaaagttagcagccccagtcaggtgcttatagataaaactcccatctccctgggacagagcacctgggggaaggggcagctgtgggcgcagtttcagcagacttaaacgttcccacctgccagctctgaagagagcagcagatctcccatcacagagctcgagctctcctaagggacagattgcctcctcaagtgggtccctgacccccatgcctcctcactgggagacacctcccagcaggggtcaatagacagctcatacaggagagctctgggtggcatctggtgggtgcccctctgggatgaagcttccagaggaaggaaccggtagcattgtttgctgttctgtagcctctgctggtggtacccaggcaaacagggtctggagtggatgtccagcaaactccagcagacctgcagcagagatgccagactgttagaaggaaaactaacaaacagaaaggaatagcatcaacattaacaaaaaagatgtccacacaaaaaccccatccgaagatcaccagcgtcaaagaccaaaggtagataaatccacaaagatgaggaaaaaccagcttaaaaaggctgaaattccaaaaacccgaatgtcgtttctcctccaaaaaatcacaactcctcaccagcaagggaacaaaactggatggagaatgagtttgaggaattgacagaagtaggcttcagaaggtgggtaataacgaactcctctgagctaaaggagcatgttctaacccaatgcaagggagctaagaagcttgaaaaaaggttagaagaattgctaactagaataaccagtttagagaagaacataaattacctgctggaactgaaaaacatagcacgagaagttcatgaagcatacgcaagtaccaatagctgaatcaatcaagcagaagaaaggatatcagagatgaagatcaacttaatgaaataaagcatgaagacaaggttagagaaaaaagaatgaaaaggaatgaacaaacctccaagaaatatgggactatgtgaaaagaccaaacctacgtttcattggtgtacctgaaagtgatagggagaatggaaccaagttggaaaattcttcaggatattatccaggagagcttccccagcctagcaagacaggccaacattcaaattcaggaaatacagagaacaccacaaagatgttcctcaagaagagcaaccccaagacacataatcgtcagattcaccaagattgaaatgaaggaaaaaatgttaagggcagccagagagaaaggtcaggttacccacaaagggaagtccatcagactaacaacagatctctctgcagaaaccctacaggccagaagagagtgggggccaatattcaacattcttaaagaaaagaattttcaacccagaatttcatatccagccaaactaagcttcaaaagcaaaggagaattaaaatccttgatggacaagaaaatgctgagagattttgtcaccactaggcctgccttacaacagctcctgaagaaagcactaaatatggaaaggaaaaaccggtaccagccactgcaaaaacacaccaaactgtaaagaccatcgacactatgaagaaactgcatcaactaatgggcaacattaccagctagcatcataatgacaggatcagattcacacataacagtgttaatcttaaatgtaaatgggctaaatgccccaattaaaagacacagactggaaaattggatagagtcaagacccatcagtgtgctgcatttaggagacccatctcacgtacaaagacacacataggctcaaaataaaggaatggaggaatatttaccaagcaaatggaaagcaaaaaaaaatgcaggggttgcaatcctagtctctgataaaacagattttaaaccaataaagatcaaaaaagacaatgaagggcattacgtaatggtaaagggatcaatgcaacaagaagagctaactgtcctaaatatacatgcacctaatacaggagcacccagattcataaagcgagttcttagagacctacaaagagactttgactcccacacaataatagtgggagactctaacagcccactgtcaatattagacagatcaatgagacagaaaattaacaaggatattcaggacttgaactcagccctgggaacaagtggaccaaatagacatctacagaactctccaccccaaattaacagaatatactttcttctcagcaccatatcacacttactctaaaactgaccgcataattggaagcaaatcactcctcagcaaatgtaaaagaatggaaatcataacaaacagtctctcagaccacagtgcaatcaaattagaactcaagattaagaaactcactcaaaaccacacaaccacatggaaactgaacaacctgctcctgaatgactactgggtaaacaacaaaattaaggcagaaataaataagttctttgaaaccaatgagaacaaagacataatgtaccagaatctctgggacacagctaaactaatatttagagggaaatttatagcactaaatgcccacaggagaaaacaggaaagatctaaaattgacactctaacatcacaattaaaagagctagagaagcaagagcacacaaattcaaaagctagcagaagagaagaaataactaagatcagagcagaactgaaggagatagagacatgaaaaacccttcaaaaaattgatgaatctaggagctgattttttgaaaagattaacaaagcagatagaccgctagccagactaatcaagaagaaaagagagaagaatcaaatagacacaataaaaaatgataaaggggatatcaccactgatcccacagaaatacaaactaccatcagagaatactataaacacctctatgcaaataaactagaaaatctagaagaaatggataaattcctggtcacataaaccctcccaagactaaaccaggaagaagtcaaatccctgaatagaccaataacaagttctgaaattgaggcagtagttaatagcctaccaaccaaaaaaagcccaggaccagacgaattcacagctgaattctatcagagatacaaagaggagctggtaccattccttctgaaactattccagatcatagaaaaagagggactcctccctaactctttttatgaggccagaatcatcctgataccaaaacctggcagagtcacaacaaaaaaaggagaatttaaggccaatatccctgatgaacattgatgtgaaaatcctcgataaaatactggcaaaccgaatccagcagcacagcaaaaagcttatccaccacgatcaagttggcttcatccctgggactcaatgatggttcaacatacacaaatcaataaatgtaatccattatataagcagtttagagccaatgacaaaagccacatgattatctcaatagatgcagaaaaggcctttgataaaattcaacaccgctttatgctaaaatctctcaataaactaggtattgatggaacgtatctcaaaataataagggctatttatgacaaatccacagccaataccatactgaatgggcaaatgctggacgcattccctctgaaaactagcacaagacaaggatgccttctctcaccactcctatttaacacagtattggaagttttggccagggcaatcagacaagagaaataaataaagggtattcaaataggaagagaggaagtcaaattgtctgtttgcagatgacatgattgtgtattcagaaaactccatcatctcagctcaaaatctccttaagctgataagcaacttcagcaaagtctcaggatacaaaatccatgtgcaaaaatcacaagtattcctatacaccaataacagagagccaaatcatgagtgaacttccattcataattgccataaagagaataaaatacctaggaatacaacttacaggggatgtgaaggacctcttcaaagagaactacaaaccactgctcaaggaaataagagaggacacaaacaaatggaaaaacattccatgctcatggataggaagaatcaatatcgtgaaaatggccatactgcccaaagtaatttatagattcaatgctatccccatcaagctaccattgattttcttcacagaattagaaaaaaacaattttaaatttcatatggaatcaaaaaagaacccatatagccaagacaatcctaagcctaaagaacaaagctggaggcatcacgctacctgacttcaaactatgctagaaggctactgttaccaaaacggcatggtactggtaccaaaacagatatatagaccaatggaacagaaagaggcctccaaaataacaccacacatctacaaccatctgatctttgacaaacctgacaaaaacaagaaaaggggaaaagattccctatttaataaatggtgttgggaaaactggctagccctatgcagaaaaccgaaactggaccccttccttacaccttatacaaaaattaactcaagatggattaaagacctaaatgtaagacctcaaaccataaaaaccctagaagaaaacgtaggcgataccattcaggacatagtcatgggcaaagacttcatgactaaaacaccaaaagcaatggcaaaaaacccaaaactgacaaatgggatctaattaaactaaagagcttctgcacagcaaaagaaactatcatcagagtgaacaggcaacctacagaatgggagaacatttttgcaatctattcatctaacaaagggctaatatccagaatcaacaaggaatttaaacaaatttacaagaaaaaaacaaaccccatcaaaaagtgggtgaaggataagagcagacacttctcaaaagaagacatttatgtggtcaacgaacatatgaaaaaaagctcatgatcactggtcattagagaaatgcaaatcaaaatcacaatgagataccatctcacgccagttagaatggcgatcattaaaaagttaggaaacaacagatgctggagaggatgtggagaaataggaacgcttttacactgttggtgggagtgtaaattagttcaaccattctggaagacagcgtggcaattcatcaaggatctagaaccaaaaataccatttgacccagcgatcccattactgagtacatacccaaagtattagaaatcattctactataaagacacatgcacatgtatgtttattgcagcactattcacagtggtaaagacttggaaccaagccaaatgcccatcaatgatagactggataaagaaaatgtggcatatacacaacatggaatactatgcagccattaaaaaaggatgagttcatttcctttgcaggacatgaaactggaaaccatcgttctcagtaaactaacacagaaacaggaaaccaaacactgcatgttctcactcataagtgagagttgaacaataagaacacatggacatagggaggggaatgtcacacactggggcctgttggtggctggggggctaggggagggatagcattaggagaaatacctaatgtagatgacaggttgatacgtgcagcaaaccaccatggcatgtgtatacctatgtaacaaacctgcatgttctgcacatatatcccagaacttaaaagtataataataataaaaaaaagatctaatggctaaacctatagaaactctagctagacctgtggtttctattccttcctgggtataataataaaggctcacatttattttaagtgttacatttttcattgacattgaaatgagactcccttttcgactaatcggctgctttgatttcttcaccctaaaaatcactcttcaatgttttccacaattcttcaacattagtaataacttcctatatagtatctgtggtcctttttctttccccagtgtgatatatttatcatctattacacaaacttcctcttttgcttcctcccttttcaccaccagctctaacatcttaaattttcatttgacatactgcttacctaaattatttcatgtgtgttcccatccatggaaattcatttttgtgtgacataaatccctaccctactctatttcacagtaataaaactttatactgaattgccaaagagataggtaaccaaccacgcagtttaaattaagtgcaagatacacatgtttgaatattctgctctctgtctaagatgtgtagagacaggtcctgtttgtgtctgagcattctgtcatcttattcaaactgttggagttaaatcacctaagaactgttttctcactttgattcaaaagtaacttctgctatgcaaaaaaagcacagttatgaaataatatgtgtattaaaaaatctcaaaaataatgattagagtcacattcagtctgtgaaaggagtagctccatgacttgagcacatgccaatgagattagaactcatcgggggttggcattctcattgattgttgtccctctgtaccttcaatggtttccagtccttgtccaagttaacctttgctagttgttgtagccatggtaaatatcctgtttattggattttattagcgttttaaattttgacatttggaaaagcacaatcctccttctttttcatcctgtcatctttagtgtataagtgtccaggctccttccaattttaagtttctctttcctagctttagaagattataattttggaaagtcacaattattctgctagttggtggccagaacatatcaattgcatgtaacaaaattttattcagatgcatcattcatacattttaagtctcacggtttacttctttcataattatttgacatttttggtgaaataagtttagttctgaatcacccattttgttatgttgattctccactatttttggcgatacaatagtaataatgttagacatttgtatagcagtgtaaagttttcaaagtgcttccacatacacagctcttatttgcttctctaccttaggacataagcaatgtggtgttatacccattttacagataaagaaacacaggaacagagtattactttggatcacacatggtaagcctcgaggacagaatgagctcctgtgctagtgttctttccattgcatcgtatcattagtaatgtttacttacacctacatacttactgcttttcaaatatccagacgtcatctcctctactgtaccactctattatcactcgtgtcatattctgtttttatctctttgctaaggctatacccacccttccagttccccactgccctcattagactctgagctgctcgagaaaaatgattcatccatctttgtatctctagacccaagtaagatcacaccacatttttgccaagtctctcttgtgctataaatgttcatcttctcttagttgtaaattgctttcaacccaccttttttttttttttctaacttttattttaagttcaggggtgtaagtgcaggtttgttatataggtaaacttgtgtcatgggggttgtacagattattttatcaatgaagtactaagcttagtacctattagtaatttttcctgattctctccctcctcccatactccatgctccgaaaggccccagtttgtattgttcccctctatgtgtccacgtattctcatcatttagctcccacttataagtgagaacatgcggtatttggttttctgtggttttctttggttgctgtgttagtttgcaaaggataatattaccactgaccccagagaaatacaaacaaccatcagagaatattatcaacacctctgtgcacataaactagaaaatcaacccataatttttaagtttatgttataaatattagtattatctgagaggaaggcattacatccataagcagaaaggtggaaaaatcaggagagtgagtgatttatttgagagtatctggtttgttagtgaaagagatatgaaacaaacccagggctcctcatacctaggctacatctgtaacaccaaagtccaatgtactggtaccaaacagactggcacttgtgggatgctgtgtaagcagcatggacagtattcccttatccccagtgcaggctacagttgcttaaaagaactatggaaaaccggacattttgttcccttctaatttatctgtgttcctgtagccatgtctccacttctaaacgctaatcacttctctaggtgagcttaagtacctaattattaagagccctccaaatttctagtgtcatcttcaatatagttagtgccctttctgtcccatttgccccctgtgcttggcactgaatcagtatagcaaatatccctaatgaagaatcatggtacagggttaaatttacaaattaagcaattcctttagtttttatgtcaattccttttatccttgtatccccaccctgcatttgcttaaaattcatcccactgagaagctaaaaaaacaatgctactatgacgatttaaagagaaatactgaaccctaggactttttcctgagattcttgttacctgtaaactcttgaatataggatcagattacctaggcttccagggaatagtaagaccatacattagcagatttaatattaatctctagaatcccagatttacttcttgtccaggttaaatgcccttttgattattttagcaaaaaataatacaaaaaattgattacaaccattaatggaggcttaaaatgttaactcccatagctttaacccagtatctatgattaaatgcaaaaaatctaagttaatgcaatgttaaggttgagcttctaattgcacaaaagtcatgaaatttaaaattaaggtttctagtgctactctctgtcatttctacaacattcctccaatggttttctacaatatatgtttcatttaaatgtgtgtgttgtagagttcccaggaaagaacataaagcacaacagatcaggattcaacttgtggatacctagttttacataatcaatatggctggaaaagtgtgattcttttttaaactacaatgccctatttgagtgataaccatattcctgtttacaaatttgcccatttcctctaaaaatccttgaatcttcacttctgattacacactagccatcccctagagaaggaaagagcatttatgtaataaacaaaccaaacaacctgtggactgtgatagtacctacagaccttttcttcaacatatgacaaagcatattcatgtgggattaatgttgaaagagtaactcagaatatttaggtttatgggtgcatctagcagaacaagcaaaggtgaatagggactggaatcctgttaatactattaataggactagctgaggaaactgtcatcaaattattaaacctctctgaatgttattatcagagtaagaatacctgcttgtaggattattaggaagaacgagtgaagtaatatatgtaacacatgctctttaaaactctcttggagtttatagtaatagatcaactattactattaaagaatgagtaatcataatttaatgatcatctggatgtctacaggtattttggaaatatgaaacaatgataatttaaaattcattttattgaaagatacctagaattatttttttcacaatagtttcattaagttaggtatttgtttatagcctactatggaatgcccagataacatttaatacatgatgcactgagctgcatcagctaactctgaaggcaggtgagttaaatgaattcttggatattgggctgccatgcccaatattttcttcaaattttatgaaacatttgtgtctaaatagaaaatgtgcttgagaaattctagcccaacatgcaatttagagagaaagttataaatcataaatataagagcttagagctaaagtgccacctcaaccataactataataaaaactcctaagtgcattctggcaggaataaataaaaaatggcaaagcctgttgtggacggtgcagagcccaggaaggtaaccaagtgagtaaacagctaaggcaggattatcctcatttgggaggactccattccagacaggaattaaagaggaggggctggggaagggagaatggaggttgtgggagaaagtgtttttgcatttgaaagcagctaagttaccttgtgtaatgaaaaggaaatttgtttttttcctttcaacagtaatctcatttgaggtctagcagactgctacacaaaagatacatgtgttctacctacttggtttttctcctctggcagtgaggtacacaggaagggttcaggtgaatcagaaccattcagaataacatagtcaaattcctttccaaaggtttaaatacctattctttaatagctttcttcaaaagactggtaacttactgcactgttcctggcacattcacaaccaaaatttgttcctgggagtactataatacgatgcaacaaatgggtttaaacgaaagctggaaagatctatactgaaactatgaatcacaattactgaaagcaaaaaaatctcatacacatataatatccagaaaaacatacaactgtcccttggtatcctcgagggactgattccaggaccccactgcagatactaagacttgcagatgctcaagtccctcatatgaagtggcacagtatttacatataacttatgcacatccttcccttatacttctcaccatctttaggttacctataatatctaatacaataaacactaggtaagtggttgttatagggtatttttaatttgtcttttttttggtatattgttattttttattgttttttttccaaatatttttgatgtgtggttgattaaatctacaaatgtagaacccataaatactgagggctaactgtataaccaataatttctgagtccttttgtctctccctatgttaaagcaatggtgtagatgagatttctctgaatagaggggagcagctggaccaataagctgcattatcacttagagttatcaggactatatcaactgattcaagccttagcccccatctccgacttgctgtgatatgcaccaagttgcctttcttcttggtactttcctttcttaacaacaactagtaaattgactataaaacccttggctactataaactctattagaaaactggctgtttccagcatgagccaaggactctagctttccatactcaaagatttatatttctcaagtttcttaacaacattggcatatatttattacaatacagtttatacttttaaaatcaagcaaacagttaagattttaatggtcataaaaatgaagaacgcattggctattttctgagtagtgaaaaagttctcttttataatagcttaactcaagaacttttgaagtctttttcttcaaagatttttcatacaaaaattacctttgagagtaagcatgaaaaaatctcaggaagtaggtaagtattgttaatttaaatgcctcccttttcactccaggaaacataaaaccaaatgacaaagtacagatgatttattccacaactattcattgagcacctactattctctggcactgtggtaggcagtgaacaactctgctttaacagtgagaacaacattcttatctcctgtgacccttaaggaaagactagctgtagttagacttactggatttggtcataaagataaattaaatataaagcagtgaccatttaagtttaattatgttaaagaaattttgaaacaatagcttatttaaatcatttaagtatttgtttacaaatttttaccttctttctaaaatgccaagaattgccaaccatgaaattatgaaaacaaatcaataaaaatacaatgatttgaagaacaaatctatttaagataaaaaggcacataacctaacaccaataaaattacctgtagcactcttaaaaactagatttcttctttctttctttctttctttctttctttctttctttctttctttctttctttctttctttctttctttctttttctttcactttctttcttttctttctttctttttttttttttgacagggtctcactctgttgcccaggctggagtgcagtggcatcatcttgggtcactgcagcctctgcctcctgggcccaagtgatccttccacatcagcctgtcgagtaactggaactacaggcacatgccatcactcctgcctaatttttgtatttttttgtagagatggggttttgccatgttggccagggtggtctcaaactcctgagctcaagcaatccacatgccttggcctcccaaagtgctggaattacaggtgtgcaccacaacaaatggccccaaaactaggttttcaaatatgtgagagtatctctcagctatgtcaaaaatcctatgagtcattcattcagtgtttatttaataccaaaacatggaagatagtatgtctaggaactaattttactccaacaataaatctagaagaatgagtacctatttcatgtggttatcatgaagaaactctgtcagaaaactaaaatgaaatggctcatgaagttgacatatgtatgaaaatataagaattctgctcacacctcttctttcttcctgggggcattatccatgagcatcatctctgtatatgaaggacggaaaacccgctttggatatgtatgcttctgggtagtctagtcaaaaaggaatatgaactcttttatctctgaatgcttccaaataccagagaagaatgatttatggagttctgtatatgactaaaagagctgctagtacttttagagtattcattctttctttattccttcttcagggtgatctggaaattgcccttcccaggactttctgtctctcatataaactaccatttgtataccactttttaggttgcaaaatgctttcacatgtattgtgcaatttagttaaaaggcatcagggtgcgaggatcaagaacactggctttggtaccagagacatcagtgtttaccaaagctacttactagtggtacaccattgtgtgagccacttgatcactttaagcaacaattttctcatttgtaaattagggataacaatatccaccttgcaatataaggtagagattagcaatagggcagttaaaatgttattatgattaataacccatagtagggacaccaaggacttctcaatagtctgtttctcttcatcaggctggaggagggggtcttcacagttacttatgagtacatattacaagcttctagttaaagtaatggcctcttcaaatcttagatctgaaccatcttcataaaacagttctttaattcatggccaaaaacatcgtttccatatactctcagagacagagtccttttggagcaagatataaagtttaattctaagtctttttttaaccccgaaactattttccctgaagcaatccatgtgctgccatcagattttattaggtgggctaaaatagagtcagaaggagatttctttacataatagctgtccctacagaaacttgagacagtcagcttaaaaattatttttaatgaagaatttttgagatccataagtacaggaaaaattttgatggtctttctcccttactgattcattgataattctcaaacattgggctggcacaactagagtaaatcggtacatcttacacagtggaaagcggtgggtgtagatgtttttggagccagtcagtctctggcagcggatagagtcacacttgtgctttgttgcccatttacatcttcagaaagcagcctgggtgggcatgcttatcaaatgtgctcatttaaggataaacccatttgaatattataacaacatttggcaaacttcctctaccgaatggtggacctggcccactacctctgaaaactattgcctggccaggcaacataggtcctttgactttctttacatggtagaacacatctgagaccttccaatcaaacacccaggaggagtcctgagtgctttacctgttcctcaagcattctgaaggttctagtctggactagtgggttatggatatatggatatgcagtgagtccttccttttgcaacatacaccttttttttttttttttaatccagactggagaattcaaatgccttgttaatatctagtggtcacctttggcatgaagaagtcagcaaacatttactgaaaaagttgcacgtggagaattctgtatcataattaaggagatgccctccactccctgaagatgtttataattcttgctgggaatgagggaaaaacaaaacctatacaggcaaaactgcacagcacttatagaccaacacaaaagtgtgtacacacagtgtacaaagacttaagcagagcaaatagggttaaaaaaagaatttggaagaaagtaatggatatacattttccaaggtgagagagaagaataccatagagtggagaaagcataaacaaaggcatggaaatgggaactggaaagcccaccaacttggctaacatagagaaagcagagcagtaaagagtagggggtaactacaggggcatggggatgcatgaggaaccagtttgtaaagattaccaatgctaagccaaagctcttgttcattccattccagggaaacagaagttgatggagaccttggagttgggaaagaaaaggaggccaagaaggataactggtagtagagtggccttacagctagatgaggaattcggattctagtcttcaggtagaaaagcagcagtataaaatccaaggccaagaaatgagacatagaaaattatgtgtgggagcaggtatcctagatgcttaaaaaaattgttttgtgaagatagtttgaaggaagggtggcctattcaagcggttcagaaaggagataaggggccacttggtctagtgtcagcccttgaaaataaataaaagaaagaggctgaatgaagagatattactgggtgagaactggcagaatttagtgactgactgaatggtaatgaagggcaaaagaagaaaagatttaaaaatgatcgtagtgctggggcctcaggaaagggtcctatggacagtaattgaaaaagaaaactggtggctagagcagaagatgctctggtcagtggtagagcatcccaatgattaaggggtgtatgcatgtgaatgcatgtgtgttactataggcacacagatttaggagtaatacctcctttgccctaatgttacataacagcttacaattttctttcaattgaaatctttatttcaagtatttattaagtgcatactaggtgtaaagtttacaataagacttgtgcaaggtttacaataagaaaacataaaaaagttctattactgaacagaaactagtttaaactttactgcaacattttttaaagagtgtattttcatttttatattaattttctattatttgtaattcttaggccactgacataacagtgctttcattagtgctagatatgccaccttgacacaatttaaaaatcaataatttttcttagtgtacttggatatcttccttttcctaaatagtggttatgcatttggatgaagccagtgaataagatggcttttggtttaaatttgcacccagatcagtcctgatagaaggccatgtgtttctctgtaagagacacatgtgcatgtgcatattctctgcctcactcagattagccttatggccatggtatcagaactgcaaatagttatattgtggattctttcttgtttgtgggtgacaggagaaaggaaaactcacactttttttgaacaaagcaccatgtagatatccaactgaagtgggctctgttcatcctcaattcaggtgtgatgaaaacctacagggagttgaccttcagtactgaccttttacattatctcatttctctcatgcaacttctgtctaaggatgggaagagacctaagagatctattagtctcagaattacattcatctacaggtgtgccaaaaggatatcaagttttaaaaacacaactgcactatttcttttgtttttctttttattttctttttttttttttctttttgagacagagtctcactgtgttgctcaggctggaatgcagtcgcatgatctcagctcactgcaacctctgcctcttgggttcaagtgattcttctgcctcagcctcccaagtagctgtgattacaggtgtgcatcaccatgcccaggtaatttttgtatttttagtagagacggggtttcgccatattggccaggctggtctcaaatgcctggcctcaagtgatccacctgcctcagcctcctaaagtgctgggattacatgcgtgagccaccacacttggcctatgactggactgtttcttaacattaatataaagcaaaggttgcataaacaatggatgtaggaagctcattccttcataattattaagaactgaaaaggtacattgaagaaaactagccatgaataagaaaataacttcttcacagtggttaaagagaaaaggtactgaaaaaagtaaacaaacatatgaaagcctcttaatatactaaggtattactatatatatttctgacctttggctactgagaaaatgtgaaagatgacaattctatagctattctatataacggcagatgctcctcttattccaggaaacaaaatccttttatgacatttcactaaatatctaatcaaagagtattttatgtgctcatttcagatagtctcattcacttgcccttataactttaaatgagttcttttcttaagcaggccagcttgtatattatttatgataaaatactttctttaagatggattcagtgttaattttgtactatatgacttagtacagtgggacaattacatataacacttcttctatcagccctatgtttctatgttctttattaagatattatcaaagtaatagcaaaattctgttaaatgttcaatgtatatctttactgctaattttttttcaacatggtaatattactggtaccacagtgactcctcatatcttgaatatatgcagtacaattcattctctactagcatcaatttctttttgtaaacagaaatttggctttaacacagcaatttccaccaaactatataagtgctaatgatgaccaatttaggacataaacagtttactactgtcctttgagcctctctcttttttcatttctctaatcatcacactaaggattttttttctagaaagctatgggcagagttgatttcacagagttacaagttgacctttttcttttttttttttttttgactgatgctgttaatagagttttggtgactctatcagttaagaggtataccttgtacctgacattttacttgcttgagcaactggccccaactaactgatttttaatattttgcttttctgtttcctcaattttccttccataaaatattttttctacttctatataacttcttttttatttttttgagatggagccttgctctgtggcccaggttggagtgcagtggcgcgatctcagctcactgcaagctccacctcctgggttcatgccattctcctgcctcagcctcctgagcagctgggactacaggtgcccgccaccatgcctagctaatttttttgtatttttagtagagatggggtttcaccgtgttagccaggatggtctcaatctcctgatcttgcgatccgcctgccttggcctcccaaagtgctggaattacaggcatgagccactgtgcccaccctataacttctttatttattttttcttcccttatcaaattccatctcatttttcttacgcaattaaaatatttcctcactacagtttgggtcagcggtcagtcatatttacatcactttttccatagtttggttgatgatgtgcatagagtatatgcactagccaaactgatccacattcactgtggataggctgaagtccaaattgtaagctgatttgtcaacagctttgagtaagcctgatgccagacaatattttaattcttcagtgatatttcctcttcacttatgaaggaagccttgaagatggcaagttaataagtgcattgttttaactctgtaaataatgctttttggggggttgtctttaaagattctcatttactttttataaagaaagttataatttcttattttctggttccattcttgatctctttattttccttcagtttgtggatttgctctacttttaaaaactcataacttatgagtaattttacagatcccaagatatagtttgtttgttttttgagacagggtctcactctgtcacccacgctggagtgcagtggcgtgatctctgctcactgcaacctctgcctcctgggttcaagcgattctcgtgcctcagcgtcccgagtagctgtgattacaggtatgtgccaccatgtccatctaatttttgtatttttagcagagacggggttttgccatgttggccaggcttgtgttgaactcctggccacaaaggatcggcccagctcagcctcccaaagtgctggaattatacacataagccaccacaactggccaaaataaatttttttaaagaggatactgagcatctgaaacaaggggggtttgtagactcacaaggattaaaaattatttcgattgtctttaaatcgattgttttttaatcgattaaaaatatattcgattgaatatagtgatgcatttatcagtctatcattctgtaaatagtatggaaaattctggaaaaaaattcctgttcacaataaaagagattcaatttgcgtaacgatatttactgtgtgcctactgtgtcctgtcctaagacacagtattaaagttctttcacttaaagagttcatacctagcagagggattagacaaatttatagacaattatgcaaattaagtaataagctttacaaaagaagtgcacaaaaatttattgtgggcgggtggtatatacaagtcaatgactttcgttgcatgggagagctaaagagaagtaagcaataagggcctcagaaagttagaggcatttgggatgagcctttgaggataggtaatatttgatatatggaaatgaagatagagatatacataagcaacaaagtgaagaatgatagattggaagtgggctattcaggaaaaaatgcttttctttggaaaccatggataatatttcagcttctattcttataaattagtctcagcaaagttgccacttatcatatgttcaatatgaagtattttccttgcctataagaaacactacaaggatgtgagtagaggtgaaacatagagtagacgtgtcccaattgtaccccagatgtgtttgtaaacttctaggtatggtttccaaagaaataaagctcacagaacttttattaagaacacttttatttctataaataaatggaaactcatcttcagctaaaaatatagtggcggctcacatctataatcccagcactctgggaagcccatgtggggggatcacttgaggccaggagtgtgagaccagcctggacagcatagtaagactccttctctacaaaatattattttaaaacattatttgggcatggttgctcatgtctataatctcagctactcagggggtgaggtgggaggatcatttagcccagaaggtggaggctgcagtgagtcatgatttgtcattgcactccagcctgggtgacggagcgagaccttgtctctaaacaaaacaaaacaaaacttggaaattctagatatccaggtatttattcactaccacatagcttaactgtatttccttattattttgtctctagctgaagttctctggaatggtcatgaagagagaaaacatcaaagattaggaaatctatcccaaaaagatcacaaaatcaaggacagtgacacctttttgagctttttacttgactcttcctgtttttttttttttccacttcccttagtcattcactaatcagttctgctttagaaccattaaaataatagaaaagttacagaaacttggtaaaatgtttctctggcctatttccaaaccgcccaaaattaatgggaaatggttaaagtcaaaaaagctttttctctgacatggatttctaaacaatataattatggttcactccatggttatgagctttgggagctcccacaaaaaagtctttgctgcagatgtggccactggctgctataccaggcaatttgattcatgtttgttgttgttaaaaaaatatataaaactctcttatgttggattaagaggcttttaagaggaagctagacagaaaggccaggtctctctctatttgctcattcatgacaaaggtggaagcttcaaatttgtgatacatgtgaagaaggtgtctgttacttcgtgttacatttttgccttcagaattattgttttcaatcattctattttatataaatgcacaaaaaataagtccaagctaaactagtgatgctgggtcactccaagaagtgtcctcaatatagcttcacaaatttacccttttctctccaaatccacgtttatttcttgagacagttatatgatgttttgccaagaaagcaactgggagcaatgccttatgtttaactgggcttttagatttgagaagcaatccaatccaagacttcatgataagacttccacagcaattggatattagtgacatataaggaccttaagaactccaccattttatactctatataaatgtatgatgtggtacacaaagtattaatcaatacttcatgagcatagtagctctgtttataccaatttctagcaatgtacattaggcaattttgtagaaaaaatataataattgaaagtataatttaacttccactccatgaacacttagcctcttcataccatcctcttccaagcatttctttggtccttggaaaatcagtgaaaaatctgaaaaattgggattttgtgtttgattatatgtacatttactacaagtatactgggctttccttttctgatgctatagagatgaactatagctttcctaactcagtcttattattagccaggtccagtttatattagttaaaatgaacatcataaatttacagtataacttatctggtacattccttctattgtagtttgaaaatgtgccattcaggactgaaatgacttaaacataatcagattttatttctagagaagtaaagtctatacttctataattctgtgaacccatcagcaattaactttgtcccagtagaattaatatagtgttcaagttcaggattgagtagatgagaagaggaaggaacaataaaactcattcactcccatgctaggttctgcaaaatagcttccatattcccataatgtgatatttatcttccttataatagcacatttaaagtcagtaaccctaaaaatctcctacataaaggtttgcatctttccccttaaaaatgtacagatgagcttgtgataaagagatgatgtctcctgccaaattgtaatatcatatagaccagttccaggcaaagtattgaagaagcagtcaaaacttcatatacctatctatccttgtcagcctcacgtattcatggatggggtcacagcttatccctttattctttttggttagaaagtctttccagatgaggtcatcattttcattactctgtttcttcctctctcactagagtgtctttctaaaggaaaccaaggaccacttcagtgaaatattgaaggcaggggaggccctaaatgattaaaagaaacaaagctttcccatagcacgtgtccttttctttgtaaggagatgaggtaatatataatcttcccacgttactaccacaagggcattttgtggcagggagagatggatttctgggagtgaaatccaactgcaaagcaagggctattttcagaagggcttatcttcaatatcctcatttcagaattggtctctttgctcagagcaataccttgggcaacactgagaactcccatctctaaggtaagaataaaagttatttcctcattgatggaatatctgatgaagaaaaaggaagacaaaaaacaataaattattctcataaaaggtgatgcatatgaataaatgtcaaatccttctagtatttctcatgtggcttgtacacaagacttctatttgatctttggctctgcagtttctaccactagatgacccacatgtgtaatctggataggcagctagtttgcttacatataaattaaatagcctcaagtgtcagcagatctctgtatctttttaatatcccccaaactgcttcaagtaggaacagctacaaagaaccttaccaaaggacatggaattcacacttgccaaagaaatcactgcacgtgtaaattagaaactaatcatcacttcctctctggttacagtggcagctttgcctcatagtttatgttgaaatatacatttttatgaaatatttctcactgtagtcagcatcaatttaggagtatcaaacactaattcccagctccagcataccagaaaactagagacagagaagtgcagacaaagggaattgacaaaggcctggacttttcttatacttgaagaagctaattgtatttgtaaatttctggttaaaaacctgacaattatcagatctgccactgcaaggctattcctcaatttcttcatcatatatttttccctaaagtctctcagagaagtaaagggcttctagagatgaaaatgaacttgacaatcacgttgcaactcaaactgatcttgattcttttcgtcactttttaatttattgcagatggtgtaaatgggatgtttactggttggcaggtaatgagtcttgttgtagataatagtgatggacagaatctcacgcctgtcgacatcccagcatctcagcagctatatatggttatcatccattgctttgaagcacatataatattgtgacaggatgcacaatatttcccccatagaaacgatgattggtacacctgaatctcactagttcacatgtcatttgtcctgattccatcctcactgtccacatgagtagacattctaagatgtgatctaatggaaaatgtaatctgtttaaacatccaaacactcctcttccaaggtatcaccatttatcacaactgtcagtgcccctgtggaagagtaatgaccctcaggcatgggataatgctccatagaggccttatgaatgccactgtgaaacacagaaattgaccagttttcagttgggctggtatgtgcatcatgaaagatctgcacttactcactaaattacaagtggctgtttaccctttatacaataaagtctaggttgggaagccacagaccctgctgacttcaattgtcccaaacatgtgagtactagatttggacctgcctttgaaatggacttaagcagcttgaaactggaagttggatcacagtcattcaaaaatacattgggagataacataggtgtcattgccttccacttttttgcctttttaaaaaatcctctctatcaatggaggataacaacatctcactatccactattagcaattaaaaactaaacagggtaagcatgccagtgaaaagttaactatttgtttccttcttgtaagcttcccttcatccagaagaaaatctggatctggatctgttcatatattgtttctacaaagcagaacaaaggtgaacagttatgtggtatgaactcatgattttcaggtccctcccaatgggtccatttcctcattgacgatttccttgaagtcccctgtaccttcccaatcttatctacattttctatgaagtcaccttagataataggatcacttgcactctaagactgtttacatctcagtaaatgctctatcactatgaaagtttcatctaaaacatatctattcctcagtgctcagacaccctgaagatacccttcaggatgtagcatccatatgaagtcacaaaataccagttgatcttcccgtggaaattgttttccaatctgtatgaattgaatggctcaactaaataaatgaagaaaatgaaatattttactcacagtgattcattccatattaagaaaatacactaagtaatgaatggcccctatgaaatcattacagttatgagcatcttttctacttgacagatctctgttcccctcgcagatgagttatgccaacctaactatacttttggtattcacaatattctgattattagtatctccaaagatgggacttaagacactttcctgagaagagaaatttacaattagatacatcttaacaattaataaaattaatgagataatgaaataagaagctctcagtatactgctgaggatgcagaaatctttttgagaattaggaatgttctagaagacaataaaaaagatcagattgtgaactgagcaaaacaacctttgatgtgaagtgtcagccagaaatgtcaatccaattcaagactgcatacaaaggggcactgtgtctttgagctgagaggtattatgttacctgattatcttctctggaagaatgcattatggtttagacacttttattacctgaaagatgtagacaaattagggaagattaacaaccagttttattaggaagtagcagatgagctggtgtgaatggtactggttgttatgagttctgtattctcttttcagctttgatatgctctcatgtgggaatagtcatccttgaaatttagataggataatttatattcttttccccagagaaaagacagtttgggaatgaaagggaggggaagtgtttaaaacagcacaagaacctgggataacagaagggtcagaaattctattatagaatttttcaactcccatttacaaaaatacaaccaacaataaccagttcttaagcctttatttgaataagctcagtacatttagtatttgcagtatgtttttcatatatagtacctaattgtttttggtccacagaataaggctattctatgatactatgttattatgttcatgttttcctggaaatataatttgcaaggtcattctaggaactctgattatgaaattcaacatcactttaagtcagttaccctgaactctaatgcagtttcttgtctcttcatacttaccctggagctataacctatagtcttatagaagtgcccttttcaaaaaggctcccactccttgccttctgaatgactgtctagatatattttcacctgtaattgcatactacaccaaatttgcattatatatgaatgtgattgagaaatgattaagataattgtttagtttattagtgaaaataagtggtatataagctaaaataaattattatttttacacatggcattattcctagttgtatttattatgatttaccatttactaaagtatttcagttggttgacaaggaataatagcactaaacttccttcaagcaatactggtgactcactacagccctaatgttaatacattccctcagacttaatcttttaattctattgggaaacacctataaacacaacagaattttttccttttctgatgttcattcaaattacattacctatttccaccattcagtgtagtaatttctgggaactaccttgaggggtggatggtggtaaagaatcaggacatttaaacttctattaaaaagggacagaagaagactttaggtcacctgtgatcttaggcagctttcaggaaacagaggaagcacacttgtgatgaaccttcataaaattggcccatattcccaataattcccttacctattgagattcctggttgctaaggactttatcagttacttcaacaatcctccctccccgctaataacagtacctcatttgcgaacaatactggactgtactcacaattccttttccccttcctttcagaaagaacacttttacgcccctaaatagtcctataaatggccaaagacataggacatgctacatgattcatctcatgaatcagtttctgttctcttggctgttcaacaaaagacatttcaaattctccacgaggcaatgtattacactgccatgagattaatttctgtcttcaactttggacatttcttaactattaactgggattacttcctttttgctcctctacaacccattctctacacagaaactgtagtgatttctttcaatgtgacattagattctactacaaaaatcaccaatggctgcttactgtaactagaataaaattcaaacttctcactctacagcctatatagtctggttcctgattccttctctgaacacatcaccagtatacttttccttattcactgacctgtcataattcacatgcctagctcacttgagcctcaaggcctttgaagttgctattccaatttgcctgaaatgattttccttcacatcttcatatggctagtttctaacatcattcaggtctcaaccaaatgccatctccttacatgccatccgtgtgagattttactcttactttcttcatttcattcttcattgtgtgttagtgagtttacatgtttattaactatctcccttaactagaatgttccagaaggaaggaggactttgtgagttctgatcactattgtatttccagtgtctggaatagtaggtgctcaacaaatacttgctgagtgaatgaataaattaatgaccaaacagtaaataaatagtaaacaaggccaatatcaatgctctttattacagtagttatttaaatgtacctcaaaatgctctaaaaataaatatgtgctttccctgcacattaggattaaaagtactcattttactaattaaaagccaggacctcaatttacattaatgactggtccaagatcatatggtaaatacgtattgcacaattctggtctgaaatcttgttagcccagtcagtcctacagtgatttacttagaacacaattgtgaaccaggtataattaatctgaggtccaccaataggcttgagggggtttgtgaatcctttgaaaaggtattgcaccctcttttgggaagagggtccatagctttcatcatattatcaatggaagccataaactaaaagaggctgggaatctctttaagcaataccattctgaaacaaattattcttaacctccctaggtagattggaaggctgctggcttcaacattttctgtagagaaggaacacctatgaaaatcctatcactggctgagtagacatattttcctttccagcaccaactctggggaatggtgggcctcacaggctggctaacccttcttggagttcacgggaaaaagatgtctagttcaaagacgatgagaagggaggtatcattctaatcatgtggaaagcccactgtgcttttagtttgtgtttgtagcattcttagcttaatttcagggatgttattgtagctgtgaagattagataataataagaaaaactaattcttaggcaccagacagacaatatgaaaaaaatatataattctaaatgtaggtcaaattttatatttatcagcattgatgcagtgttgttttggtctgttcttaaatttttgttttatgaaaaacaatgaatgcaataatcttctaatacagtgattaagaaacagtgtatatttttccacatactatcaaagcagagtaaagagtgaattttgccatgggaaatagtgtattgctacagtaagtaagaatattaagtttaccaagtttttctagactgaagacttaacaataaataaggcacatcttccctgtaaggtttctcttgagtctgttacttttcagtagatgatgatgatgacagcaacagcagctaacatttgttgcttattatgtaccaggtcctgctctaagtgctttacatttattacttcacttaatcctcccagcaactatgtccatgaattaggtattattattatctattcttagagatcaggaaagtcagatgaggggttatttaacttggtaatgaggggtaaaaccaagattcatatcccacctgtctgatgccatgtccaagcctttcaccactacactttcctgtctccctctgtggtagtgcagggatactttggagatgtaacacatcttaattaaaaatactttattgctgaaaagtgctcaccaccctctgagctttcaagattaccatctgagtggtaatctttttgctggtggagggtcttgctttgatgttgatggttgctgactgatcagggtggtggtttctgaagcttggggtggctgtggtaatttcttaaaataagacaacaatgaagtttgccacatgattgactcttcttttcacaaaggatttctctgcagcaggtgatgctgtttgatagcattttacccacagtagaacttctttcaaaattggagccaatcctctcaaactctgccatcgcattatcaaatgagtttataaaacattctaaatattttggttgtcatttcaaaaaatgttcacagaatctttaccaggagtagattccatctcaagaaactcactgctttgctcacccataagaaactactctttacctgttcaagtttgataatgaaagtatgaaagtacaacaattcagttacatcttcaggcttcacttctaattctagttctcttgttattttcatcacattatgtacagttacttcttctactaaagtcttaagtgcctgaaagtcatccatgagggttggaatcaacttcttccaaatgcctgttaatatttatattttgaccttgtcccatgaatcacaaatgttctttatgacatcgagaatggtggatactttccagaaggttttcaatttactttgcctatgtcgatgatagaaatcactatctacggtagctatagccttatgaaatttattttttaaatataagacttgtaaatcaaaattaccccttgatccatgggctgctaatagatgtcgtgttagcaggcatgaaaacaacattagcctctttgtacatctccatcagagtttttcggtgaccaggtattgtcaatgagcagtagtatgttgaaagaaatctcttttttctgagtggtaggtctcaagagtgggcttaaaatattcagtaaatcatgctataaacagatatgctcttgtcctggctttattattccatttatagagctcaggcagggtagatttaacataattcctaagagccctaggattttctaaatggtaaataaacattggctcccagttaaagttacctgctgcaccagctcctaacaagacagtaagcctatcctttgatgctttgaaaccaggcattgacttctcctcaatagctataaaaaccctaaatggcatttccttccaagtagaagactatttcatctatattgagaatctgttgtttaggtcagccaccctcatcaattatcttagctagatcatccagataacttgcttctctatcagcacttgatacttcactttgcacttttatattatagagatggcttctttaattcatcttcatgaatcaatctccactggcttcaaacttttcttctaaagcttcctcacctctcttggtcttcatagaattgaggagtcagtgccttgctctggattaggctttgtcttaagggaatgttgtggctggtttgattttttttttttttttgagacggtgtcactaggctggagtgcagtggtgccatctcggctcactgcaacctccgcctcccaggttcaagcgattctcctgcctcagcctcctgagtagctggaactacagacacgtgccaccacactcagctaatttttgtatttttagtagagacggggtttcaccatgttggccaggatggtctcgatctcttgacctcatgatccacctgccttggcctccaaaagtgctgggattacaggagtgagccaccgctcctgtttgatcttttatctgcaccactaaaactttctccatatcaacaataaggttgctttgccttcttttcattagtgttttcactagagtagcacttttaatttccttaaagaacattttctttgcatttacaacttcattactgtttagtgcaaggggcttagctttcagcctttctgggccttcctcactaagcttaatcatttttagctttttatttaaagtgagagataacgtgactgttcctttcacttgaacacttagaggtcattgccgggttattaactggccttatttcaaaattatgtctcagggaacagggaagtcccaggagagggagagagatgaaggaacagctagttggtaaggcagtcagaacatataaaacatttattgattaaatttgtcatcttatatgggtgtggtttgtggcacctcaaaacaatcagaatagaaacatcaaagatcactaatcacaaatcactcaaacaaatataataatgattaaaaagtttaaaatattgccaagaaccaccaaaatgtgacacagagacatgaagtgagcacatgctgttggaaaaaatggtgccaacagactcaatacagggttgccacaaactttcaatttgcaaaaaatgtaatgtctggaaagtgcaataaagtaaagtgcaatagaaagaggtatgcttctatatcctattttcaatacaaagatgctgggtagccaatttctaccactgtctttgtctatttgacaaaactttcccatgacttttatactgttaacttttttgaatagcagatgagacacatacttgcatcctcaaatctgcaaagacaccttgggccagtttgaaccgaatcccatttttaactgaaaatgatgaaaataaggtacattattagcctgaactttgcataactctaaaatgtattaatcttcggtaaaaattttaatcttagttttagaatcctcatgaagtacttagaatgtttaaatgagataacactgggtatattaaacattatgaaattgccatttctgtagcttaaaaatggtcaattgttgccacagtcaagtgattaaacctaaggtaagtaatcaacttaccttattaagttaactgctattgttgtaagataaattattctcactctacaatcctccctccctgaaaacttttctagtctggaatgtactgctgataactagtgctagggacatagggttgaacttgcccatgattttaatttgtaatacataggcttttaaaattcatatcatagcaggtatacctccaaatgatgccacaaagacagcctagaaaatgggccttagaagattaagttaataaaggcttattatttttcctatagctggatgtactcttaactagataactttcaatagaaatcaagttcatgaagcaggttcatgggaactgtattagtttcctatcgctgctgtaacaaattagcacaaacttatagttctggaggtcagaaagtcctaaaatcatggtatcagcagagttatgtttttttctggagtctttaagagaaaatccctttccttgagttttccagttattagaggccacctgtattcattggctcatgatctattcctccctcttcaaaaccagcaacgcagcatctttcaatctctctctctctctgacctctgcttccatcaccacatctcctctgtgatcctcctgcctgcctctttcctttaaacggcccttataatcatattaggcctaaccagataatctggcataatcttcccatctcaaaaatccttaatttagtcacatctgtaaagtctctttgccatctaaggcaacatactcacaggttctgaggattaggatgtgaacatcttcggtggggtggggaggggggcattaatctgtctgtcacagagaccgaaatattctaggtacccaaatttcaaatagcaagcaagatggtatcttatttctttaaacctcatagcatggtaagctgcacagacatttttacatataccctcataatttttaaggagattgtgatgtacaactctccagtttctcttctggcacaagtgtgtggaaatcatggtcttagctttggtttgtagaaccagattttactcctttacccagttttagtcaatcccatttatatttaaatttgtcctttttgagcattcatactgctatccttagccaaagaattattagtacagtaagtgctttctgcacttccttctcctaactctaggaataaaaggcacacgtgtttagctgagaaccaaccaggacagaattctagcacttctcattacatctttcttgtgctcttccttcaggcactacattgacatctcaataagcaaataacaccagcgttgcaggtgttaacaccaatgactataccatgagaaattcccttatgtcacgccttgcatgggtaaagttaactcaaatgtcttccttctcttacctaaaatatctgcttgcctgacctacatctcccttgtccattgtttccaatgaacactaacccttaaacatttaagcctcatcagcacatgcccatcataacagcataacatccttgtcctgctggaaactattcagcatccagaggaccatctttatgctgataacactaaaatataaaataatgccaacagctggtgctacaaatggcttttaaaaacgatgttcattcactaaaattcctcttgctacttttgacatgaaacacgcagtctctaattattctgatcaagacggtgaaatacaaaaacaaactttaattgtgtttaacagatatttaatcaggactcactgaactacagattaaagctgaaattcataaaccataattacccgattgtcgcaatcttttggtccacattctccttccgtctgggcgtctggcaccttgccccgaatttcttttactgtcttctcagcttcattactgttcatgttttccagcagagatttagcacagattacaaaatatctgttcttggcaactttcttcattagctttttctccccccttgcaaaaagtttattttcttttttctaccagagtagctggaacaggcatacgtttagggtgctttgatgacacaaactaattatatagttatcaggagataatacggtagcgataactaaagttactacagttatcatgtaggtatcatgcaatttctccagtataccatgcggtgtgtcccagtcaccacgtaattacctaatgtcactactgcattgtttcatggaaaatgcttatctcaccccaacaaaaccttttctgccacatttagagaaaaaaaaagaagtgaaattcttagttctcatatccagtactgctcattcccagtaagatgttgtcatgcaaatgtaagggaaacacctgccctctcctgaaaatttgctcttacagggagcaaatggagcaattattattattattttttcctgcttcactctttccaggtaaaagaagtaattaccaacaatacatacattttttctttttttttctttttttaaaagaaaccaatccccctaccgacccccgaaagaaacaccctatttacttaggattcgtttagtctggcacttcccccctatactctttcctttcaaatttcagtcactcacatttgtttttcctagaattatggtgtaaatcattcttaacaagctaacttgaaacttctctcactcagtagaaacacaaaatgccactgtaattgaaacacggaagcttgaaactctttctaaccagttcttttgggccactcttcagaagggcatgccgagtttccctcacagtgcggtaacccctgggtcacacagcgaggataacatcacagaccaaggcaagaggataaagagaaggcactggctaaagaagaggtgggtggttcctttattccccccagttgggcagtcaaccctatgaagcaaggactgtagttgctacttatttatctcaagttgatggcttgaagtctgacctcactaagacctttagatgtgacataccacctgagagttccagtttaaaacaggatgtagcagcttcctttgcagcacaagttgaaagctatttccaattctgcttttattagtcacctcccaatctaagagctgcccattcaattgtacacttaactcatgtcggggtaaaaagcacctccagatttagaagggccagaaaaattgctatcctatcctagcacattgttcttcaatcacacagttcctctaaatacagttgacagcctttgagatgcaaaatgtatcactttaatgtagtagaggtccccttcactgcattgccaaatctatttagcagaatcttcttggaataatctgtccctagacctgaggatgcacagtgatttcaagcattttaagctaatgataatggttagtgctgagaacagatgtacctggctgtgatgtgatctattccagtaggcttttatgagctgttcattcctattgacttagcattttatgtctgtgcttttgcctggtgtgatggttgcataggggtgtcatgtgtgtattttcctgatgtgtgatggctgcacagggggctgtgtgtattttctcagtgcaatggccacacagggtgttatgtgtgtgtttgcctggagttatagctgcacatgttattgtgtgacttttctctctatttgatgcttgctcgcagggtcctatgtgtatctttttcttagtgtgatggttgcactcaatgctgtgctaatgatggacatttctagcaattatctatctacagggtcctcgggaaaaaaattgcagtgaaatcaataaacagtgctagacaggcccttgtaaatatgaaatgacaccatgcataaatgccgtttcctactatagcatgttaaaatccaaattctgttatgttattggcattgggataaaatttctatggtccctccatctccttcatatattgcaatcttttgggggaagttgagattactgctggttggagggcttttacacatgcatctatgtaatactactttttgctacattgtcctacacatcatctcttatactccattctgacttatcctggcataatagctgatattctaaaagtgaatatgcctttcatttattccttcagtctcaccaagccctcccccatataacccctacatcacacatacaaaaccccctcgcttgcctccctctctctagtttctccgtatccctcctgtgttcaccaaacggaactgacaaaggaaacaaccaatgaggttaaaatcttttgaaacccctggaatacagatgagctgggaggcatctggaaacaaaaccagacacttgaaatcaaagagacaagtaaattactatcctaatctaggaagaataactaaaggtgtcagtggggttccattgatagcacttggctctgggccagaatgccaagggttcaaactccacaccagctttgggctcaggcccaagacttgctactgcagggtgcagcagcatgtgcagcagtgttaaaggtgtcagccttctgcagagaggttaagtccaagtccttctgcctgtttgtcattacaccccagagagacggagagataaccctagctttctcttcgctgcctttctcaatagaacaggctgaggaggaactagtgctcagcagcagtacttgctagtatgagtactatacaactaattagtaaaattcccctctactgataaggctgcttgaagtatgcgcaagaaaatccactgtccctctccccccacgaaaaacctgatgtttgtcctaaagattcttccatcaatgcaaagagctaagtttggaaacctaaaaccatgtgtctaaaagaaagaaaatgttttcattggaacagcttacatgtctggtacacttgcataaaaactatcgcatagcattttagagctaaaattgctataaaatgcttaatacagtaagagtaattatgagattttgcatgcacagctggtatacaactagagtctcagccacatattcaatggagcatgggaaaaccatttataaaaattcctggtatgccagtttaactcaccatcaacagcctatcaacacttcattctttaagtggatagggaagatatttacctaccaaatgctttatttcttctctcatggatgttatcaatacttgattcaaggaatttgagttattacttagagagtataaatataagctgttaacaggacatgaatgacctgaatgcaagccttctccactgagtgaagaagttacaatgatagtagtaagtaatgaaccagaagaccaaatcattaaatctacttgtatcttccctttttaacctccgctttttgctatatcttcacatattcttatctctcttcatttctctaagattcaaatcctcgggtgagttcctgggtactctggactcccctgccatagcccacctggccttgccttcccctgagtaacaccctgaagacagagctcttcgtttacattttcccccaatcaagttataacaggtatttgttctccattccctttagttccagctacatcacttgaaaagaaactgatttgggtgagttgttaatggttaataataatttaataaagtttatttcttgatgaaaacattgattttaagagtcaaatgaagaacctctttattgtggtcttttaggctctatggaaaatgccataataggtgagatgattctaatcagaagcattgatggatgctccattgcacattttttagccataggagccagtggatagatgggaattcccaggtggacaggaagtttggggtcacaaaggcagcatgacacaatacaaaatgaatttgaacagaatcaggaaactcaagttttaggaccaacaaactttgccacgaagtgtttggcagacattcagtttcttaacctgagaaatgaggcaggccctgggatcagaaactctccatgatcctctctggctcttacattctatgactctctgaccgcagatcagtcaggtctcctggattagctaccacctccagttaagaactaatagttctgaataaagatggcggtcattccacactgagccaacctaactaaagaggtgttgatgtccataggtgagttttacctgtctgcctacaacctgcatacactacttttgagttggctcctttatgctatacagatatttcttagcattttgttttccctcatttacttaattcagcaaacatttaatgagcactttctatacatgaaacacagagtcgatcactaaggacaggactgaacagggcaccatctctgttgcacagatgattttattattcttgtccattctctctctctctccccaccttcacttttatgcataaacacatacttctagaactataaaagtagtatagaaaaaataagaggaattagacttatctgagccagtctgaaatactgtttattttaaacaaaagaatatgataataatttgtgttggcaaaatatatgcattcaattacgcacttcaatagtataaagggtatttctcaacatgtattttgaggtcagtaatttgcaataaggataacaatttgggggaaagaagattataaaggtaaaacattcccttctgtagaatcctgataaagtcctaggataaaatctgtgacttgtgtaaataacctctgggaaagtgagatcatagaattttttttttaagtttttgtttttcctctaaggattttgggttcatatccctccaaattttatttcctgacttaaaaataataactgccacttattgagtaaatattaaattccatgcacttcaaatacattatttttataaatacagtatgaaatacaatatattaatatattgtataatacaatatgatatattataatacattgtaaatattaaattcaatatattattaaagcaactctgctagatagatattattactctaacagacatgaaaactgtgggtcagagagctgaagtaacttgtcaaagataattcagacagtgtgcagagttagaatttaaactcaggtctgtatttgtctatgcaatatggctccataaccatttcttggttctgctgaatctaactttattttaaaaatgaataatcttgcttgaatgctttgttagcaaataaggaaagcaccctttttactcttccttcacattcattcattgcattacatatagtacaatgaaaacaggagatggttaagattttttcaatgcagatctggttgccttttcatattgatttggactgagataattaaatttgggctctcaatcaaagtgaaagaataagctatttgctatctgaataagtatttcttattaattgatcagacatggataaggtgtgttattacaactatatttgtaaggtatgatttatgttgttctactgcatattactctgtgctgtttttcattttcttgcactttggactttttgttttgtttttatgaatttagtcacagttggttgtgtgttgaactttgtaaaaatgtaatactaaggaaattaaaaaaagaaagaaaatattttcaaaatgatgtcaaaatcaaatctacccctcactaatttgatttgtaggaaatggagaacaaagtattagaagcagaatgcttttaaataatcctaattacttcaatgtgcaaatgcattgactaaatcgaagcatgcgtttaacactttgcacttcaattgtgcttattcatctaagttctatagatagcaattctataaaaaacaagagatatagccagccattccatagttattgggggaaaactattgttctaaaattcaagcttacctctcaagtcagcccacttttggactaacgcagatcattaggtcaaagaactcaaaataacataatttactgtaactactcaggttttcccaattgactctgccttccctattctttttttctgccttcagcggggtggggtgaggacgtggaggaaggaaagcttctgttaacaaagccacagagtggaagcagcaaggcttttggtagtcaagccacacagcattaagcagggccaatcttaaggaataatgccatggggttagagtggtttgtgatcaaggctgagatggagtcatgatggcagggtaacttagtacctggtctaggaccagctgcatcagaaccacctgctgagcatgttaaaaagacacatttcagggtctcactccagagcaaaccaacagaattagtatctcttgaggtggaactcagatctccattttaaacaggctccccaagtaattcttatgctacttaagcctgaaagcactggcatatgcacttaagctctctaattctatatccagcgacagccctgctgctacacctgtatactctgtcccagtcttcaagacatatgtgcaagtccaactacttgtcctgggaggcattaatgctaataataatggcccaagggcttagctaggcatgatgttatttgacatgcagtatctcatccaatccccacagcaaactacgagacaaagatgattactattctcatctttcagatgagaaaactgaaattcagagagacttagtaacttgttctgggtgccacaataataactgaaagagctctgaagaactatactactgtactttaactcagccctgcagaaaaatatcttgaaagatgtttacttctaaaggtgttcataacttggtgatatcattattccaaagaaacttgcctagatgctagtaagatagattatggaataacacacaaagtgtaagcatttctacccaaggaacttttccttagattatttcatagagacttaaactctcaaaaactaggctaagaatccttcattagttcgttcaacaattatgcactttgccagaacctgaggtatacaaagataaacaggacatagtctctgccttcactagacttacagttctgaaaaagagacaagcttgtgtacaaatggttctgggttaacttatacagtcagtggaggcctgagggagagagagtagttcattctcctggcagaaggaaaagagggtgaggtctgtaaagttttagttactccagcactatgccattggctaatgtaaggaacttagattttaaagattatatttttacttgtacagttttgttactaaaggggcagactaagttacttgtatatttcgagccaataaaactttatctggttcattctctctggcatcaaactggttttcttttttgggtaaatttctgggtacagagccaagtaagttgttatgtttattcattcttacacagagcaaccgagattctattcttgaaatgagtgcctaataaattttatcagtagtactttattccacccaataaaagtggttcttccttgacatactgtgtcctttattttcacttgtttcaattactcagaatgctattattagatttgcatattttcataagagaaatttagaaattacaaatgattgaaaacaaagaacaatctagattctttcctttgtgataagagaggatgatcccatatacatgtaaatgtgctttgagtatgttaatcttagaaatgactgaagaaaatgacattctaaagaaaatgagggccaggcatagtggctcacgcctgtaattccagcactttgggaggttgaggcaggtggatcccctgagctcaggagttcgagaccaccctaggcaacatggtgaaaccctgtctctactaaaatacaaaaaagtagctgggcttggtggcacgcccctgtagtcccagctactcgggaggctgtggcacaagaattgcttgagcctgggaggtgtaggttgcagtgagccaagatctgacacttcattccagcttgggctacagagtgagactccaacaaaaaagaaaaaaaaaaaaagaaagaaagacagaaagaaagatgaaagaaagaaaagaaagaaacagagagagagaaagagagaaagggaaaagaaagaggaaaaaaagaaaaaagagaaaaaggaaaaagaaaaaagaaaagaaaagaaaagaaaaaaatgaggttctggaacatcgaagttcaggctaatcacttaaggcaaaggtacaaggatccaaaaaagaaaaagaaattatgaaatatgatatgattcagtttggggaaactgaaaatctatgtatcccatattttagtaactgaataaattggaatcatacatgtattcttttctaagttgaattattaccaaatttgagattcagtgtttagattatttactgcttgcttaaaacttttatttttcaaattatcagagtatttttcaagcattaagaaagttcaataaaaaggcaatagaaatatcaagtaattccaccatacagagataactcctctttacatttgaatgtattctcttacatcattatcgaatactttcatttttatatttgggattgttttaggtatatatatttatttgtatcttttggaccaggaatttttagttgtgttattttataaacttttcctaataaaatattgtttaaaataactttaagaactatctaatttgcatatatgatatgtggtgatacatatggatattcaataatttaataatttctcgaattttgtaatttaagattttaaaatcttttttctcttttataaatgacattgtgataaacacctctgtacctaaatctttgtctgagattctatttcctctagacagatgcctagaagtaaaattaatgggtcagaggacatatttttaaagcaaggttctggataacataatgctacattactttgcagaattttgtgtcaatatatagatatccactatcactatgagtgtctatttcactgtaccattaccagcactgaaaattactatttttcataaatcatgactttgaatcctagtgaattatactttttcatgtttattagatatttgtatttcctttcataatttttctctttatattctttttagccattctatttgactgaacatatatctcaatatcttcatatctgttgcttcaacttcatttctgattgtaacaccatagtctgagctctccttaccttgctctgaatgatggcatcatgtctgcctggtctgtattccaggtttctttgattctgatttattctgcacactgatgccgaacagttattttgaaaatatgctttcatcatgtcagtcctgatcaagaacctatgacagctcctggttatttatctatcagctacattcaactgcctcattcaggggaaaattcatcccattcttggatattcccttatgagttctgttgaataatttaggttattgctatatggaccctatatgcacttacgtttttataagtgggtatttctatataaagacagggagacacaatgtggagtactagaatacaagaactggaaagggctttaaagtacatcaaaaccaactgtctacatttataaataaaaaaaagtggcctacagagtttaatgaactacccatggtcatggagccaattaaatgacagaactaggactagaaactaagttgcattattctcttttagtgacttttagatagagaataataaaagtcatttttacaatttaaaaaatagaaacagctaggaaggcagtttaatttcaatctgttgttatgtataaaagattgttaaaatcatgccacatagaaggcttgagtgttcttttaacatgaataatatgtacttcttataaatcaatcaaatgtatcattagaatttccataaaatttgcacatctgcaaatgacctagtttatttatactttgctttttcccttgctaatctatattgttttatttaatctgctttgccacaataaaagcacagtattttttatcctagcatattgcagattttcactaagtttcttaatcatatcaataaaaaatccaattttcccagcaaattcatataaaagatttcttttgactatagttagggatttgaagaactacctttaaaaaataaaaaaaaaaaaaataggaactacttcaaaatgcctctatttaaatagtaaacaacacgaactattgtggaagaatgtgggctgtcatccatttaatatgatatgatgattgctatatatattcaagaatcccactgtatttgccaaatgaaaacttaacggtagtcactggtttagaaacgagagttaccaaatatatttattatttgtggaagaggggtagggcataagaggtaaatgtggaaatagccatgaatggacctaactttgatagaagctcactgatttcaaagggctgattaacaaagcatgtgtttgcctaacaaaataattgacagaaaaggtatttattaaatcataaggtgattcaactgtttataaaatacaaggtttaaacaaaatggtagttcatcagcagcaatgagagctcagctatgttttctttctccgtgtgtgcatgtgtgtaaccaaacaggtccaccattcacttaacactcaaccaatatttattaagcacctactttgtgctagaaaccctctactatccaaaataagtaaccctgttattttgttacagaatactcgactactctggactgctgtaaaataaaaattaataataatttagccgggcgtggtggctcacgcctgtaatcccagcactttgggaggccaaggcgggcagatcatgaggtcaggagatcgagaccatcctggctaacacagtgaaaccccgtctctactaaaaatacaaaaagaaattagccaggcgtggtggcgggcgcctgtagtcccagctactcgggaggctgaggcaggagaacggcgtgaacccgggaggcggagcttgcagtgagtcgagatcgcgccgctgcactccagcctgggtgacagagcaagactccgtctcaaaaaaaaaaaaaaaaaaaaaaaaaaaaaaaaaaaaaaaaaaaaaaatgtatacctgatataaggtgttataacaaaaataataaattgagtgataagaggagacagatgaaacagcatcctaaatttctcatttcatgtaggatactacttcattaatgacaataattaaacaggcttgaatgtttttcagaaaaacaacagtgattattaccgaaagaataaactgtactttaaaacttcaaattgctagattgataaaagctaaaaaggtaatcacacatcaaaaaagacagagagtgagagtgagaaagtgagtgagaatagaccaagcaagcataaaaacatagaaaatataaaaaagatttatgagatagtactagatatattttttataaaacgaatattagttaatttaattaacattaaaaataataaccataataatgttaaaagataacaaaacataatttaaccataggatagcagtttaaggacactagctttggtagcaaaaacaggattcaaatattatttctgctatttacttgttataatctctttcctactggtgtatttatttagactatttacctcaactttctgctctaaaaaatggaaataagaataactgaacgtagaaaggattgggaaaaaataatatgtaatgcttagtgaccagcacaactaaacattcaataactgtaatttgtaatattatgtgttttaaatgatgtatctaactatgtacccatataaatttaaaaaaaaagaaaaaaatagaaaaatggtgctgatagattttctcaatgcagagttgccacaagccttcagtttgtgaaaaactcaatatctgcgaagtgcaataaagcaaagcacaataaaaataatataaaaaacataataaagagagataagaatcaaaggagtattgtccaagatgtattgttaccttaaaaattccgtgaaatataaaatgtgaaaatcacagaaacacagtcagacttaaaaagaagatgattagttacagaaagctactaaaagcagcccatggtgctgaagccataggcctgctgaaatctggatctagaatcacatcgagatacctagaattccagctctttagagtaatgaggtcaaagaggctccatttgaaatggtggacctgaacctggcttactactttatcacgaggctacaaaaatttggccaactactgcctggggaaacagcttatatagggctgcaggacctgagagctggaagaataaagatacagcattatgataaaatattcatataagaatgaagctgaaagctaccattgtaagatctggattgggactgagaagatccagataaaggcaactgtaaaacccctagttagggacatgtgaacaaaacgaaacaaacaaaacaaaacctgtaaaacaaaattctaaagcataaccaagtaatggtaagaaaatcaataattgtaacattcactccagataaatttgattttatgaaattatctgacaatgacctcagcatgaatatgcttgagatgcttagtgataaagtactcatacctaaaaaagaacaagaaatgattaaagatagaaataaaataagaataggtgaataagagtaaaacttaatcagaaatcttaaaaaattaaaaatgttcattaatataaaagtacaataaatgaaataaaggaatttcaaggaaagaattgagtgtattggaaggtaatgttaaggaattcactcagaaaaaaattgtagcaagaagaattaattttttgaaaatgaaatagcaattgagatactaatcagtaagctgattagaaaataccaatgtttatcttataagaattccagaaaaagaaaatggaagtaatgacaaaggaacaataaagaaaaggataatagctgagaattttccaaaactggagtcctgagattaataagtatatcctgagttcatgactaataattcaaaataaatccacgtccagacacatttcagagaaactacaagatatttaggatatagaataacttttaaaagctaccaggagaaaaagcagattatttataaagagataaaaacagattgatagatttctcttaattaagaatagttgacagaacaatagtctaagatataattgagtaatgtctttaaaatactcaacaaaaaatacccagataaattgctatttaagataaaaaacaaaataagtacatttttagttatatgaaatatatgtattacccaaggtcctcattaaataattactaaaaaaaagtaacaagaaaagtgcacccagaaaggaagccacaggatctaagaataatggtaggcatagtaatatctaaaaatattagtaaatataattaagcattgattatagacaacagtgatcaccacttttgaatatggttaaaaacaaataggtaaaactaaaacttcatacacaattatagtaacaagattgatacttaataggtaattaaaagatgctatgttaaccaccttttttatactaagaagaaggtcagaaatactaaaaggtcgattttatattttcttagaaaaatacacagttcagtatacacaaaagaattttagaattagtgctaaagaaacagataaaccacctacagatttcaagccagaagtaaaatccatgtaccagataaaatcacaaaataagctaaaaaaagtttttcaattaaaaccacataaaacacatcattttattttaatgcgtttaaattcagaaataaataataaaaatagagcaaatatgtttacaaagtaaaagcatacccttctaaatacctcaagggctaaaaataaaacagatattatgaaatatttaaaattgaacaaaactacgtatcaaaacatggtatgcacctaatgagaaaccaggagaaaaatttagagtctgaaattcatttttaaagataataaaaattattgaaagtaaaagggtaataattcaattcaagaatctagaaaaagaaaaatggcctaaaaatataaaaaaaaagaaggaatgaaataacgctaatgctgataaaagcagaaagtaatgatttagactacaaataaataataaagtagataagcagaatcaaaagccagtttttgtaaagaagtaaatgaaacagaaaaatgtctagtgtctaataaaaaaaagcagaagggtcaaataaatattaggaataagaggggaacataaggacaaaaaattaaaaatcataagaatatataaataactttgtacaaataaattgaagtataaactgtgaactgtatttaaaaaaaataacttcccaaaattgactagagaagaatcagaaatttcctctgtggttattggtttattctgatattcaagtctgcctacctacaacctactgatgaaaattaccaagttcagatgacaaatactcagaataaaaaatcccaataatgtgaaaactgtttaagatatagaaaaaaatgaaatgttactcagcttattttgtgaggccagtattgtcacagcaaaactctatagtaacagttaagaaaataaaatttaaagattgatctccccatgtaaacatactacatgtcagtaaattaaactcaatagtagattaaaaaatacaccaagagcaagaatattttttccaagaatataagaactgtttaatatcaggaaatgtattaatatcttataaaatattaacatagtagtggaaaattttatcatattattgatgcagaaaatgcattagataaaatttaactagtatttctgattaaaaacacttagtaaactataaatagtttaggaacatattaagaacttccttaatacaataatttcgatttctcaaaatcccaagcaaatgttatgtttctaaaacatttccattaaaataagaaacagaatagatattcttaatgtgactatcctattcacactatactgaggtttagtaatgcaatatgacaggaaaaaattgaacatttaagaattagaatttaagagaatgactgtcattatttactgctgacatacatgttgctgtagaaaacttaagagaatttaccagtttagttattcaaagtagtaagagagctcagcaaagttgctgaatatataacaataataaccaataaacaatgaaatggaaaacagatatgaatataataatgtaagaatctaagttatatgaggaacaattttacaaaataggttcaagaaatttatgatggaaattttaaaacatgattataggatatgaagatgatcacaaatagagggatatagtatgtcactgggcagcaagacacattataaaaatgtcaattctccccagattattttctaatgttaatgtaattacaaataaaattcagcaagacttttgccaaacttgaccaactagccctaaaactcatattgaatagcaaaagaccaagggagctaaaagaatcttaaaaaggaacaaggtagagagacttatcttaccaagtaaaaagaatattataaagctatggtaattaagggttatggtgttagtacaaggatagaaaaacagtccatcggatcaaataaagatcatataaacagatttgatataggcaaaagatggcattataaattagttaataaagaatgactaattttttaaataatgctgggataactgggttatccatatggaaaaagaataaaatagggtgcatgtagggtaccagaaccaaaaataattccagaaggattagagatctaaatgtaaatgggaaatctttaaaactgttagaagaaaatacagaaaggtaaatgaccttggcatgtgaaaggatttcttaaatgacataaaagcacaaattatgaaggaaaatatcaataagcctagttgagttaatattaaaagctttataaaaacaaatactactaaagccacagttaaaagggcacctacaaattgggaaaaaatctttgtaatctctatggcccaaaatatgaaaatccagaatattacaacaacagcaacaactaataccaaaaaccaaatcaagccaaacaaaactcttccaaaataacaacagcacaacaaataacccaacagaaagatggacaaaagatgcaaattaggcaacacagaagagaaaatcccaatggcttacaactaaaaaaaaaaaaaaagttaatgagatattattcaattccgatcagactgacaaaaattttaaaaagtctgaccatcacaaatgttgtgaagcatgtggagaagctctcatagattgttactgagaatataaattggtacaaatacattggagggaggttttacaatacctagtaaagttcaaaatgcatatttcttaaagtttagcatttctacttctatgtatatatgtctataaaaatgttaactgtggtcttgtttgtgattgggaaacaattaaaataatgtccaacaatgagagaattgataaataaattttagtaatacatacagaagaatacatttcatataaaccaaaatatatagcttatgtaaaactaattcatgatgatagaggttacagtggttttgcttgttctttaccttttgttaaaactttggaaaatttcaccttcaaggggcacatacaaaggattcttcttaggtattataaatattctgcaccttgggttgggtgttgtcacatgtatactcatcaaggtatacacttaatttgtctaattcactgtatgtaacctataataaaataataaaaaataggttcagaaacaaatgttccaaattattaaacttcgtttaacctgggttctggattcttgtatttcatattatcctttatacttccatgtgttttaatttttttttttttttaaagacagagtctcactctgtccaccaggctggagtgcaatggtgccatctcagcccactacaacctccgcctcctgggtacaagcaattctcctgcctcagcctcccgagtagcttacaggcacgtgccatcatgcctggctaatttttgtatttttagtagagacagggttctgccatgttggccaggctggtctcgaactcctaacctcaagtgatctgcccactttggcctcctaaagtgccgggattataggcgtgagccaccatgcccagcctgtgttttaaatattttacattagaaaatgtataaggcaaacaccatagattttcctaactagaattaatcgaggtaaaggaaagcactagtgtcatcttctcttcactatctctgataatagagcccaatattagtaagcacttcacagccaaacatgcctacaaagtgattattttgttgaatcaaaagcaaaagttttcattcacttcttgactgactatagaatctcaggcttccttaagtgagtgaccagagggatatattgttgatatagacagatgctgccaatgcacaaagatcatccatttaggtttttcagttgatgaagtgaggcatgcattgccagactttacttacatgaattaacagaatcaacaggtgatttggtatcagtactgctattggctggcgggtttcacctctggtttcagaaaagaaagagatgataccttttcaatgctgcatttcaagtcaaccatatgaaaagcaaagttttattccagtcacttttctttctctcacattgtggaagaaaagtgccagccactgctactctaaccactaaccatggtacagatgtttgaaaaatgtgaaacagagaaatgaaacaaaaaggaaaccctcaaaaattaagtttcgcataagtgaaaaatacagtatttatgtatcataactgcaaaaagatcaatggacttttttctcatgtattaaacaaaaataaacacaaacattgattttttgacttagtgttttgttgaaaccaacaattacaaggaccaactcaaacatggctaaaagtgggaataaaaataagatttcttttatcctgataaaagattttttatcaccaagaacgttacagtatgacctacttaagtgaatacttattaaagaaacagattcatttaaaaaacatgtttttaggtaaataggaacggtgcaagtgtttctttgaaatcttacaaaagataaaaattaattgaactaactaaggttccttaccctatgcaaataagaaacggcttagaaagaaatgtcttcaaactgttgaaatgtatattccttagttggtgtaaccaatgtgaggtctcagttactataatagcaaatgttctattagatttaagcacatcagtgcaaattattaaaatgagactgtctttgtttaaaataaagctttaaaaaatgtaatgtaatctctgagggagtattgcctgaaatgaaagttttaggccgagctctgccacaatcctattgcgcatcttggttcatctgattaaacatctttgggtctcaaaattcacatacattcacatttctaaagtgagtgtgatataaagtcatagcttgatcatcaaactcctttctagccctaaaattctacgtatctaatgagattaatttatcatgaggtgtttttcttctttcctttgttaatttccttacaataaatagacaaataaatgatcaaataagcaaataaataaatattaaaaagacatacacacactgatagctatccatctgaataggaagaaagacttttttttgtttgccattatctatcccctaatgtgtatttaaaaagagagctcccacagaaaagatttttatttttttctaaatcaaaaatagtgtatcatttatttgccatttaagttctactaagaaggaaaacacaaaatcattatggaaatcctattaggaactttagaaagaaaaagctgatgaaattccatttacaattcaaattgttcattcacgtatttccttttgcagaaactttaaatgctgcctcaaactatcttcacctctttttccagggacaatatccctaactctgttaaaaaaaaaaaaaggctctcttctcacacccttcccacctgtcctctgaggtagttgttccacaaagctaaggtatagattacatcaagagatatttgggatgggagtaaaacatttcaccctggagacagtaatgtgtgcaatttgccaagtctaaaagaaagttaagcctcatcaccactttggcaagaaatgtggttctcatggatggacaatgattatcatttttacacagaacttttgaaaatgaaagtacctggggcaccagccagaaaataagtacgagaatgcaagttttttgcgtcaatatttaaatcagacaaaacactatcagtgtacccttaacagacctgaagcgtctagaaagaatacaaggcagctgacaccttggtgaataagagcagctcagttttatgaaaaggccaaagtcttagggcaaactctctgttgttccaagtgctgatatacctatggcatcaacaaaggcaaaacaccatagggggcaataggcaaggcttctcttacaggcaaggctcctgttaaaggctgggaccctctggactacacactcgaggaaccccaagtgtgggtccctgaggggaggaagtttcctcaaacagaacggcgagaggctgaagttacacagtgtaggagtactccctgctggcagctgaggttggaaatgaactggtgatgtcctagagagggctgcttaaattttctatgaggaggctaatggagataacagtgctcttgaggggacaagagcatgggtctgattaggtttagataactccagatattatgctgagtgaggaggaggttaagggaagctactgatgacaggaactccaacaattgacaaaaactatgtgtagagctggtatatacaattttcatttaagtttcccatctcatatcattctataaagcatacacagccgtatgtgcacatgtgtgtggggttcagaggatgcaggaagaaatctatttctgtgcagttcattttacccctgcaagaacaatctttgaaaccgtctaatgtattcacatttatgttttacaaggaatcccttccatacttctaatggacctgcctggtatgccccctgtaccactatacctaatccctaggcaggtggtctttgtatgggcctggggcaaccacactggtttctccccagtgctctgctctgttagggttcttctgcataataaaatgaaggtcaaaatggcagcctgctaaaagcagcagtatttcagttgcaggaataacttgcttgtcatcaacttgttaatgcaatagtcaaacatttctctgacatgtacagtatcagctaacttcagcagataaagggtctagaacaggaagatgctgcagatgctttagctcggaggaaggcttagcagagccaaaacgtcagcagggcctgtttgttccatactttccatcgggctctgtgaaagaaatgttagattactgcaatgacaagtttgtgacaagcaagtcatttgtgcaactggtgcgctcctgtttttatctgtttaccattcagacttgtgaatgccatttcaagcacttagaggatttctggctcccattaaggggaaatggttcctccatgtttagaattttctacctcaaagagaattactaagcaattatttgttcctgtggtcagtgtcacacaaaagcactcttgagttgtttagctggactctgaatcatgaaatgaagtcctgaagactggatagcttggagcatcaaaaatttcccatctagtttattggaatgactacaaagcaagcctgtgagagacaataaaattatggccagcttgaaataccttgcccttttgctctgggatcatatatcaaggccatatgcttcaagccacataaactcacttgtaacaagtagatcctgagaagctaaggcctggcgatgtcacactgacatgtgatttagcatatgactgttttggtgacaaggaccactttagctgttgagaagagaatttccactgacttctctctataccttgtgggtaactatagggtcaatactaatccagagaacattttaactgtggtaaaataaagtaatataatatcaaattaataactagggccatcctcactaggctgactttttaatagtgaatggagaccctggcagatttgagatcaagaattcaagatcctctcattaggtccttcacctgaagttgctgagtttcttcaagtcattttaacctcctgggacgaaggtagaaaataacagcacatgttcctttccatctgacataaatggtctcagggtcaatattacaaaagatgaagagtgccttcagactcaagaacaagaatgatactctctaaacatcatttattctttctacaattttacatttttgcccattgttggtactgaatttatacataactctaggtataactcccttttttttttttttttttttttttgagatgaagtctcactcttgtcacccaggctggagtgcaatggtgtgatcttggctcacggcaacctccatctcccgggttcaagcgattctcctgcctcagcctcctgagcagctgggactacaggcacccaccaccacacccggctaatttttgtatttttagtagagacggggtttcaccatgttggacaggctggtctcgaactcctgactacaggtgatctgcccacctcggcctctcaaagtgctgggattacaggtgtgagccaccgtgcctggcccaattctaggtataactcttaaagaacataacagaatgaggctttgaagcagacacagatgtacactatctggggaagcaagtcaaagccggaacaggtggaatgtcaaggactagacaaaagtaatgatgtaaagtgaagcagagcttagaaagggctactagagaatgttacagaaagcgataatagtactcattgaataaaaattttattgtgaatgatcctgtgccagacactatgtgtattatacaatttacatgtgtaatttaatcattacaataattctatggcatatgcatgctcaatattttttcagatgtgagaactaaaatgtagggagttaagtacttcacaccataaatatgtaagctgcagagatttgaaaccagttttccattgttccaaagcccatgtactcttaaccatagaagaacgaaagtcatttccactgcctccagaagccttttctctcttgcttactggaaaacatttcagtctggaaatacaggaattcactaatttgatacaaaagggccagtgagaagattctagctctatctgtattgccatccttgttaggcctctgagaaagctgagtttcatcaagatgtcattcctttctccaggcctgacctattcctactttaatgcactggggaagaggtaagtgattctaacctaatcacatatctccgtgctatgaatggagggtgtttggcggcatctccttgtgtccatgacaattcctttctctctcttcatgtgtatagcctttagttcatcctactctttgctcccatattacttccagggggccttcttttgtcacttgtctgctattctgttttaggtgggggaaggggcggacagctttcttaccatgacaaggatcactgaaacagtctcaacttcaaactttgcacagaatgtatcctttgttcggtcttctgctttgtttctctttaatgatagctttgccatgagtcccattcgtatgtaactcagagctatgcaaatcaagctggtaagcaagcatttgcagttactcagtcttaaaatgaatatgtgtccaaccagtggaaacctgagtgaggaatgtctcctgaacattatgtgtggaatggctcctttccttgatgggtggcaaataataaactcagtgagatctgcattatattccctggtctcttttagtgtatgctcagagtgggtcacaagagtggttttagcttatgtaaaattttttcttatagtatttccaattttttttaacttcttgatgtctcccaaacacagaattcttaatagctactgaaaaatccccatgcctgaagaatcctaagatcccagggcaaaaatatggtaaagaacattaaacaacccatggtctgggtcttaatctggtgctcacagtgatcattcagtctctgctgcataccaccagggcacggaactctccactgtaggatacttctttctgttctgttcttccttatgctgaatcttaatccatattagtctgttctcatgctgctatgaagaaatacccaagactgggtaatttataaagaaaagaagtttatatgactcagtttcgcatggctggggaagcctcaggaaacttacaatcatagcagaaggcacctcttcaccgggcaacaggagagagaatgagtgctgagcaaagggggaaaagccccttataaaaccatcagatctcatgagaactcactcaccatcacgagaaaatcatgggagtaactgcttccatgattcaattacttctcaccaggtccctcccacgacacatgaagattatgggaactacaattcaagatgagatttgggtgaggacacagccaaaccatatcataatctatctttctaaaatccccccagtgcgtctagttctttctcaccctaaatttcagttcagagcttcagaaaattattagtttaatgactcatttaatgacaacccttgtgtgtattacataccaacaactgggtttagattgtcctgccttgtccctttctcctcacccaacatgatttaaattcccactctatccctctgacaagccggggagaaataaaagccagtcacacccatttctcatttccatttggatgcaggtagtactggtggcaaagcattcttaatctctttgattttctgtcctattctgtggaaaatctttcctgacaacctcaggcatctttgattgatatggctatttatagattgaccatttaatttattgtccaagcagggacacttttgacagtgaaagggccttataaataattataccaagactacagacttaaacaagaactttcccaggcaaacttacataacaccttgcatatacttttacttcaatacccatctttttgcataaaaactttcatgtctatttttcccaccaacctgtgaacactctttagcaacagaaacatatttttacctatgcagcttcagttcctagaaaagtgcttgtaagtataaagacctgggggtaaatatgtactgacgcacatgcatatgcctatatgcatgtgtatgtgtttgaattgatggtatatttttccataattacattctgtggacctctccccttatttcatagcaaataccaccaacacatgttaacttcatatttttggagatgaatcaaaaatatttcacttaatgccataggaaggaaatggtctgagtatattggtaatgggtttgcttttaatattgacagcaacaaacagaaagtgaaatgtgataaattttccactaaaagtctactgcatatttttttaacaaagcactgaacaataagctttaatcgctttcttcacaagtattataaattgtttcaggccgtgtgcgaaggctcacgcttgtaatcccagcattttgggagggcgaggcgggcggatcacctgaggtcaggagtttgagaccaagaacggccaacatggtgaaaccccgtctctactaaaaatacaaaaattagccagtcatgatggtgggcacctgttatcccagcaggaggctgaggcaagtgaatcgcttgaacttgggaggcggaggttgcagtgaagctgagatggtgccactgcactccagcctgcagcctgggcgaaagactgagactccgtctcaaaaaataaaaataaataaataaatttatttattaatttatttaataaaaaataaaaataaataaaaaataaacaaaaataaaaataaataaataaataaaaatttcagcagctgtatccacaatttcaagtttgtagtaaatgagttattataggaaatgatggtaatttaagagtgatcctttaatctccattaaaatgttggtggcatttctattgctttcaccctcgtcaagcacatttggaagtcctggtaacttttggcagtttttttgcttctgagtaactgtggctttaagaaaaagaaaggtaaggagaaagtgcctggaaaatgtgaaccacttagagaagtcatttcttcccttctcgctgacacatgcagaccattccagaaagatatgactctatactggttaaagagcttcatagaggataatctcacaacttccctttcagtgtttagcactcactattaataacctatctcattatcaaaccttaagattttctgttgcagcatattttgtcattatcagacctcagtgaagaaaagagagaaagccttgtttcccacttctcatcacttgcttaacagctactattagcgctctaccttaacattcctttttccaagataaaaaaagtcaatgtttttgactcttccttgagaatttttttccaaaatgttaaatttaaatttgtttggaggggtttgataattctgtctctctaagatgtttgtattcagtattatctgaaatcagaacaagcatgaataagtatgtaatctatgctcataagaaatcagagaaatatctatatttggcatgcttcttatacattccactattatagctattttaaaatttcagtttgacatttcacactcttgataaactttctataatctacttctagatgctatttttcccacagaggaagtcattctttattttcagtccatcaatgacatttaccaaaccatcacggataatgaaaaatataagacttataagattcaaaagaaacaaagttacatgtctattatttcagagtcttaaatatgtggaaaaaagaagacaatcccacacaaaagaagaaacatggataagcatgctcaggtgtttggtgctagctcaccagctattagtataggtgaactaatacagctatatggaattctctatacaagtgatgaagaagtagtggatgaaatgccacttttgaggtctgctttctctcctgaagaaaactaacaataacttttatttaacaacgttttgtttattcccagttttactgagtgttcatttcagtcctccctctgaagtggttagttatacttatctctcaaattgttgttatttggacactgtacgtaaaagcattgcactttgaaagcatgcatttcttgtcctcaacatctaaaataatgatttgcaaccatttagaagttctggtatcctgttgttaatgtgatttttgcatcactcttccttgcctattccttaaaatataattttaaatgaaaattaatttcattttgaggttttgaaatgcctctaacaataatttagaatacactgaatttgccaatattggaaaacatgtatgtagtctagattatcaagccagaatccaggaccgacctcaatagcatgtcacttctatatctctcaatactgagtctcatctcctactaatcatttcctgagaattctgaagtgctggccacaaaataaataggttagaattttttattttttggtcatttgagacagaattaaaggctctgctggttacgtggagttatatcataatactagctttgccttagttcagcaaaacttacattgggctaagaaagaagataatatattatcaaggcgttgtgtcctggtatcatcaaacgatgggcaaatcgatttcattaggtctctcctaggatatttcgtggaataaaagttagagttctatgtctataacttgcaggatagaattattaaaaatggttgtatttaagtgcattttcccaaatagtgagtttccttttggcagaaaagagacaatgaaggtaaatgtgaaagtatcatcaaccacaaactagtaagctgaactcaagtataatggcaatcttcctgggtgatcagccatagagcaccatttgtgcaagagtctgaatttctatactaacttacttttaaatttcgttgaatacaaacataacaatgtttttaataagtggcttatctattaagtttatagagaaccttccactaaagagattacttattctaatctattcttttgtccaatcttttccccatttttgcccagtgttttgtttatataatattttattctataaaaatctatattatacattttctacctgccttgtctattcttatacattcacaatctattctactcttagtatataatttgaacagattcacatacataaatcaacattcattacttctgggcatataaatggttgctgggtccatgacggctgtttaaataggtagcttccaggccactatgacatagggaaaaactgaaaagtgtatgttttataattattgagtaaaagaggattttcattatggagacatgtacagctatctcaaaggcttatttttccaaaaggaacaacgacactgtcccctgggatatgtgaattgaaaattcagtgtcaacctcttctaaaaaagtagatattttgaggtattaaaaagcgttcttttattagtgataacacctcttacttggggtcgttttgagatgaaagttggcaagtagatttttcaataaggcggggtgggaatcactataaattcataaactaaaaagaagaatgacaatttattggcccaaaaataggggagagggagagatttttttgttcttttttcttttctttttttttttttttttgagacggagtgtcgctcttgtggcccaggctggagtgcaatggcgtgatctcggctcaccgcaatctctgcctctggggtttaagcgattctcttgcctcagcctcctgagtagctgggattacaggcatgcgccaccacacatggctaattttgtatttttagtagagacagggtttgtccacgttggtcaggctggtctcgatctctcgacctctggtgatccacccaccttggcctcccaaagtgctgggattacaggtgtgagccactgcgcctggcctaggagattttggaataaaggtgtctctgtgactaaaaacatataactggtcatagatagtctgtttacctctagtgtcttttggagcaagggtgtgggtctctctgttgagtggtgcctatcattaggcatcacagcaacatcaacaaaactcatctccgtaatatagtagattttacattgtgttaaggtagaccttttaaacaactccttcaagttttctgttgatttcctgccagacagtcagacagctacttcttttttagtaggagtagtcaaggctaaagtcaatacatgtgccttccttgctgagttagaatcaggcatattccatcaacacatatgtcccactgttctcatttctctcactttactatgtgattagtagacaaagtatatactaaagaaagctgaggaagttgctaggatttctaaagaagaagaatccaaatcttgcctactttaggcaaaaaacattttagtattaattgaaaagagatggttaaattgcaacccataaattaaaatgtagttccaaagtgtgtctatagtgatctacaagcaaacataatttctcatattctttttttttttttttttttgagatagagtcttgctctgtcaccaggctggagtgcagtggtgcgatctcagctcactgcaacctccgccgcccgggttcaagtgattcccctgcctcagcctcccatgtagctgggattacaggcacatgtcactacaccgggctaattttttgtattttagtagagacggggtttcactatgttggccaagatggtctcgatctcctgaccttgtgatccgcccacctcggcctcccaatatattattaaaatatattctgcaggctaattctatgttcttatctcattcctgtttcttcctctgctccagaaaggattagtgtctagcataaaacaaacagtatataataaagaacagataatgtatagtcataaaattctgaatccacagcaaaaagagggtaaggtcttagtctagcaggtaagtcttattgacaataataaaggcatgtttctaagccacccatggaaaataccaaaaatgttctctattatatcttgaggtgaagttttggccgtgtaaaaaattatggttaatgctgtgtatgttatgttttatttgccttcattctgggaccacaaaaacggatctaactatagataggggcaggagagcatttgtgtttcttcattagaagctgtgcatgttagtctaatgtataagaattaggaaaacaatactaaatctcttgatgcaggccatgtcataaatccatttatacttatataatattttcctttttcttattctttcaaccttcatgcttcttttttcatttaaaaaactttggggtcagcccttatattaccagatgatttctagtagttgaagcccttgggaaattcatttgtccatccatgctgcctagtttagtacaacactccaaagggaacttccttctaccaaaggcaatgactgattggacttaaaaaataacttctataaatatgacataatatctggaggccacatttatagctggtcaaatgcactgttagccctacaaaaggctggctcataattatgaggcaataacatgtaaatttccctttctgatgagaaactaaaggtcacataggtcctgagttgtattaagactgcattaatactgttcgttagacatttcttttctcagtctcaacaagtcaccttaaaatctatggtatatagcagatcctgagcacctacatgaaaagcaagtactcaaatgttagagacctgaattgaaatcaagattgagatccatccaacttaggagttactgctggttcaatgagtccagggaagaggccatttaatgattcctccaaggaccattaagagttccagggtattcccttggatatctggaaacctgggttacttgatctgagcatgactaaaaactgggcaaagtcttgcatgcttatcctaggttggacacagatctctaagataagactggtatttggtaagctctcatctttcccattccttcctttagagttcatattcctgatgtattcttgtcacaagatacggtcaaggttacacatgggttaagagctcacagcagtccaataacaaacatgttgctgtaatactggtctcccttgtagaccttgaaagtccaatatgctatcatctagggcagttcatgggaaagttgacataataatgcttcaattattcaatttataaatgggacatttaactgatagagtagggaggacaactgagaaacgtttgaagatgtaaatagtttttgtttcagagaacaaccttatctctccaacacagtaatattttttctttgtgtagccaaatttctctaacacgaggctcacacagaagctatagagacttcacctagaaggtctcaatggccttagagccatatatatatttctactataaaacagcaacaacaattttggcccaaatatcataacctaagcaaaaatacaaacaaaatcaaacaaacgaaaactacctagaatataatcttaaaaagtactgcctatatgccatcaccatgtatactataaaacccaccaaacttagaatgcacaatgatgtcatttacttcaatttttataatactgctttttgaagattcctatttttatacgtaatgggaaacatgacatcatataaatgaggcaggcaaacagaaaggtgtagaaggcaaatgcaagatgcctatatattgtctaccaagtgttgccagttgtgaaaggatttgacatgctaatatccattcattcactaagagcatgatggctggcaggctctgcatttaagtgcggttatcgaggcccccaaatattgacagagtgccagattctaagaaactattgatgtacacagccggccacagctccagacacctctcagacagagtctttaaatgtcacagataaatgaattttcatgaaactgagagagaggaagagcaagaggagagaaagaacacagaatgagaggcaggaaagaaacaagaaagaagaaaatcacttccataacactgacatgaaagcatgtggcatctcatctctaaagctcaatcataactccttacacaggatgtgagatcaagccttctgaatgcattgcattaccaaagcactcaaacacttttaatcatttcattgcatggtattttaaaagttaagggagatacatgttacagaatagcttcaacaaactatttctgagcaaaatacagttcaaatataaatacttcccgactcaatcctaaagcaaattaaaaaaatatatatatatataaaggcccacaggcacagataagcattggagccttctaagcagttctccatatgcataaaaggtgaaaagtcaaggtgtcatgaaatctattttatgccaagacacaaatgtgtcctctgacattttcttctccacagtcctactgaaagtagtgacccctagtgggtttattgcacgatattaagggatgccttcttccttcacctctcttttcctgcctttccacagaaaacatctgccaggaaaatatacgagtcagttacttgacacatgataacaaaagtgagccatggttataactagaacgaccaagtattccttagaaatcatgtgtaactcaatatattttaaacgtaaaggaagcttttttactttgaaagttttccatctgctgagggcagcttctcttgaccttgatacactgtgccattgaaagcagtcacactttcaaggttagaatatggcttgtttgtgcatttactgttctatactagagttgtacaatctccacgttttacataaagcgatcatgccaaggcacacaaacaaaattcttcttccaattcaaaagcacatgggtaagttttctgttttggtttttaacctgcagcaacatggtttcacaaagccctagctgcctttttactagcatcacaaaaagccttggtgtaagttatttttctacatctggctctctctgttttggatacatgggactttagcaggtatatacttggagaataaagttccatagctcaaatattcaatagaggttttgtttttgcatcaacttttcagtaatttcttagtacttttcttttttatgttaggagataaaatgaaaggatttagatttcctgccatgggaaaaataattattttccctgtctttaaaggcttttattttgaagacaaaatcagttttaactcaaatggaaattgcagtaaaatctcagacactgtaatcagtgactgcattaaaactctcaagaaggaagccaacttccatgtgaggccacaattcagccaggatcacaaagagacattatccactttgcctgtggccattctgtcattttagactgtaaaatttttatactgtaaaattaaggttcaaggaaatcttctctaactttcacatacatacacataaatatactgatttttgcctgtaaccatataataagcagagaggttttggcttactttagacataggtatagaagacacttaataaagattattaaaatttccttcattatataagtaatagtgttcaccaaatattcagtgattggttaacacaaactgtgttatacaccctacagaaaatactgtaaagttgctaaaaaaaaaaatagacttaaatgtgctatatgacaggatatgacattatatatgctcaatccctcttgtataaagaaaattagtatacatatatacacatatttatgatagataggcatatacacaaacattttcttctggaagtatatgtaagatacttttgatgtatttggggaaaataagatggagaattttacttctaattacatatttttctattctgtttgaattcttcaaacatgtttaaaatataatgccaatagggatatccgagtggtaaggttatgaggaatttttttctcttcatttttttatatactggaaaatttaatatatcatatttcaaaacggaagcatcttcaaaataattatgtaatagtaattcatgttagttacaagaaacttgaaaacactaaaaaagcatgaagtatatcaacaaacagccttgtaattctctgacccaacaataaccactgtcgaatttttgctgcgttgtgtccagtttgcaaagtctcttctgctttgtacagtgtaagtaagaaagatcctttacattcccttaacggggggggacccaaaacagctttatgtgtcatttgttctgctatataccttcttagacaccttcaccaccacaccgtttttagttgccaggacattgttgaaatagcatgctatatgtgacacctccctaaattacacaggttctttattcatctgctattgccccctgaaaaacatgatctctgtgctatttcataatagtacatggcatttcatgatggaagccatggagttgaaggcaacagtggcctcatgctccacaattattatagtatacatactgaaatagtttcgtgaggactcagaaatgttcttctcttctgaatgcacagagatgcttccctgtaaggagctctgtcttagaacttcttcaaagcctaataaagttgaaggaaaaacacagaaaggtgatatacttggtgtgatattttaagcaactgacctattaattataataccttttgatattttctttgctgaggatcattttctgaagaagggtatgaaccttctctttcatgcaaaataccttggtataactgttcatcttttaagtatcttatttgccttttggcaaattaaagaattttcctacctttgttgttgctgttattgaaaagaagataataatgacaataataatttttatagctaactcttattggttgctttctataggttgggcagtttacttacattatttgcatttaattccaaaaatacctctattattattgttgctgttattcccattttatagatgagaaaacccaggcatagaaatgttgaaaaacttgcccaatgtcacaaatctactaagaagtagacgaagaaatctacatcagactcattccaaatcttccttaagattattatctagattagggttacatgactgtactaagaggtccaaaccatgtccagagctttcttatttttctaatactatggggggtgaaggggagtgggaagagaaagagagcgagcgagcacataagattccaaataaaatgttataaaatttatctaagacttcattttcctcacctctaaaatggacagcacccatcacagaggtttatcttgaggaccagttgagataatataagtgaaagcatctagtacaactaaaataaaacaccattattgctctacaagtttccttcctttgcataatggatatgttctggataaggtgattatgaaaaggtataggcttaacttctgttgtcaaatcaaagagcaattacactataaaatctcagagaaggattcccaacagattgagatgaagacctgatgtaaggcaggggttcaggtggaggctgggtctacagatttactgggagcactctgtgggttggtaacacattctagatcctcttacctctctctcctcaggctccttggtctgaaaattcctgagtgtactacagcagtttccagagatgattgctttctttttcttttatctggttacaaagtctagtggaatttatttgcaatgatgatacttcacttgaaggccttatcccacacattatgatataaaatagttagaaattcctttaatgtgagattctcaatcagataaattcactgtgctctatttactctggatgtttggttacaggtttccatcatattattaataatacttgcattaacttcctcatattcattacattgaaaggctctgagttagaaaatatgtattctactttcttggaaaccctacactcactagtgaggcctataaataaaatgaaactttaaatagtacgaacttcaccttcaactcataactaaacccaactctgggcttaaagtgctattttctccctccagtctcatcagatataagtatatcatgttactaactgaggccaagctatatatttacacaattcacttcatactaacaacctgctgcattttgttgcttgccttttcttgaggtactgggacttactcttaaattaatgccttagtttttttttttttctctagggacatccttttacttatggaaaatattcagaaagaatggaatttttaaaataagccatctgctgcgcagacctcaagaaaaacagttatgtttgaaaataccagattcaactaatgaggggcacaaaagccttattaactgtgttagctttcttatctttagagctcaggtaggaagtaagagccgacctcagcatgccaacaggtatcaagtgagagaggtcagcacagtctacacccttatgatatagcttgaacacatcagctcagaagtactcttcataaattctaaaaagagaccttcttccagattatctcgcacatggcagcagcctgggagtccttaagacaaaactctctagttctagaacaattcaaacaaggtgcatttacattatatttaatattttgctgtaagcagacgatagaatctactcaaaactatctctatttcactgtttgcccatattcccatatccgtcctttatttctcagcttatatctttcttgaatttctaaagataagaaatctaatttattcatgtattcattatacaataaatattaagtatctcagaaaagggcaaataaatagatgatagatgattaatagatagctaaatatatagacagataatagataaatagctagataaaacagagatgagttatggcctaaagaaatggctaaggaagaagattgcatattgaggatgttttaaactaggtattgaaggatacttgggatttcaaagtatagagagcaaggagaaatcatttcgagcagaataaactgcatgaacaaaaaggtcatcacacgttgggaaaagcagattatttggtttgtgaaagagagtagtaaaaataaaactgagaaggtaaattagggttagatcacatgagagttcgagtgccaaccaaggaatattactctgtcaataatctaggtttgaggaaagcacagtcaacaactctctagctttcataatttaagtaatgagtattataatccaccaaacctctggtctttaggctccacaggggatacgttagatcagtggtagagaaaaggtcctcatatttaatgagtcctcctccagctgagattatcatgctgcatctattgaagttaatcatctcacatgatttgaacaagaatctcactagttcctaatcacactagcattggcccttcattctcaataacaagttctatagagttacctaaaggctgacactgaggctggctgagatgagagcggtgagtatcccaagcacatgtgagatgtctgtagaaagtttgacataagctgtcatttgattttgaataaagccaaattgttcataagtgattggttacttatatatgtctagttcaggttctccctatgatacagaaagtcattatagtatacgtggaactctgagatctccttacacatcttttaaggctcactcctaactgtttaggattctttgatagaaggtgtttcccagcaccttctgttatgctccctctttattgttctctagtggacttactgacttctgatatgctttgtttttatgtatgtatttgtttactttctgcctctcctctccaaatgttaggtctttgaaaacaaggattatttgaatgtgcctgttttgctcactgttgtatctccagcatgtagaagagatacctattgaaagactgcttttgaaactgaagacaaaatatagaggaaggtaagcacatattaactggtatatgggggaaaaaaggcttctgtataaaactccccccaaaaactcatatgctatataatttgaaaatatcatcagctaattatgtcacggacgaattttctataaaactcaaagcacttttaaattaaaagtatgtattttttcttcctgttactgaagtaacaatctcattctctctattttatacaaagggaaatcatggcagagagagagatactctggagtacagcagatgaattcagagcttctgactctaagggccatctatattctatgcactatttaatgttagtttatattttactaccagtgagatttaagtgctgaattgaatagagtcctagaatttgtaccaataaataatgttattaacttatgctctttctgctagcacatggccttctcacagatataagcaaacaaataaataaagagcaacacagaaagaggaaaggtgaataacttaaaggggtgaacatggttgttcttatttttaaaatccagattgttcattttcgttgtaattgtattgtattctactggcagaaagagatgagatttagtgtactatgcaaattatagtaggtccaccacagcttatcaagttctgagaacagtatggtttctttttcctcagatcctcttttacccttaaaatatcttctggattaaaattctcattcaatgaaccacatctttcaatataaaaaatgaaattataaaagtactaaaagaaaacattagtaaatttctttataatcttggcataagaaaggactttttacctataactcattatctagaagctacatagaaaagattagtaaatctgattatatttacaaacaaacttcagtatggccaaaaaatccataagtaatttttaaaagtgggaaaaacttatgcagctcacatagataaaaggattatcatcttaatgtataaatagcaagaaatacataagagaaagactaacaacccaatagaaagaaaaggctaaggagatgaacagacaccttatggaaaaataaacgctaatgacattaaacatattaaaaaagatggttgacatcacttataattttaaaaatgcaaactaaaactataccgagataccgtcttttaccaatacaattggcaaaaatccaaaagcttaaccaagcactattttatagttgaggcttgggtaaaaaggtacttttatatatgccaatggagctgctaattgatccaactcctgtcgagatcaatttggcaaaacttttcaaaattcaagatgcatataaccctttgatcaataattttatttctgagaatttatcctgcagataaacttgcacatctatgaaatgatttatatataaggttgttcactgtaatattgtttgaaatgaaaaaaattgtttatcaatcgggactgaataaaccatgatgcatttatataatggaatactgcaaaactataaaagagattaaggcagttctctatgtatcaatagcaaaagacctctaagagatactggagaatacaagattgagaacagtgtataaagtggtttaacttttgtgtaagaaggtggaaggagggaatatatattcactttttttgcataaaaagaccactggaaagttacacaaaaaaaataatgaataaaagtggttactaatgggaatagaaagagaaaaaggtggatggggagaagtgaagacgtttttacatagttttgatttttgaaccctggaaatatatagcctgcctcttcaaatatatttaaaatatatgtaaaatatatttaaacaaatatatttaaaaactaaatgaaagataatctcatattaaagtaaaaatgagaacagcatagcaatgataaaaatggttcctgagctccataaatttctcccaacttttagctaccggtgcagccaatatctgggtaaacgtggtaaaaaaaacttggcagtttggtccaaatggcgtctttggagcaaaaaatgattcaggttcttccctttgactttgtagcattcttcagatgttattaaacagttattcctttctaagctcaatcgagttaccagtaaaatataaaatgacattagtgttgcagctgtgaactagttgggatgaatccctttaaaagcctaggatgatttccatgtgttgagtggagaagacctggatgtttgcttgttgctacgtaataagaacaaaacacatttcttgaggaattttaatgtgtaaaattgtttttaaaaataagtaaaatctatttattaattatataatatttatcaatcttctataatacttaggcgatgtactcagtatgcataacattcttaacaggaggcagaatacatcattaggcagatgatgtatgttgagtacttagaagttcctaaaggagaagcctataaagacagtgcattataattaataataaatgtaatagtataatttttttgtaaaataagcaacacatttatccactagtcagaaattatagcttcaattcaataagctgctttctcatgtttgtattgagaatgccatctagaacaatctagaagccacagacaagagcaggggtgaaagctcctaaatttcctatttccgttgtcccatgactttttggtaaaaagataatcagtgaattacccattttgtgtaagaatttcttcctctgggttctgttcttattttaggcaatgattttaaaacatggaggtaggtaagtagggagtattcattcaatcattcatttgtattaattaaacaccaagtatgttctgtgtatttcgctaacattagaaatgcagagacaaaagacataatttttgcccccaaatatttcaatctagtggggagaaaggaaagtaaataaccaactaattataacacagggtgaataacctgctgtaattgacttaagcataaatagctgtgagagaacagaggcgtgggactctgacttttaatgaggaggctcaataacaagttttgaggagtgggtgccttagctgaaacttaaaggatggaagaagttaacaaggcaaagatttgagaggatagaaagggattctaggtataggtaacagaaaaaaaaaagtacagagcaagacagaatatgatccattcatgaactgcaggtggttccagacagaggatagagtgatggttgggaatgccaagaaatgagttttcaggcccatccagattgtgatggaagcactactttagataaggtgataagggaaggcggagatctgaatgaacagaaagagacagccatgaagagcttggtgagaacaacgttcccagcagagaactgtacttattgcacatatatgcctattttaaggaatggttaaagagctaggggaactgattcctggttgtcagagatgagcagcactattccaaatactcttcccctgacaattatctaatctcttttgttgtctctggaagcatggttctttcccatcaatgaattcattcagtccctgtaatcaactctgattagtgttgtttaacatcaatcttttctactttttttcaaagaaagataccaatcagttgctgcacacccctgcttgttaaaagcagcacctctcctgctgacttaccgttcttttaatcaaaagggcaggaggaagcagttgggattcacttttctttttttttctttcaaagtacacaaatgtcaacttccttaaggatgtctggcatagctgagttcagtcatgtaacatacaaagtcagcttgatcaaaaggttgcaggctgcccactgctaaaatggaagagaaaaggaaaccatgggcttccctgaagtgtgaatgagtgcataggccactgccacgtgtgtatttatactgaagacatgctgggctgacaagggagattaggaaacataaatccccaccactacactgctctatcttcacctttgaacctctggagcagcactttctctctttcctatttcttctgttgtgcccagtgaaggagttactatatagctttatagcaactgcaagccatggctatttttgaatatttaaaaaaaacatttttgcggccaggcactgtgcctcactcttgtaatcccagcattttaggaggttgaggcgggtggatcacttgaggtcaggagttcgaggccagccttgctaacatggtgaaactccgtctttactaaaaaaatacaaaaattaactgggcgtggtggtgggcacctgtagtcccagctacttgggaggctgaggcaggagaatagcttgaacccaggaggcacaggttgcagtgagccgagatcacgccactgcactccagcctcagtgacacagtgagactcaatctcaaataaataaataaataaataaatgaataaattcttttgccccaacatttagttgaagtttataattctcaatttgcaatatgaggttataattcacaatatgcaatatgaggttataataatctcaatatgcaatatgaggttataatcatttctatggatttaaaagtgttaataactagaaaaagcataaaactgttcattcattttttttttttttttgagacagagttttgctcttgttgcccaggttggagtgcaatggcatgatctcggctcactgcaacctccgcctcctgggttcaagcgattctcctgcctcaggctcccaaatagctgggattacaggcatgcacccccaacgccgggctaattttgtatttttagtagagacagcgtttctccatgtttgtcaggctggtctcgaactcccgacctcaggtgatccacccgcctcggcctcccaaagtgctgggattacaggtgtgagccatcacgcccagcctcattctcttactcttttaataaatcagtatgtatcatgtgacaaacctgtatctgccaatatgacaaacccttgtcaataattctcctggaagatgcttctggcaacccagaaccagaaaataatttttccaaagagttgattatcttagactaaactaatgactcaagttggttttacaaatagggaacactctgtaaatactcatggacatatctaaacctgaacatacattctcatgaagcacaaaaatcatcatatatggttacagtccccaaacaaggctgcagaagaatttaacattcgtaacaatgtacagctagtataattacattttgtgcaacctcgtaattctttaacagtacaactgaagtgatgagaaggtacatactgatataaggtaacatagctctgtgttctagccaaaactagaactcaggatccattatttttaatctaggaacttttatgtgatgaccatttactaggaagggttgggagtaaaaagcataaggcaattgatatagagaaacaaggatgctttaaaaaaacaaaaacaccagtctaaaagaagactattctttactcacttgaaatggctctgaattcctgggaagagcataggaagaaatgtaactataggatcacttttatatgagtaaattaataaatcatttcccctatgttctctaagaaatcttttagaacaatatttcccaaacttccctaatcataccaattgactagtttcttgtttcagatccaaatgccaaggccccttcgtgaaaatttcttattctctaggtttatggtagactcaggaatgtgcatatttcaagggtgaccctgatgattcttagttcagggatgtttgggaaacactgttctggagaaaactttgtacaatagctaaacatttcttcattcctaatgaatcatcccattttaatgtttctgtggtgtgtcttaagcaggtgcagactctcatagcaaaccataaactcctatgttcctttaaaatagcttaagatacatttactcagttttcaggattagcaaaaagtcaaatagggctgttaactagcccattcccacagaagcaccaacctgtaattcccaagtatcaattctaatgtgttcaaaaataaaagcatatgcttagtcatgtaacagagggtttctttttttacttttatttcattgtctgtcaatctggttgatcagattactaatttctactctactggaagtgatctttagaaaaacaggtctgccatgtttgcattacagagatattaacaataataatgatttttaaaaagtaaaccaaacataaataaacaggaaaagaaaccaccatatttgagtccagtctttgtcctgcctagtgaaacatctgtcttatacctttttgacaggcagaaataagacctttcacatcgcctcatctctctgataaatcagtctatttccttacaaatttggtctgagacaaaactcttctgctcttccacttaccatttagaaaggcacagtcagaaacaccatctaagatgagctcacttctgggtgtctttcagttagacttctattaaatggataacaagaaaactaaccaagaaacaaaaatattcctgtcacttcttttgcaacaattccacaatcttgaggaaaattgaattttgaagaaaagaatggtctatgccatcttacaagcatgagatggaggagcaatgactataaagaatattcgttaattttggttgtactgtagttatattacaaattgcacaattaattcccactatcaaattacactggtaaacaggcctagattaaaaacacaagcctgctctgcttgttttgctctgttatacacaaagtaatcttaaattcagtttattatcattagtatggtttcactttgggggaaaaaaactctttttcctcataaggcatattgcatattgagatgatgaagaccaaagtcaatgctgtagagagttgtagggatataactgctgctaaaataagcacttggtttagtagactatttcccttagacgcttggagcacaataattttttcctgctgggagacaatgtatatcctgaatggggtagggcctgaaagacagtgaaatacagccggaaatacacctgatggcagaatccaccaggatcagacagcatcaggacagcattaaacacagtgtttgaagatagcagaggtatgtggactctcaaggaacactgaaagattacagattgtaggtgagcatggttttgagagtctatctctgctagccacaagaaaattagcagtcaacatttgcaaggtctgtttaattatgtcagtgaccagagctagcctcccaggttaagtgagaacgagaactaacaagctgcccctagcctccttcaggacttaaatgataaagccatggcaatcacagcagcagcagcagcagcaaaagcagcaacagcagcagctgaagcagcaacagcagcagcaagaacatggttttgacccgcagttcttgcccatcaaagagctgtgccctgtctgctcccactgacaggcagataaatacagagatctgttggcaagtacatatttatgtgtatctacagttccctcacacagacttacagagaatgcataacagcttctagtggtataacaaatgcacccactaatggggtgagacccattactcacaaatgggtgaaaagaagcatcaatatgcaggtcttaaccccagtttgtgggcagaaacctgtcattccattgcaggccgataggtctcctattcacacagtccttgtttaattttccaaacaccctttctctaaatggtgctactctgagctgtgtagtgcagacagacaggtttgacaagcagagctgtcaatttcacatttttcatcccaactgcagggcaaaattaggccttgtacgtaactggggttgactggttaggaaggcaggagaggttggcatttaagaggtattttccacattagaaactcagaactcaagatagaaaactcaaaaagggttgtccctattcaacatccatgaaatcaggagagtccaaagatgtgtactggtggtctactgtggggcatatacattttgctgaaacgagaagatgaagggaaaagtaaagcttggtcctatctagaaggagctatgggtaagtaagtagtgaaagacactcactcaaataccataatataaaaatggggcacttgccgtaagagaggaacatagcaacgtgtacacacaattcttggttaaccaagaagttgaatatataagtaatatattagtcaaatttttatccttcaaaaaattttggaattgtccaaagaaaggccaacaggatacatgctaggcaatgatgggtggattaggcatacaacgaaagcaagttaaccagcgctgtttctaacaaccaagtcccagaatatccttgggatctctgggactatctcaagcatataacatgagtctgggatggttttgaaatctctgctagcatatgctctgccctgaggtttctttttggtgctgatttggttgaactgaagaaggaagggagaacacatagaagaagagttctctctattttcaggcggcagtcctatctataccggtggtacagttaagaacctagaatgaatgctcctccagaatcccctgtgcagatcgacactctatggtatatgagatctcacagagtcttgcatatcagaaactcacaaacgggaacacagaagagtctgtgtgtccctgagtttatgctcaagctgtcaaacatcaagagtaatttatgttgttcaggaacatactataacaaagctctcacaggttggaggcttcagtgagcctgagggctcacttcccaacctggacttaccccataaggagcaacggactttgctaacatgaaatcaaaaggcaaaggaaatcaggcatttaggaggtattttacagttacaattacccaatcctaggttggactaggattggggttggtggggaaggagacatggaaagtgctgttaaatgttgtttgaaatgtccctttttgatccccacagtcatgagtgtatttgagtcttgattgctctttacttaaattattgtcattgcccctcagttggcatctctgactaatcccaaccctctcaatctactctgcacactatagccaggttaacttctaaaacatgcctttcattatttttgcttgtctctgtaagtgtttcagttattcagcaaatccttattgcattctaactgtctgatagctattgttctcatcacccacaaaaaataaatctggactctgcctgccttttggaattcacatcctagtcttcaataacatggctctcatttctagtttcactacttcctgtatacaccaactttatttccattggttgatatttttcttcatcctccctacttctctgttttcccatattaaaccattggctaccatctttgcttctttccaaaagaccttttattccattatctttcaacgtccagcttttacatctacagctaaagttctccgtctactattaatcaagccttctatactcctttctaggccaccataatgcagattcttgtagtactcactacctttcgttattgctcatgttggtgcataatggcagattggtaatttccagttagttttaggatctaattactagtctctgcaataagagtataaaaaccataagctctctgtgagcaggtattgtgtttctgatagtaacattattaactgttgtgataactgtgaattaagtttagcatcatacttatttctaaatttaaattgtaccacttctaacaaaattttctccatcgttttattaaaaaaaagtccaaaagaggatgacaataacaggaacacaataaatatatatccacatgtaatggtcagtggtcttttccagtgacaataatgctgcattttgctattagctcctttcttttttacgtgatattcactattagacatactactacactaatgccaacattttccagtaaaaattgacattaattaagctttggatgttgtcagcactagcctagggatagggtaggtttagggccactgagaccaagttcagggtataagatctctgatattcatcaagcagctaagataagaagcataatgaaaggcaaaacaaatggtacaccatatagtatgccgaatatttttaatgctgatttttgtagatagaacttgatatcagcttttactcatttgttattgatatatgtgtattttcttaaaatataataaatatagaaaagggtttgtgaataacataatatgaagatcagaatcaagattagagccaagggcatcagattaaaatgcagatgaataatgaatcacctgtaagattaaagctctaattccaaatggaaagaaagcattggcaaaggcatacaaacatggttctagtgtggtgttcacagttccatgaaggaaaagatgaagcagataggagggtgggcctactgtatggactaggtactggtattaagggttttgtattaggcaagaagacaaaaataattaaaagagtttggactggaagactgggaatgataactggggatagtgaataggatggcctaggtgtacaatgaggtcagcatttagcacatcaggtggccaggactaggacctaaccaagaagctggaaatagaaggaaactccttcattcattatttgaccttacatttttttattgaataatagtagtagactgatctatagacctaaaccagtggatcaacagacctagactagaccatgcttaacagaatttacagtttggagggaaaatagacatgaaagacttaagtaataagatgagagcagccagagacaatgagtaggtaataggagtgaggcccaccaaagaagtgatcatatatcagctacttgaaaccagtggtaaaagtaaactcagtaccaagctcacttcatccaaagcatggattccttatatgttctctgcttgggataatattaagatcaatctgtatgtaaagcttacacagctaggacaagcaaggattcctaggtcgggggagtgtgttcacatatgatggtgtctgtgcatgtaggtttttttcctaacaagtattaaccatgatcctatagcataagagtgagtgatgatgaggaggatgataatggtaatgatgataacagcagctgtttattgagtgcttattatatactaggtattggtttaaatattttacatttattagattacttactccccacagtaattttataataaaaacaaatttatggtcccccacctccttctcctcatccttaatttacagataaagaaactgagtcatgagaattagttttcttaaggttacagtgttgtagaatctacgtagtcttcactcttaaccacactgctctactgcctaaattcaggtaaccaacaaaagagttgccctgcctcatcttggagcttatagatgtctacagaatatattgagaaatatatatgagaaatgatttaaggatattcttaccagagcagtagccattctaaaaattatcacaatggtatattatattgtttagacataaaatgagagtattggggtaacatatatcagagatttggctcttacagattttaatttttaattgtactatttaagggaaaaattgagtattgtgaggagcactggaacaatggaaaaggtaatatggaaagtaaaaagtttagtctcagcctggtaagtgtggctgtctatctcttcaagcttcctttcctcaacggggtgacataagggttaataggatgactgtaaaatgcagttaccttatgaagaatgaaaaatcccattattactgagatttttcaaaccctgataattctgctgggattttctgaaccatgataattctgctgggatctggtattaaacagcatgtagacagattaatcccaagcccagaaaagagcaaacaaataaaacataagtagcataatgactgaagaaagttagattgtagtgtccaatctcatagtggccactttttttgtttgtttgtttgtttgtttgtttgttttgagacggagtcttgctcggtcgcccaggctggagtgtgcagtggtgtgatctcagctcactgcaacctccacctccctcccagtttcaagcgattctcctgccttagcctcccgagtagctgggattataggtgtgtgccaccacatccagctaatttttgtatttttagtagagacgaggtttcatcatgttggctaggctggtcttgaactcctgacctcaggtgatctgcctgcctcgcctcccaaagtgcccaaagtgcttgggattacaggcatgagccaccgcgcccagcctgtagtgcccacttttgacaaagttgattgttcatgtgggagcatgaacatgaaaatttaattacaaactaaggagaaacatacttaactttgaatctttcctattggtttcctggagtcaattttaaagtatcacttaataaatactatttgacaatttgcaaatttatataaatgtattttccttagagtataagcattcaactccaatatgatggtttcctattttcagtttgagtaaatatcaaaatagaatgtccctgttagatatctagggaatcacttttaggggacactatataatgccttactaaataccaagactacagtactattattttcacaagtgagcatgggtcaaggcaaagaagggcaagttggggtaaggatgtataggctgttaaccttgctgcacaggtaaatgtaaaagttccttttttctagcctcaacatgctggaagatcctgactttaaactgagtagagaatgtcttaaagcaaagaaacaagaactcctgtactctgaactttgttggggagttctggccccttttatcatttgatcgtcaatgaataatataactgcgtttagcccttaagcctgtatcagctgcaaacgtgacagatacctgtcatattttagaacagcttatcgcctcagcctctggagtgattgagtatttatagacacaaagatagaaacataaagcacatatgtataggcaggagtcccctggaggtggcgattaggactaggcagtaattttagcttgaagttcctatgacttaaatagccacttgagctctgctcttgcagtttacgatgtcaatagaacccctaaatgaaattacagccttctgatacgcagcaggatatcctttctttgccatgcaatgtacacggccaggagaaattgctctgtatatggagtttcactaaagcagaatttatcataaggctgctctgctaaaatatcattatgctgttattcactggataacacatctaatgactcgaggtgcacttgatagccatgtttcagtgaacacagacgcatgccctgatgtgaactgggcactccagtacttcaaagcactatcgatttcaattctaccataatttacacctggcttgttttgccaatagcttgaacccatgctaacactggaacatacacatacaagctttagaaagatcagaaatgaggtgtatagcaaaaatgaatgcagcaaactctccaggattttgcctttataatcatctcccttgatgccgattaaatattttgcacgattttcctagttaagtttgggcattccctctgttagcattatcctttggttggtgatgatggtaataagaacctcttatatttggacaagctatggacacttctgcagcaggatctgggtgccagtcatcttggttctcccactatctagcacaatgactggcacataatagttgctcatgataatctctgcaggctcctcttcctctctccattccagaaatgcactgtatataaaggaccttctcccttttgtcatctttcaatatatttttcctgagaaatgtccactccataattttaactattaccatgatttggatgattcagatgactgccaaagtctgtccctgacatctccagcattcctgactaaatccaactgccagtctggatgctcccctaacacccccaaattaaacaccttcaaaagtaaatttgtaatcttcccccatcctccaaaatctactcttcctcctcatagcttttcttgcttagttgtataaggcagaaacctgggagcaatccaaaattccttctctccatgcccagcccaaaggttattaaattgtgtcaattttgcctatctcttgaacatatctcctcctctctgtctattcccacagttattgtcctagttcagggcttcattgtttcctgtctgaacaatttcagttgcctcctaactcattttcttgcctctattctcccactcctataatctatcctctaccctgctgacagggtgatcttgtatcacacaatttcatcattaaccttctctacttaaaacctttcaatagctccctgaatgccacaagatgaagttaaaacttctttgcatggcaatcagggtccaacatgattgttccctgcctgcatctacagcatcgtttctctgtactcccctactacacataagtgatagtgttccccagctctgccatgctatttctagttaactgcctttgcccctgctggctcccttactgaatgttcttcctccctctgaccatctgggaaaatccttccattcccagcacggatttatcagctcttctgtgaaacttcctctgatcccccactccaagatatgttcagctgaacactcactgtgcctccatggttccttgaacatccttcagttacggcacttagcataatggtattaccccaacttgtttccctatctgcctctcctctagtgagcaacttgagaccatgttgtattcatctttgtattgtaaatgacaaagccaatgccttcacaacagcatattagggcccatgtgatcagacacccttgtctcccttacttcatctcctactagtctcatgcttacccactcagattctgccacacagacttccttgttgtcactcaaactttccagatacattcatgtccaaggcctttgcacttgatggttccactgttgaaaatgcttttgcttagatatccacaaaacttgcttcttcactttcattgaggtcttttctcaaatgctgtcccccaatgaagacttccctctctacctctccaccctatttaaaattgcaaacttatccctgacacaaacacacatgtatacactctttctcctctttaaattttctccatagcacttatcataaaatgccacatattttacatatatatatatattttatcttctgtctctcctatctagaaagtaactacaaggagaacaaagatttctgtttttttttttctaaatctactgcagtatccccaacccctggaatagtgttgggtacataatatgaattcctcaataaatatttattaataaatgaatcaatctttagcttcttgaataataactgacacagagtagggattcaaaaatgtttctttcctttttttttttttttttggtttgttttttgagacacagtcttgctctgttgcccaggttggagtatagtggtgcaatcatagctcaatgcaagctcaaactcctgggctcaagggataagggatcctcccatctcagcctcctcggtagctgggactacaggcatgtgccatcatgcctggctactttttaaaaattttagtagagatgagatcttgctatgttacccagactggtctcaaactcctgggctcaagggatcctcctgccttggcctttcaaactgctgggattataggtgtgagccactgcatctggcccaaaaatatttcttaaactaaaaaatacatgggtgaatgaatgaattaatgttaaatccatctttaatgaatataatgaagaaacagtctgtgtacagtacagtctgtgtacagtaagttgaatgggttactattatcctcattagacaaatgaaatagatgagtcccagaaaggttaggagccaaaattaaagctactatacatagcttaaacaggtttgctactctttttcaattcactattgaaaggaacagacaattctttgcactttgttcatgatgtacctctgacatttgttatacaattttgcttcctcttgactaggaatgcaattagcaggaggtgcaaggtgctaacactttttattacaatttatgtctttccatattaggtgtttttcataaaaaagatcccctttctttaattttcacaagtggattaggcactcatataattttgcccttcggagtggtttgtacatgactacccaggaggacattgtgttacaaatcctgccagaatgaactggaaggtgagtgcagcattcatagcttaaggatgaacaggttgtttggtgccaggtttgtactaatggagatgttctccattagtgttaactcccaaaggagaataaattcaataacaaaacatttcagtttttggcatttctatggagagttaactttccattgttcaagggttaattatccattatgtgaatcacttttctttctgtggctgcttacatctaggaattcagtttactagagagtgagcagggaaaataaagagacgaaaaggaatattctatatatataaactccaggaaaaaaattggtttaggggacagaatgagatatagtttggggattgctaagttgattgacaattgaaaatgggtaagattaaagcatgttttattatacacaatattttgggttttttttttaaattgtttattagggtcagtttgtagtacatgcagttactctctggatgtgattcttgtcagcacaataccatctagggtgctagaatgggcatttagcaaatggtactttagaggctagctcgacttggtgcccctctcctctgaagaaggcttagtgtgctgcagcttaatgaatgaaacagcactaagtgattccacctatttctctactcattgatgagaaacaactgcagtaggctattttcagctattatttacctcaaacagggcatttaattagtgcttgttaagacagtgcaaatgatttggctgccagtcttcttgcccctgctctttattgtgctgtatgtctgccccgcctctctcctgtctagttcacagggcatccatagccagtcttcatgcctttccataactgacatcagcctgacctccacggatgtggaagtttgaggaaaggaagaacaagtattgacaagctggagggactgttggttaatatgatgcattataggtaagtctggtactttctgactacatgagctgaccaagctggatattcggtcaccctcataagtccaggaaaatgaatggaactactgcaaactgaagatcccatgttccatcagaaattacccaagcattgtggggaaccttagcaatcttagtaaatggttggaaatgctgtcagatagttggaagatctaatgtgggagttaaggaggctcagatatagaagactctgccaatttgtgttctagacatggacatgtttttttcttttcttttctttttttttgagatggagttttgctcttgttgcacaggctggagtgcaatggcacgactttggctcactgcaatctccacctcctaggttctagcgattctcctgcctcagcctcccgagcagctaggattacacgcatgcgccaccatgcccggctaatgttgtatttttagtagagagggggtttcttcatgtttatcaggctggtctcgaactcctgacctcaggtgatccgcccgcctcggcctcccaaagtgctgggattacaggcatgagccactgtgtccggctgtttctttcactatgataagcaagatgtattcactgtcaatgcactgacatgtagatatccattcattcatcacctattcattgatcctccactcagactgagccaatctgacactggttgggagagaaattaacaaacctaaaacacaaaacctgccctctaaccacttgcagtttcatatatagaaaaaacttcaacttaaaagcatatataaatgctaaatgaaggtagatttgtaaaatgctaccagtgtcagatcacttttaatttgggttttatggaaaacttcagagaaaaagtgtgacttgtcaaggatatgatttggctgatcttgaaaagttatcagaaaaattatggttgctgatgctaatatgtaaatacagcatcaaaatatttaacatatagtaaaatagctgagaaactaaaatgggatcatctgtatatgtactcagccttataaaataaaatgaattcattaaacatatgctcaattttaagatatcaattaatttctttctacttaattttaaacttttatatatatagcaattaatattttgaagctgtacataatagaatttaggttgataagctaatatgtatatttgctgaaggataattaccaaacttatcagctaactacatctttctttttgcaaatactgttcataaatatttgtgtaaactttcggtgttgtcagtgtgataaaaagtcagctacatttcatttatggtcattatgaccaaaacatttgactgaaatcaaaggcaagtaagcctggctagaatttggtcatatttttaatagctgaatatagatatatggttgtgcgtatatgtaggcatttataagctaacatacatatacaatcatatgatacaagcaatcaactcctttttaagtttttaaaatatatgtctttcttaggggaatcacataaatactaaaaaccacttctatataaataagaaagaacaatttcttattggggtaacaacaattctgttatttagcaatttgatttgtgtatatctgcgactgcctaattaaatgaatatagcatataggaagtacttacagctaaaatatgcacgcaagaaaatacacatttcacaacatgcatcctcattaatttaatgaaattagaatttccaggtgagcactaggaaattgagttattgacagtgcattgtgaaggcttatgatcaaggtattgaaaaaataagtaatattaatatagccattgaagcacaaaaaatacatcgtcttgcctttgtatcagaggtacactaatcaaattctgacttcttatatatttcaatttagtcatgaaattcttccacgaccacttggaactccaagccttagcaactataagaaaaatctctctggcagattatatttttttaaatgtcatgtcttgggaatactcttaaatatttgttttcacctattctcttcttaaagttgcttatataatttcatatgtagtcattaataacatgttttcaaagtgttagagatctagcttgccttcaacgcagttctaatagacatccctaccagaaactatgagacagttttcctgggagtctgggcagtttgaatattaactgaggaatgttaacctcctatgtaggtcttggtggtaatggcctaagagctagttacattttttataacgtattgtaaacaccatttccctttcaactttttttctttagaaaacaagataactaatgaaaattacccaagaaatattatacatataaatagtatagtcctaacacgagctaactacaataggcaaactttactattaatataacattaaacttttaccatactagccctaataaaactctgagactattttctatcacaatgacagctgatgaatttaatgtgcctcacaaactataggaattgtgataggaagctgactctgtcctagaggccactgacaaacctgataaggctgtagcaggggtcagtctctataggaaacttgggctatatgagcatgtatgagttctgtggttaagaatctgaagcactcagtatagcaaacaaaattccaaagctgagtaccaatgtaatacgctggatcgctgtacctacttggacaagagtacatgcaacaggcacatacaatatacatctggttaaatgtaaaatcatccattgctaaagcattttaaacttctaggagaaatctactggcaatgtgttaacagcaaggacaaccaaaacaataaaataacatctctttcctaaaatttaagaacatcaagtaagtgccccttaggctgggttgtgattcctggaagtttcagcctatgagaaccatattggcgacatcaaagactccccctctttccaaaaagcaattcacttcagatgctgccacacaatcgaatgcttttatggccaccatgtttttttggtttttgtttcgtcttttgttttttccatgcttaatgaacatgccagattcttgaaatagaaagaagatgagaaaacccagtaagatggaatacctctagaaaagaaactaggcagggacctgatggtaaaggataaaaacacattccaacaggaattctacttttagggagagtatgagttattaagaaggatgtggaaggcacattttggctatgaaagctggtccgtggactcctctgccagtctcacatcagacaggatgcaaccatccccactccattccttcgacaacttcccagagcacattcaatcagtgtcccttaaattgaggacaatactatatttgggtttaatactgtgaggacagtcatttagttttcctgtggcaggatgataaatttcctgggaaccaaataaggattctcattgcattcttctgcttgatactatgaatgcagaagaataaagaagagggtgtgacaaatcatattttccaaaggtcgggtgtggggaggttccctaacgtttaaaagcaaccagttgttagcaaagtgatctttagaacagtattagcaagaatgtttgctctacatccactatagatattctctcctgcttagctaggcatgtaagtactgtgagcataatgtaaatactcagaacagaaatgcatggaaagctggtggagtgaaactccaaatgaacaattaattccactttcacttcccccatctacctccctgaatactacctccctgcccccactcacctatcttcctccccccaacaagcatgtttgctaggcatgtcaaggctgacatccatcggtggcagtatgaaacctatgcctacaggctgctcctgagcatagcctcaaggctctgccattgtccgtagagtgctctaagttgtgcccgctaaaaatcttcatcattccatttgactgtttggtagtatttctttaattgtattttttgtttgtttgttttaaaaacaccctttatttcctgcttgccttagagacaccaagaataaaatccttgacacatcaaattctggaacctcaccactcaccaggactatggttcctgatccaaggagtgacgactgagaatcagcacacagtctcttgagggtgtccaggcctggctgttaagctccctgctctgattagtttgtcgagttcacagtgttccagagtgctgaagcacagaaattagggaggggaggtggaaggaaaatcactggagcctcttacgatctaacttccactaactgggaggaaatgtcttataaataaacaacagtaagagaaacaaaaaaaaaaaaaacccatcccgtcctgccagaggaatgtacattattgtctcccgacggaaaactttacaccacaccagaatgcagccatgtctcctgaaactacctccctcaaaacagaaagaaaaagagaatcaaaaaggaaaggagaacaaaacagaacaaaaaagatttcatccccttgaattctgttgggaagttcatgtgagttcccagtagacaaactaaactaagcaatttcaacagtgtcactgttccagaattttgtgcagaggctgcttattagccaaatttcatttctgcccagatcactgctgtaccatccagacattttcagaagggaagttcagggaaggggggaagggtacgactgtggagaagaggaagaagagaggacaaaggaaaactcctgatgaaccagaatgccctagccacggccatgatagagcgagcccccacccaccacccgactactgcttgttgaggacttggtgatgcggtgtgttttatctacttactctttctgctcgggaggctgaggttcctacatttccagctcatgctggactgtaccgtaagcaacaagtgaaatgagttcagtgatctcattctagtccttcgactcctgtccacatcactaagcgactgcacagcttggcacaggccaggatgagtcagcagtctctggtcatgagaggccaggcctggaatagcaggggggtttaggtcaggagcaaaatgaagcagaaaggcagtctagatggcagggctctgttctgcaatacacagaaatactgcaggtcaaaatgaaagcgcctcatcagctctggggtgaagattgtaggactgtaaaaaaagaagcatcaagagaaaaaaaaaagctgcctaccaaacatagcaaggacaaaacagagtaccacagtcagaaaaagagggcactggtagagccctggaggataaaagatgctcattaaggtttctgaaatgtcttttcttccacatgctcccaaacttgaattaagaaatggtgacttcctatatactatcctagtattttggtactgttttcccaattcagtaagtagcaaaacaaataaaatgcaaggcactgcagttaaatagcaagaaaagcctcatatttcataaaataatatgagtctgatatctcaaaggtgtacatttgggttaatagtgtctgtatatagcctgtatgaaatggttaaagaggagtactctttaagttgagcttgggtgggggtagagaagagcttagagaaaagagagttaccagttaatgataaaacataggggaactatgacactgtgaccatatttctactcaatggggccaacatagacctccattagacctccatcaagaagtgatgctcccactaacaggacttcaaacacttctccctctgcagtagtactgtaatatagcaaggggagagggaaaataaaatagatagaaaaacaaggttcaacataaaaaaaattagtgatagacattttgtttcagaggaggcaaattgctctataagtcaactgataaaaaaaagtcttggtatctgaacagacttagagaaaccatatctagatgaagatgccaggtggagactgataactatcaggaaatggtagtaatggccataaagaaggaagaaagcaatctcaagtcacatgatgtagaataaaacagcatggaaaacagaaggagagcaacagacttcgggaacacgagtaaaatatttctttaaagtccttttaagaggagtaatgaggacccaccacatattcctaaatgttgtccctcagagatgcacagatgtatatgggtaaggaaatgtaaaataaactttcagctttcatttcagagggtattaagtcatctgaacacatatttactaactgtttaatcttgggcaaatgagctttctagcctcagtttctctctctttgaaatggaaataatattatcatcctcatggaatcattgtaagcactgaatcaatgttcattaacccttatctcagcagtacctgtcacatggtgaacattcagtaaattgcttattattcatattatttgattatcatatcatatcatctttataagtatccagtgaaagaatccccctccagtgttgttccactggattgagaggaatcaatatgaagactctagtaaaatcagttgagtaacactgcttacactgctgctttaaaaagattatttctgtctgggtatgttaaacattatacttgaagacacaggatgttgaaaatctattatgtgaaatccttgaatttgggtatctatgttgtcaaagcaacttggagcctaacagttgtccagtaactagaggcccaaaaaagaaaagaggaatttttagaagcttctccaaaagcaacaggataaaagtgttattggccttaaccgcatgatgagggctttttaccaaaggggaaaacgtagtccagttgatcatcgcagcctaattgattaattgtgggtctgaccatctggctgatgaatgctgacacccagcagtgattactgtgtaacacaattccggatgtgctctccctgatgcctcccacaataatggcaactctgaacttaaggttagtttattcaggcctcttggctcaatctcttcatggaatagtggttgtggcagggaatattttactagacctggtcaagcattatcttctcttatttcagttacccactcttttccaactctactcctacccactcctaagccctctcttgtatataatcacttttcatgcaaagcattccatctgtagttttcatcatattatctgattctctcatttctggttgctctgttctgaaaaatatttgactaaactaggagatctatactgctagaatgccatttcacaggggatcctattgggacatgtttattgtatcttatttgctactggtttacttcaaattactctgcgcttccaaataaagaaaattattttacctaattcattagcctgattaaaagtcccacatatggcccaagttttccatgagattatcagaatacaagggttaatagacgataattcttacatcttaagcctacttctgaccctcagttaggagtatcccatgaagaagattcccctggagcatactttactgttagagaaggaaagtcagacccatgtaaatgacaaggttcaatagcaatgccatccacaaaccaatctacacctggagatgacttgtacatggagaattcaccaagcaaataaaacctgtacatataaatataaaccctggggaattataacaaaataattccattgtattttgtaggaatgcacaggggagtaactgacacaaaatatcttatacaaccttgaccaacaagtcacaatgacaaatcatccgtttcctcttttcttttcccagattgatttccagctctaaattcatcttttctttcactccccacagatgctgaattcttctatgttccaggctgagttagtgttaattttcagtagaggacggcagtagcatgctgaactgtagagttccgggctgggagttgggaaatgtttttggcctgactgtcagtaaacaactatgtgtcttgggcaagtcaagtcccttaactccccatgtctcagtctcttcattgaaaaatgatagggtaggactgcataaactccatagtctctgccaacactaagattctatggttctatagctcatttccttttttttctccctttggcatcaactgctcaacaactccgctcatagtaatctctatgctctcagttactaatggaaaaatatgtccttcatttactagttggtattttgtatttgtaatctctctctttttttatttgatgctagatattttgagtcataaacaccaacatatccaaatagatgctttaaatttgaaggcgtttaaggaaaatagctttcccatgtagaatatttagtgtagcagggcatggaggaagccagccatccaaaagtggagcaaaggggccaattcacaaatgagagaaagcctttcataataagagtctccacactctttaacttagataaagctaaaatgctaccaacttctaactacttttccaatcaatcccagacaccatcacagacacttaggactacaaatctgaggaccagcactggcagcaatgcagttcttatttcacctccaccacccattgccaagcaggatttaggatggcatactaataagagccaagaggacgatctgtcatttattttcctccaaactttttgaaatttcccatttgggctctgtttcccagttttaatttggtaactgccatttttcagcatttcttttaacaggttactaataatttctgatacaggatctcatatttcattttatgctgctagagctgctgttaatatttcatctgccttcaattcagctctgaataaaggctgctaggttttgatagactgttaacactttggttctggggatttgatcactatgttcatccagtttgtccatattttgttaaaaaaaaagtaataggttagctatctcagaaatatctcagggtgtgctatacattctagggatacttcagagtttctttttctggatctttgatgaaaaccaacaaaaacaagtatcctgggtttgttttcacaaatgacttgccatttgcttcagtgtcagtattctggaagcagtgggcagtggttaagattcagggctcataggcagatctagattcaaattttggctctgaaatttattatatatatcacctcaggccagttccttaaccttgccaagtctttcttttcccatttgtaaaatagggatgataataatatccacttctattaattaatatgaggatccaataaattaatataaagtgctgaggattttctcagttctcaataaatgatggctatcattatcctagcattaataatctacaaattcacattatagaattattattttgcaacatcttttcagggtcaacaaattattttttagtacagcctttgttgtttgcttcactatagcttacatttttaaaaagtctcagtaaaatcatgtaaaatatttaaaaatttgatatttaaactgtatgtacagttagactaatatatagcaccatattattattattgtagcacttttcagtgcagcagcaaattctcaaaagtttttgtccatctaatagccagccctagataaggcacattgtaccaatactaatctgttctataaaaagatgacttatcatatttatcttctcctactcccaaagaatatagattattttaatattctttgggtatgtgtcagtcaggccctgtttggatacagagaccatatagcaatttgaatagaaagttagtttaaattattaataataacgggattaaagtaataagagtagctagtaagaagtaaagaatactttaaagaatataagaataacatgggccaggcgcaggggctcatgcctgtaatcccagcacttagggccgaggtgggtcttcagcctaggagctgaagactagtttgggcaaaatggtgaaatgccgtttctacaaaatattagtcgagcatgatggtgtgtgcctgcagtcccagctacttgtggggctgaggtgagaggatcgcttgattccaggaggttgaggctgcagtgagctgtgttcatgccactgcattcaaccctgggtgacaaagcgagaccttgtcttaaaaaataaaaaagaatagaagaataacaaatgtaaggaacagccattatttgcagggctaagatagcatatccaaggaagagtctcctccatccctggactgagatctagacattgtaggactcaagacaaaaatctcctggacccctggaccaggatccagaccttgttggacaacacacagccataactcattggatggcagagaagttgctggggagctgcatcagtagcacctgcactctagggtgctaatgaaagctatttacagggatgtatctcatctgaggcactctgctataaattgcccaatgtgtgtgtacacatgtgtgtgtacgtgtgtgtgtatggtgggtgctaggggtagctgctacctgccacgtactggagaagctacctgtgcttcagctgctgggtaccaggttagctgcatttgctgcaggagctacatgctgtaaaggttgcttatgttgtagaagccaggctctggagaaaccgtgcacattgcaggaggctgccaaagtagtgcatgacaaccaggaaggaaaatttcttctttctgcaacgtctccctaccttctctactgacaaagcaccctcaaaccagctagcaaagaaaaaatatttaaagaatccagatacatttttgcagagcaggcaaggagaactacatttggaaggaggcaatgggaggtaatacattggtaactggcacagatattattatttgctcacacacttcatgaaataactcacattagagattataatccagtattttcaactgattgcactactgttcacatttactaataaaccaactccctttgcatagttaagcaaatactgtcagaattaagaaaaataagaggccagtagataaatacctataatagaatattttaaagtgacagtactagtatatgtacataaccttttcccccaagtgctgcccacatacattttaattacatgtttataatttacttaagaaaaaaatatacagaagtactaagctattgacctaaatgtatgcatcagtgatctcacaccagaatctcaactaagtgggtattcagaagagtcattacaaacaaccaaaagctttgagagaggtaaaaattgcctcgattatcatttttcctttctctttccttttctttttaattaactctagaactcatatttgcttcttctatgacatttttgtggaggggtggggtggctcttaaataggttattcttttttttttttttttttttttttttttgagatggcgtcttgctctgttgcccaggctggagtgcagtggtgcaatcttggctcactgcaacctctgccttccgggttcaagcaattctcctgcctcagcctcttgagtagctgggattacagacatgtgccaccacacccagctaatttttgtatttttagtagagacagggtttcaccatattggtcaggctggtcttgaactcctgacctcgtgatccgcctgcctcggcctcccaaagtgctgggattacaggcatgagccacgtgcccagcaaaatataggttactgtttttcagaaaaatacatatttagaaattttttcttatgattctggtcctatattgttctactcttaatattaaatagagaagcatcaataaatgaccaatttggtaaactatgatactgtgatcattgttagaactagttttacatatggggagagagtatattccaaaatacctcccctacttttgcctaattcccttaagaagggaacaggtgcttttgctgtataattacaggtagagtttaaaaccacaaacacctgacattagcaaggagcgtggttgtgagaggctgagagcagaaaagctaattgggtgaggagagtcctgtagagagtagactatactgaggtcaggaccacagaacatctttctcaccattcatccgtttttacctatgtctggccatcagcactatctgttctcactattatggaaggggtctacttgttacctcacagttgtgttttcttaaagccagtggtatccagcaaagcaagccatgttgggttgtctcacaatcacactgtaggcatctctgccagctgcaggtggttatccttatgatttccttttgtttgtgctatgcgtgagtactgaggataaatttaatgaccctatgtttagttctctcctccaacacacatgcacacccccctctcccctgcaattcctgagttcaaaaagagatgaagacaaaggaatgtcataagtccgtgtgattcaggcaggcaagtccattttattttagtttgcccttctgttctgctggcttttctgctatgacccactatacttaacctgtcggctgttcttagtagcaacatgcctttttaatcagccttcctggggtctgcatttgattacagcatttgtgttctattttgattcttttgtactgtgccctgtggtgttcgcttgaaaggtgttatttataaaatgaaattctattgtattgccacttggattcaaagaggacatataatattaatgcagaatgtatttaataatatcttcaatctattaaatcaatttcttcatgagaatacagaatggaagggaggcacatgggctgataatcaggtaataagacttaagaatcacctgaacttttccttcacaagctttcctgaaagctggcacaagaatcattctcttaatgtcagggtttccaagtggaggagactacctttcttcagccagaccagtgcagtgcgcacctgtttaaacattcaactgtgcaggccaaacattttcctaggcttttagatgcaaattttttgactaaggaaactatgagaccaaacatgaatatgacttttttactacatagaaagaattaggttatgaaggaaatgtaatcacctatttctaaggatctactttcaagatttgtaaaaagaagtatatttgttctcacactgactcttctcaaaagcaggataggaaaattctagtgataccaagaactgatgcaaagtttccaaggtggcatgttcagaatgatgttctcacctagcaaaagggcaggtttcattgtgggctgctgggcctacagtcaaatgtttctagattagattgatggaggagtccccaagttttttcaacttctaattttaattccagctaaagactgaaacattgtacactgtatcacagcttgcacagcacatttcttgctgcatacattctattctttcactacaatttttttttcctgttgatctatctgaaatcatcaatggctatgctgctgtttggatagggaataagaaagaatttggtttgaaagatgatttaggaatcaggctctgcagaacttactaaaagaaactgtaacatacaaaggaacctggctgggcagtcttgaaatgagagttcctggatttttacctgttctcattcagtggcatattatataactccagaaaaatcagggtccagttttctaatcactaaaaggggaataactgtccttttctacttgcactgggctactttagggatggataagaaaatgattccagaatcttgtaaatgctttgcaatgaagaggaaatacaaatgcacaatattattaaaatgatagtttaggccacatttttgtttctccaaatctagagatgaaaaatagtaacaaaggaataaatttcttccacttcaaaaataaataatatacccttatttataaatgacatgtcaaacataaggaactaggatgtgttggggaatacacatctcagttttgaaggcatcaaattataagctatttgcatgaaggaatcacattcatctctgtatccacccaagttctacctcattgatttacattatgtaagtattccattcgttaacatatgttgaattgaaatgacaaatgagatcgcacaattttagagctcgaattaactagagaccatgttaaatcctgttgcctcattttgcagatgatacaactgaggcccagataagtaacttaactaagtccaatactaaaaatattacaagttttagaagagttattttaaagatctgccactgaaaatatatcactgaattaaaacaaaatagacattcttctgtcaaaataagaagcactattcagctcaaataatccgatgtatcctaacctaatcaagaaggctgaagcctaaagtaacaagtaaacataattaaatagctatagacccataggcatgttagaaatgccaagttactgaggggtgcatatcttaatactttgtctatcagccagtccaaatggcatatttttttcaagtaaaattaatgtcttaacaaataataggggtgaagtcagcaagatggcagagtggaaaactctacctctcattcttccacagaaatactgataaaacaatgttggaaccaaaataccttgcaaatatattcagattgtagctaagaaatagaggcaccctagaggatcccaaactaaaagcagttgcatttgcatgggtaaaaagtgcaatttcatgttagaatgtcatatcagtacttcccccagactggcttagctcaacactgagaggactgcttcagctcatgatttctcctgtgccacagaaagtgagattggagtgtgtatctggcttcctggcctctggcctctcagagaaccctctgttgggtcagttcctatattgcctcatactgtgtactgacgcacctgtagaacttcgttcccagggatgcgtaggagcaaagaaatgaggagggcaactccttacagttagagctgccttgcaagattaggaatggggcagaactgaggttattcttagatgagggaggaaagggaatgaagggggccttattctcagcatttcagagttccctctgtgaagccagtttccatttcaccttgtactgagccttgtgcgaccattagaacttggttctgagggatagttagcaaaaactaaaaggagcaggcatccctttgcagctggcactgctctgtataataagaaaaaaacatagaaccgagccttttccttgagaaggcaaggaaagaagtgtaaagggccttgcccccagtcttagattgtgctccccaaggtgtatgtctctatcttgtctcatattaagcaccatgaactggtaaaggtctctactcatcaaaactcatctgtagagactgggaaaggtagctgctacttcaaatatacagatcacaaagaaaatctacaaggaacacaaagagtcatctccaataaccatcctgaaagaaacagagatccctgaattaactgacaaagaatgcaaaataaatgtcttaaagaagcccagtgagttacaagagaacactgagagatagctaaataaaattaggaaaaagatacaagaacaaaatgagaagttaaataaagagatagagactattaaaaagaacccaatagaattactgaagctggagaatacaaaaattgaactgaaagattcactagaggagttcaaaagcagacctaatcaagcagaagaaagaaacagtgaacataaagacagatcatttgaaattatgtagtcaggagcacaaagaaaaaacaaggatgaaaagtgaggaaagcctaagtgacttatgggactcaaacaagtgaatcaataaacacattagggaattctggggagaagagagggaaaggggtagaaagcctatttaaagaaataatggtaaggaacttcccaaatcaggggagagaaatcaacatccagattcatgaagtccaaagagctccaaagatctacaccaagacccattataatccaattgtcaaaagtcaaagacagaattttgagagaaacaagagcgaagcaactcatcacattcaaaggagtccccataagactgtcagcaaatttctcagcagaatcctcacaggcaaagagagagtaagatgacatattcaaagtactgaagatcaaaaaacaacaacaacctgtcaaccaagaacgctatactcagaaaagccatccttcaataataaagaagaggtaaagactttcctagacaaacatgcagaggggtgttcaccatcactgtacctgctttgcatgaaatgctacagaaagttctttaagctgaaatgaaaggatgttgattagcagcatgaaaagatgaaagtataaaacttgccaataaagtcaagtatatagtcaaatactagagacctctagtactctaatgatagtgtgtaaatcactttcaactctggtataaacattaaaagacaaaactataaaagtaatgacatgatttgttaatggatacacagtataaaaagacgtaaattgtgacaccaataacatgaagtgtgtatataggagaagtaaaagagtagagattttgtatgtgatcaaatttaagttgctatcagcttaaaatagatgattataagttgttttatggaagcctcatggtaaatacaagaaaaacacctgtagtagatatataaaacataaagagaaaggaatcaaagcatattgctacaaaagataatcaaatcacaaaaaaagacagcaacagagggacaaaggaactacaaaacaaccagacaataatttaaaaatggcagtaataagttctcacctattaataattaagtgtaaatggattagcttccccaatcaaaagatacaaactggctgaagagattaagaggaagactatccatatgctgttaaaacagcaacaacaacaacaacaaaaaacaacaacaacacactttagctttagggacaaacatagactcaaagtaaaaggtgggaaaaatatattccaagcaaacgataaccaaaagctagtaagagtggctattcttatatcatacaaaatagactttcagccaaaaattgtcacaagagacagagagaaggtcattatataacaagaaagtgattaattcattaaaatgatataataatccccttgattaggatccttttgattggaatcctcttgactggagtagaacaaaaactgaataattgtaaactattattatgaagtagagatctccaatacactactttttatttttccaaagctttcctggagatcacagagaactgaacatggagaaaaagtgagcaagagacagcagtaggctttatgccttaaatggctgtatagcttgttaaagattattgtttgtgtattaaaaaaacatgattctagaaacataattggggtttcacagatcaaattcaaattattaacttagtatttcagcctccattacttgctctatcttgcttaggcatcctaggttccagtacttcccaacaagtgttctgtggtgtatgcagactatgttagtgtttccctttattttggtatttccacaggagacctaattttaaattttctgttctatcatctccatgatttcttaaattatgtctagacttctggattagaatattattcatgtacttactatgattcaataaacatcttctatgtgtgagacagtaggaataagatacaaataagacttatttcctatcttcaaagaataaaggaattcacaatacagtggccacttaaatatataacatgtgttcctgcttttaagcttttattctttctataattagagtatcctatcattattttattgattgaattcctttaattatcttatagtccagcttatgttctgcttcttccataaattaatttttactttttatagcccacactgtttccttttccccccactattacagtggaagtggacactattccctaaccaaacttcattccctcattcttcctagccgcagacctctattttgtgcagagtgtcaatgtgctcagtgctggatgatgagttttgaaatttataagccaattatgacaagtgtattctctaatttgcttgcttctctagcaaagaagggtggcctagggattcagttatagccaataagatctatgtggcaatccacttgagaggcaagtttctgagaaagctttttttttccgttacaaagaggaaggtaaaaggcaatccttctgtttcctcctccttccctctttgaacatagacatgatgcttggagttgtggcagctattttgtgatcataaagtgacaagcatgaaagaaagacaaaaagaatcccagagatatcagcacagactttatcatataccaggaatttcctacctctcaacttctggacttcctgttaggtgagaaaactgaatctctatttgtttaagccacttaagtcaggatttgctacctgctgctgaacacatttctaaccaaagtaataatagtaacattcataatttgaattcaccaaactgttcttcctaactagataacagacattggtcacattcttggcacttcataaacattcatttgcttcacatcttgattaaatatgctagacttttatatgtaatgaaattctcacacagaaaggaaggggggaatttggattagtatcagaaaagaggatgaaaccaggtcaaaaaaggaaaatttgattctataataaaaaattatatgacaaaaatttgttacaatgtagctcaattattatatacaataaaagcaaatttttaaatattttccaaaattaatagcaacatattttaagaaataagacagtagaataagcccccaaatgataaatgttttaaaggagagatgatataaacaagtcttctattaaatgtgaagacaataccatgcagttctactgaaacctaagtgaggaaccagcgtttgtcaaataccaccagcaataagactttttctctgtcctttaggttgtatgactgtgattcaccccaatgctacaggctccttagcatgctcattatttctaaaatctttcacctgaggtttgaacccatgacttaggaaactattatcgcatttgcttttggagaaaagactacataagttgggacagaagctattttcaaggcttccaaatattacaagtaagtagtggggaactgttgagaagagaaatgagtagctttgggtcattttaggttagtgaccttaaacataaggtgtgatttaatcagaagccagagtaattatggcaggaggtggggaaaaagactcagagctgtctggagttagggaggactttggtggcagctttcagcttgagctaaaactgcaggattctgtcagaggctccacaaacaaagggctgcattatgtaaggaatcttgtatttctttgtgaactagtccacaacaaaatttcattagtttttttttttttctctcctagagatttttttttaccacttccagcccgtaacttgttgctcagaagggaaactttctaccttaaataaaagtttaaattgtaagcaaactgacatttttttaggaacaaatcaaattaatttgaactttataataactgggaaaatgctttttaagttaggtggatgataagtaatcttatatgaagaatttccaaataatttagcaatagttggcaataatttagcaatagttagcaatacgagttcatatctctctccctctctgtctctatcattttctgatagtctgtttacacatgtaacacttttgggtcacctttcaatggagcatttcataggcagaattggaagatagcaagacacatggatggcacatagcaataggttctcataaatattatctgttttcaaaagaatatttatttttttgcccattataaagatattctaagattaattacagtcctaatactgtcaaatttagctttgatatacaaaaatctattttttagtagtttaatttttttttatcaattactaacttgaggctttcattttacaacattattttggtcagttataaaaataatttaactgccaaatgggttttcccatttgacatttcaaatgttggtttaatacttatcacttagacctctatgaaggttgactcaggtttactgggggatattgcatagatcatgtcttttggtccaacagtttgggctgtgaatagtctaaatttgcatggaagctcccaactaccaagctatccaaaaactacagggacagggcggggtgaatgattctcagcaggtggcactcttccttctaattaggtcttgaatgaatgcaccagcattctgctatctcttgggtggagtgtgagactgaatcattcaataatgcttatagcgcttaagaaccaaattcaagggaactgtggaatgaaggcaagttataggtaacatacaaggattttcattctgctggactttttcattcaaaacagcatcattctcagactcagaattatggataaccatgcctctcagtctactcaggagagtttccagtttcagttccaatggcccagtcacaattattagtagtgttcattttcactttcaaaagtgtcctagtttggatgataaaatatggggttaccctgtatataagctttaaaaaagttagtcataacaccatttacagtgataatcattctatttaggacaaattaaagtagactctattggccaacttctataaagagaaagagataaactaaaacattattaatttaatctcagagctttaatcagaaaaagtttattttaagatgacaacaaaatttctatgaattatttaggatttctaattttaggtcatttttttttagccttattttatacaagcaagcacgtatgcccttaagatttgtggtggagaaagaagtacaatatctgaaataaagttctttgaagcttaggtttgaattctaattctactatttactcggtgtgcaaatttaaataatttctgtgaacattattattaaccctttctaaaatatgtttaaaaacattttaaaaaccagaagggaaagaactacatatgctgtgaaaagctgtaagttattaacagttactattatttctctttataaataatgatagtttttccctttcaacttctatgacacttttacagactgtagaaaaatttggccaagcatgttgtagcaagggtccttaactgtaatcacctttgacacagatccatgatatttctgggtgacatctctacatggacattgatggcctgcaaagatctagaaaagaaagactatagatcttgtacaccaaggccaaagactaaaaggctgaaatttaaagtacaaaagtattgtgaacagttttgttagtagtataatatataccacttatatagataatttttcttatatagatataagaataatttttcttatatagatataaaatagggtttcttatatagataatttttccatggaaggaaggggaaacgaggcgaaaagtggctggagtagaaagactagtttgtaaggcagaaagattttctaattactaggtagattttattttattttacttgtttttactagctaaattttaaaaaagagattcctagatctctatagacatgttcctctttctttttgctgatattttcctatttcttttctgaaatcttaatttgactagaaaaaaaatgatgttctgatttaattctcttagtctacctgacatcaaaaagtatatggagggtgtctttagttttttatttatatgaatgtaatcaaataattttattttttaaaaaaagactctcactgtttttcattgtttaacagacatttctttaaaactttgaagtaattatagaaaatgttctcataaattttccctccaaattaaccaggtagaaagggctaatcctgttatgcatgccatttttgtttgtttaaattgactattctgagaattaagtctgtagtacctagtttgaggcctcaagattttcaggtatgcacaaggttctatcaactaattctttgtctcactgatgatcctttattttaaatatactctacttgcaaaggtggtagggtaaaaagaggagtggctgacaagagactaaagaggggaaaggattcccaacatccttaatatctcagggctgaaaaagagcattagaaatcttctccaatctcttggagaaaaaatatctttcacacactctgtctattagaacttcatttgtgtttaacaagcccctcttttaaaatgcaaatttgccttgtgaacctgtaaacctcattcacaccttattgttaattactttgatgttctagaatatgatcaacacttaactgatattggcaatctaggaatgaacaaattgctcagggtgaaaaaaggaaaattttgttggagtggggctgtaggtggtagtgtgagaatttcatttgtgagaaatagagcatactgatattctgaagttttgtctaggagaatggcagtagttacggtaccacaaaacgagcacttttcccgactgccgatgtctagttgagatcagaaaaagcctggaagcctgcaaacctaagttttaaatatttagccatagcaagctaatcaagcttgcaattttctgaaaacgttttaagttaattcataatagctctacaactcggtgaccttgggttctaagactcatttggttcaaccttccaggtttaaaattcaaccaataaatgaattccaaggaaaaaaagtgaatatggcccagtccttttttactgtctccctagtcattcacttcagagattttggaatgcaatcctagaacatactgtaagcaatttcagaagaatacacaggatgcagtatttctctatgtgtcttagtaaatgtcacttgacccgatatatcaaaaaggttgcaaaatttgaattagactttagttgacttaagctacacatcttagcttggcagaaattcaaggaaaaaaatattttatggcctcttgtaacattattaatcacccctccttttatataaaaaataaatatgctaaactcttcactgttcagaaaaggggtcatttttcctgccaaaatggctaattttagtttttatgtagttggatacatttgtaaactattacatgaaaacatatggttggaacatgcttactccttcatgagtgttccccttttgaggctgcaaaattttccttagttgctccatgtgctactttgttgtgctgatgacttcttgttctaaataattttcttcattttccattgttaatgaaatgagttctaataaggaacaaagaaaccctctgatgaaaatccctttcttgtagaatggactgggaactgatataggacacaggggaacagcaaatgctgtgttgcacattcttcaattaaatgatccctttgtagtttattcacctgaatgcattttggcaaagagtgaagcaatagtgggaaaaggattgtttgtgtggctaatctttggttactcagaaagtactagacatgttttcctgcatgtttgattgatttcctgcacagtttgattggtgaatcaacactttaaggtatctaacccataaggaagagtgaaaaacttccccagaggtattgaaatttcactaaacctcttcttggagttttggtgtatgattctcagttgatctttgagtgtaacagtcaactattaaattggcatgactgaagtacagttttttcaaatagaagagtattttagaacaaatgagaattctaactctttaactgaatttctaactttacattttgcccgtacctctccttgtaacattcttccctttttccctatatatttttaccagtaatcctttcaactgctccttaacagtgagattctactgttctggcacattataggttctctttaactattttttgagtgcacaaatgaccatttggacaaatattataaaatgaacaataaaaaaccttaattatgcaaattaataagtctatacctttgggaaaaaagccatgatagtaacaaaatgaataacaattccaaggatatttaggaaggataaagcctagaagattaaaaatgagaaattttagaatcataaaaaacaaaacgaaataaaatagctcaataccattgaaagcacatgtatgcagaaagaagctaatatattattgtaaaaaattaaatggaaagaaattagaaatctattggtattattacatcaaaagcaggaagttctttctttctggtccaactttagagagaagaacaaatttgccagtgccaccaagggcagaatagagagagatgtttggaatttaagagttacaggttatgttatggttcatttatatcattgccatcactgcagttcattcattttgtgtctaattattgatgttgccacggttgtcaataaacgctcagcattactaatcatcagagaaacgcaagtcaaaaccacaatgaaataccatcttataccagtcagaatggctgttgttaaaaaatcaaagaacaacaggtgctgcatgattgtggaggagagggaatgcttacacattgttggtgggaatgtaaactagtcctacctattaggtactgtgctcattaccataggaattagggtgggattcctattccaaacctcagcatcacacaatattcctatggactaaatctgcatatgcaccctctgtatctaaaataaaagttgaaattttaataaagatggaactaatccctcatatcacagaattatgtagttgtgggtagtcaggataaagaatatttaggatataatttaaatgaattcactagctctgaaaatgaaagaataaacagaaaactaatctagacattaaatttttttctttccctaaggataatgtatagtccctaaggataatgaatattcaaggacatactgtaataaatcatatacatttattattaatataatatagtttattgcacacacacactatgagctccacgatgttcgttgaactattacaaagtttaaagacatacgaaattacagtaagagccatccatataaaaataaaatgttagtgtttggaaggaccaattgtaggagactatattggcgagttaatacaaaagatcatcttttgtttaagagttcatatatttttgtgtaaattatatctatttacagaaattttctttactaccaactgttctcaaacccattcactaataaataattactatatgtgattacttaatatttacctcaaacctttatgaatatcactgaaagcattactggcaaattaattatataggcaaatggtgaggatctctcaacctcacctctcaccttcttcccaatcactcgaagactgactatatcaatttgtcttgttatccagaaattggctttatttgttaattccagagatgcttcaactgtagtttcagccagctgtttccttacatctttctgggtggcatcagtttacaatgcatagcattgttgagggtcaaagttattttattttggtattactattggatttttcccccagtgcctcaaaggggaatgttgagtcatggagatgtaatgtgactccttaaactaagtagacttctaatacaagtatacttttattatggagaaaccaaattaattttatcaattaaatgagaatttatttaccatttgcctttaccagatatttcattagacacaattctcagactttacacaattacaaagaatgttgtataaaaactatctataaagcaggagatatttcattcttagttttttgccaaacaaattatgttgcttcgaggaacagagggaaaagaaacattgatgaaacacagccctcaactatggcataaagtccaaagcacagagaaggtcagaaaagaataaagcagttttgcagaattattatgatagggagtactgataaagaagagtcaactttttggccttagtcatttactgagttcctttattaaaaatagagcataaacattttagaaataattttttctcaatctttttttataaaacctctacagaaaaaagaagcgttatgtgaaaagcagctaaatgggaggaaagtaggggtctgtgggtgaaacaggaggttaccattgcaaaccctgtccttgatgccctcactcagtaggactggtggatggaagaagtttgaaaaacttttatgtagagatgaagaaaagtagaagccctagtttacagagaacgaaagatacatttttcttctgtgtaggtagagtttgtatttggagaaggaggagactcctttcttctgatgaaaactccttcttccaagagaaaactccattaggaaaaatggagcagcagtgagtgagagagaccaggtttaagatttgttttggaggttaaatttgttgtggaagttgacagaatgtggtgaaagcaagacacatcataaaataagccaaaaaaaatctctctcttccagctcattgtatattggagagttagttgacttttctactgtaaatgtaaagaaaacaaaagtttcattcatcctcctgtaatgatgccaatctaatttgctattaaatttctattcaaaagccctattttgtttagttacaagggatttgatccccttaaactttcccaggcaatttgtatggaaaggcggttgctaagggtattcctaagggaactggcaaacgttggaagataaataacctcagtacaatatgcagattaagtagaagggatggtttaagagttaccttttgaaggaaaaataaaagattcagaattcagggctagagttgctagttaatcactgatttgaaggtacttaatcaaggcagttttattttattttattttatttatttatttttttttagacagagtcttgctctgttgcccaggctggagtgcagtggcgcgatcttggctaactgcaagctctgcctcccgggttcatgccattctcctgcctcagcctcccgagtagctgggaccacaggcacctgccaccacgcccagctaattttttgtatttttagtagagactggctttcatcgtgttaaccaggatggtctcgatctcctgaccttgtaatccacccgccttggcctcccaaaatgctgggattacaggcgtgagccaccaagcccggccaaggcagttttatacttctcaagaaagtagaactttcacattgttcctcttgggaataaaggtaaaattatcatagagaggaaattagagagaaatgttcaccatttccttccttatattcttcctttctttcctctctctatctctagagctcttcctcaaagattcaaataaccaaaaatatgaagccatgggtggcagcttggagttctcaaaagtccaaagtgaggttagcttctgaccaaaacttttggcaatttccttaggttgagtgaaagaagcaatgtgaaaaagcatgagtttagagtcagtcagccatcaatttaaaatcaaactccactatttattattggtgtgatcttgaatacattagccaacctctttatagtccagtcatttctaaagaggtgattatctatgaaacctgtattacatatacaatgtgtaagtactcagtaaatactcagtacttctctagtatctctctaattggatttggctagtaatcatgacaattgtgggagagaaaaaaaaagatatgtaatcctgagggcactcagtctctgtaacaatcacttgataaataatcaggtgatacttcgttgacatctctttaatcttccaattgagaaaacattaggagtagaagaaaaatgattaatctccaacttctgtcattggaaaataactaaagatcagaactataagaaacataaaacttttctagattattaaagttaaccttttagacattttccacaatcacatggtatgcaaattttaactaaattattttacattaaatgtattttgtgctatgttttgactagttgattttactgtagtatagaatgtattatgacattccattatcctcttattactcatcaataaaaaatttattgagaaaacaattaattataattaatatttattattcattactagtaggcattgtagtaattacactattattggtattttaaatatcattaatagctataaacatgttatacataataataatagaaaccatttgtggagtgcttactgtgtaatacattttgctaagcattttatatacattcttaaaattaataatttcaaagatttaatgagctaagtgtcaccagataaacgagaagacataataatctttatttattaaaggaaaacttgccatatccacacaatcttccaaagcactgatagaacagaatgatggcatgatggcatcttaaatttagaaagtgtcattcataaaagtgtactgttaactactaatttgtgctatctgcaataataatattatattacacaagatggaaaggctaccccctaaaagatagcatttgataaattgtacataaaaatctagaagaataagagtataacagaggagtgaaatttgatctgaaatacagagaaaattaagaaaaacaaaacatgttagccctactggaatttgtctcaatgtatttcaaggttcaaagtatagcagaggaagatcattgacactgtcagaggattatcattaaatttcaacccaaaggcaactaactcaaactatgcagatatggaaagtagtgtttcctaaaatgaaactaaggcaaatattatttattctagcttctactcttttgactaatcagctgacccagaaattaaatatttaaaggcttaaaaataatatagttttaagaagttgacctatacgttactaaataaaatgatcctcgttgtatttgaagtagctcaccatttaaaaatttaatctatgtccacccattttctttcttcccaaataatacaatgatttaattaccccacagtttaatttgacagaggagccaaaaagatacactattccttcattgttaactttaaggagaaaaatacactataaactatattagaaatcttattttttgggtgtccaccacaatgttttcactacaaaatcccttgctgcctgaatacaaaatgttaccattcaatcagatgagtctccatgaagttagaaacattcaagtgaaactcataaaataaagaagatatactctaaaaattccagttcttgagaagctgtttacacacaaaagggctattaaaagtgaaagggtaagtagaaaatcttctgggctcatttaataaaagaatgtagagttccatgggattcttttctaaagaaaccactaacaatgttgcagatctacaaatcctaaaagagtgcataatggactcaagtctctgctttgtgactcatgggtgtacttcatcaggatgtacttcctcttttagggggtcatataggtgaataagctgacaacaccttcagagagagaaattccacatgtgtcataggaatagaatttatttgatctcaagctttctatatatagaaaaaaaacaaattctaatccaaactttaatgaattcagtattgttgttgttggtttgcctctagaatgtctcttttgaccaagtcacattcctttaaatttacactaggtaaattatatattttccaaatcttttataaaagcataagctaaatgagataacattaaaaggctgattggagatttccctttaaaagcagtcataagaacaacagcaataataatataacaacaatatacactacattttgggcaccatgctttgaatttatatacactaatattattaaggcaatctgtgcttttgagaagctactccagactaggcactacacaaactctgccacacacaagagagaaacaatttcaattacaaagagagctagaaaataaaatggataagagtatcatgaaagattttttgtaaaactgaatagatcctttcatgtttctcagttttaatctctccaaatatccctattgtctgctttttaaaagaaaaaacactgtaaaaattctgaaaaaattattcacaaagaaaacttccactcgtttatataaagcattattattaacttcataacatgcataatatcatctatttctgaaagaccattgaaaagtagccataaaaacttaaaaaattgaaaataatctttagagatcaacaggccaggaagagttctaagaatatgcattggcctttactaaccattttcaatgccatgcacttttgtctgtcaatactttctcctgttatttttaatatccctagattaagaaatattaacatctatttacaaaaaaatattctaacagtttcccccacaaaagcatattcccatgaagatcaagaaaacaaaaaacatagcagggagtcagtattctgacagccttttagtcttcttcatcttcttcctactattattattagacctactgcctattaccagtaggctttttaaaggtcttggacataaatatcagttgttaagttgctattttcatggtcatttaaaattatttcaaccataaatgcttttaatttcctgaatatcttaaagctgtctaagtataaatattctcccattatattcctctgtgctaacacaataatctagttggagtcaagtttcatgaaaataagaaaattggtacattataacattttaaacactgaaaaataaacgtgatagctgtaggatgtaaagtgtagtcaggcctgtagaacttcggatgcatcattttacaatatcatttatcattttgataaaactgaggtcaagtttctaaaaatacaacttgttaaaagcaggaataaatgaatgagagatgagtcagctcgtttgatggaaagggtttaaaaaatacttcaaaagcataccacatgacttggtaaatattcagtgtatcaaaatgtagttgccatctggcattgatagactgggctagaatatgtgtttaaaaagaacaagaaaggaaataactcagccaggttaatgtgcacttgtctacatttcataattcaggtattaagtgctttaataaatattcactatgaaagaaaggctgcattacaatcagacttgggcagtatttgttggggacagctagaaagaaatgaaagaagacaagacctgatggcacttaagaaagctaaaaacaacaataaaaaagtggtttaggtaaacagaattctcaatcatatgtaatattgccagaacactagtatcacagttaaatgcagggaagtggtaagcttatatttgaaaataaactgaaatcttgcttattttcagctttgaatattttaattattcttttctttggctttgacaatttaaaagtatagagaaatccagggaataagtaaaacccttggttggatagtaaaaaaaaaaaaaaaaaaaaaaggaaaaacgaaaaagtcctgacattctttgaagttttaaacctagagtttgatattaactttgcaatatgcaacaaaacaaaaagtaaatttgaaggactcctcttttctccctcttgctcaagaaataaaatatatttagaaagcagtatcattcacaaaagagaaaagtgaacacgagcagtgaacacttgcccaagcgttcgactgtccaaggctgtatctgggcttgttaattagatatttctgtctttaaccttgaacattctccagatttccaaatcttgacaatttacattctaccacatctcttggaatcagagcaataggcagaagagaaaagttttaaaacagctttgaaggttaattaggacagggaccagggtagccattaggaaaatagatgaagcacttcaggtgagagttgattagggtcaacatgaaatttttcagagttgaggtataatttatattcagcaaaattcatggacttcaaaatgtacacagaatgagttttgattttgataaatttatacacctatgtataaatatgtatatataaaaatgtatatatttaccaccataacagagacatagaaagttcctttgtgcccccttccagttaatttctatctcccataaacaaccagcattctgatttttatcacgatagaatagtttcgccttcacataacttatgtatactcttgtgtcctggctcttctgcataccatgtttctggaattcatctacattgttgtatcatactctgttttgttttatttgcttgttagtatttcattatatgaatataccacaatttgtatatccactttccacatttgggtgcttccagttttaggcaattacaaataaagtcagtataaacttgcctgtacaaatctttttgagggcattattttcattattttttggtaaataactaggaatgtaattaccaaacaatatggtaggcatatgcttaaccttagaagatactgatccaatgttccaaagtagaactatatatttacagaaagtcttgaaattaggtaatgtgagtctttcaactttattctttttctaagttttctgcaatctcatatacattttaaaataaatttgacaatttatcttaatgttagaaaaacaagatgttgatattttgatggtgattgcattgaatctacagataatttggggaaaaatgacactttagaaatactgagtattcatctataaataacggatttttctctaaggccttttaaaattttgagtggggaatcttacattcttttgttaaacttttatttaaatgtcttatatttataggctactgtaaattgattttaaaacttcattttcaaattatttgccggtactacataaatgcaatcaatttttgtatattgatcttgtgaccttcctaaatgcactgttagctctattagttgttttgtatatcccctaagagtttctaatgtaaacaatcatggtatttgtgaataaacacaatgttacttcttcctttcctatgcttatacctttaatttattttactcgtcttattgctctggctaggatctttagaacaacgctgaacagaagtagtaagaatatatatctttgccttctactatatcccaggaggaaagcattcagattttatcattaaggacggtattaattatatgttttcatagaggcccttcatcagattgaggaagtttcaatctgttctaattttctgagagttttcactgtgaatgactgtcaaattttttcaattgctttttctgcatctattgagatcatatttttcttctttattaggatgcatttacagtgatttattttcaaacgttaaactaaagttgcttttctgagataaatcctacttgatcatgaggtattatactttttactttttattgttgaagtttgtttgctaatattttgttaaagattattgtgcctagaaccatgaggaatattggcctatacttttattttcctgtaatatctgtcaggttttgctgttgggattatgcctgtctcataaatcaggaagtgttttgtttttacctcctatgttttctgaaagagtccgtgtaggattaatattatttcctccttaaatgttatatagaattctccagggaaactatctaaacctgaagttctttttttaggaatgcttttgacgacaaattcaatttctttaatcaataaaggaatattttgatttctttggtttactatgccagttttgttaatatgtttttaaataaatttacctattttatcaaagttgttgaaattattgacatgaagttttcataatattcccttgttatcctttaatattgttatgatatgtaatgataatctctcattactgatattcataatttgtatcatctcttttttcttgaacttttctgttatagcttataaattctgttaatcttttcaaatattcatgttttgctttcattaatcttctttgtagtttgtttttatttcacagttttctgcctttgttatttgttttctttttttactgcttttgggtttaaaatgattatactttcccactttcttaaagtggaaacctacgctattgatcttaaacctttcttcttccttctaatttaggattaaaagctcaaaatttctgctaagcttctctctggctcatattataaatgtcaatatattgtattttcatttaatcagtttcataaatttcaatatactgcataacttaatttaattattttaaaatttcatgactttcaaccatgaggtattaagtttgttgtgtagtttccaactggtcttttctagatattttattgttttctttttttatttctaatttaattaattataaacaagaagcatattttgtagtatctcaatcttttgaaaatgtttgaaactcatttgatgaaccagattagggtctactttaataaataaagtagaacatacatacaggactctattcctgtatgttttaaatatgttttaaagaacacatattctccaggtgggaatagaacacattctccaagtgggaatagtgttctgtaaacatcaaacaggtcaaggcagttgatggtgtttttaatttcttgtgtattcttactgattttctgcctatttgttctatcaagttctagaacaagaatgttaaaatctccaattgttattgtagattttactatttctctctagttttctgtcagtttgtgtctacatgtttatgacttatgcattcatgataatttcacacatatgattaggaaatatccctccttatctctaatagtactccttggcataaagtctattctttgtaatattaatattccaacctagctttctcatgcttattgtttgcattgtatatatctttctatcttttcactctcaagatatccatgttattacatttaaagtgtattcctgtagacagcatatgttgactcttgcctttttattcagcctaatactctctcttttaattgtagtatttataccatttacagtgaatggaattattgctacaattaagtttaggtctaccatttatttcattatatgcttttgatttttttcttttgggtttttgtcattgttattcttctgttttcctttcctttttttttttttttttttttgagacggagtctcgctttgtcgcccaggccagactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccttcctttccttttttaatgagttaaactgatcaattatttttccattcaattgcacaactggctttttagctgtaccttttttgttattttttagcagttgttctaaggattacaatatgcctctttaattatcactgtttacacagagttaatattttaccactttatgcaaatgtgagtatcttataagtataatttcatttactgccacccagtactttgtagtatttttacatacttcatatctgcaagtactatagactcatgagaaaatactataatttatgcattagtcagtttttcttttaaagaaattaaaagaataaaaggatattcttttacatgtaaatagatactttaaaatttttagtgaaaattttctgtaaaaacaagtttctatcttggttcatagtgtcatttcccttcaccctgaagcactcactgcctttcacactacttataggaattccactgacaacagaaaattcatttcttcattattgcaagatcacattgctctacataaaattctggttttgcagttgtttttcttttcaatcattaagaaatggcattacatttagtatgaggaatgagtcgatgtttgattattcccctgtaggtgatctattgtttccacccttagggctgcctttgagatttttctttgtatctttggtgtacagaagtttgaatacagtgcctacatgtgattttctttgcatatttttgtgttttttctcagcaaattttggacattttcagctatgatttcctcaaatatcatttctgtcccattttctcatctgccacccacaatctgctgttaagattctccaacaaatcattttttatttcagattctgtactttaacctttggttctttttagtaatttcatttcttttttcttcttctgagacatgcaaagtatagtggactggttgatattgttgtacagatcactctgcacatttttgaatcctttttctctctgttctttacattaataatttctattgacctgtattcaagtttactgacactttcttctgccatctacaatctattgttaagccacttcaatgactcttcaaaaaaatttcaggtattataccttaactttttacttatttttgaaaattttcatttctctgcttattttctcatctgttccctcattatgactatatatatacatatatttttagagacagggtctcactctgttgcccaggctagagtgcagtggagcaatctcggctcactgcaacctccacctcctgggttcaagctatctattctcatgcctcagccttctgagtagctgggattataagcatacgccaccacatctggtggattataggcgtgagctaccgcaccgggcctgaaaacatatttttttaaaatcctgaatatatttataatttctgctttaaagtccttgtctacaacttctgaatcatcgaggaatctatttccatggactttaaaaaaaaattacatgtcacatttttctgtatccatcactggtaatttttgaattacagttgaacattgtgcatgatatttatacaaactctgggtttggttatctttctctaatgcaatgcatttttcttctagcaggttattaaattactagtcgaccactttgatttgaagaggactggttttattatttgacagaaactttcaatgcttcaggtttgtctctctttctataattaatttcttagttcttagctatcatctatatttctaaggtttgatccttctgggattcataaagcctgagacatttaccaaacccttctaactttgtaaactcaaactcctaactttgtctcctcttcatctaatgtatctgttcagctcttttagctttctagttgttgcttttctccaggcacttataggctcccacatacatgcacagtttatatcagccagaatgttagggtaacttatatgtagattcatgggagccttccctcgatggctccatcctttctaatacttccttcctcaatttcagctactttgccaatgccagctccattcgctaacatcacaaaccaataagattgtggttttctgcctgaattctaacttctctataccatacagactgggaagttccttgagggaagaagctgtaacaaacgtgaattttacccgggacagttcactccagattccaactgcttttggtcactctccggtgccttcaaataattgtggtgttttttttttaagtttttaattggagtttagttttatttttaacccataccatggtttggaactgttatctgtggaaatatttgtcctgaaacagtacaagttactcctttattaccaaaatcacaactaccaaaattgtggttttatgttagatagcacttgaactgatatggaaaactgcattagaatcaaagtgtctatagggcttcctctctcaatattcagtattttaaaattgagacaagactattttttaaccttaaaaaaatcactcatagtgccctaggaaagtgctatatattccactcagtcgctaaatatggccaatgaatatttctataattaaatttagcagaataatctgtgaataaaatgaaacagacctgtatgtaaagaaaactaccttaatgaacttgcttgggagatcagtggtatgtgatatttctaatcatgacagagaagttgaacatgtggtacagttgtgtagggaaaatggataactcttatcttcattattttttaagtcattctaagagaagcatttgctaagtagtttatatatatgaacttatataattttcataacaatttttaaaaatagtattgtaacattattttgtagatcacaaaactacaaagtatcccaggccatcagactccagagttaaattccaaccattccctctaactacctgctcagaattgagataaaactcatccacagcagtcatcattttttctaagaatatacatcacctattaatgttctttcccatctcccatgttaacaactttcttcctctatcatgtaaacttgctctctatcatctccgtgcctttcttgttcattttcatggagcagccataaaatggagaataacaattgaagcagtgaatagccaagaagcatctctcaatcaatgaacctgagacagcctgttcacttctgtccatcattcttgtcctttagatctcagtttcaaattcatttcttctagacattcatctcttcccatgtttaatctggaaccatctacccttccaccagaccaattatcctggcaaattaatgtaatagaccagtattaattatttgcttgtatgtcttaacaacattctaggtgctgtgccaaaaacaaatgaatagcaacacaaggtcttctggttacaagcacattacattttggttggggagattttgacccatctcacagtcataatcttcatccaggttatctcgtcaacctctatgtatgcatatattccaatattttgttttgcttttctttcttccttgtagtaatttcacacagactattcgcttcaagaacctaactaacttcctgttggtacccaatcctttaactctagagggtcaaatggagccctgtggctcctggcagtgttcctgaagatcaggtccctctggtggaactcagttctcactgccttatctaaccttcctcactcagcttgtaatcaacttaacttttaaagtctttgtacacattaggtaatatttgttctctgaactcccagaggggctgtggtaactgcccaactaggaagccctacccttcattattcagcaacagcttgaagaatattctaattctaactttccgccctctgacagaccagctgcatcaaaggctgtgttcccctgtttgtttttttcctgaagcagagtcaccatttcaaactaagtaatctatgagaaaagtaagagctctgggtccaaatgtttaaaacatggctcttctgtgaaccacggcaaatctaaactggattatgccttatgctggagtcagaacttacttggtcccttgttctttgccctctggctccctgcatgctgttcaggggaagttactggcttttgaactggcggtttgaaaacgaaggcatttttcttttagggagaacagtctttcagtgatttaaacaacaagccttgtgatcaaaataattcataaaggaaaagatttatgaagtgacttcactagcacacaatgcattttaaaaactttgttttttaaataaatctgtcagtacagaagccaagacaacacatctgaatgcaatatcagtggacacaccctgaatctcttcttctttgcttgtccaagactgtggtagaaaagggaaatgattctctttgtcttttcttatttaatattattattaaaaattttttaaaaattctagttccatgaaaagactttgaaaaattgtgcctacttttgtttcctgcaggaaaacctgccttgtaaaaatgtattttccattgaccacttgtgcttgtttaagaaaataaaaaataaataaagaactccaacttataatgaatacctctggcattagggagcctgttctaatctccctttatcaagtttgagtgatagttctgctcaacgagtattgacagggccgtcctgtttctcaggctttcgtttccctcggttggagaaggatacagtgcattttcacattctcaaagtctgcagttgtttttatataagaagcaatttgcttgggtcacgtcaggtcgaatgggatgcctgcccagctcttggttttaaaggaaaaacatacagaaagacacaaaaacacagcagtttccttcattaaattccactctacctgccatgggcttctagccacaatggaatttcccaccctggcctagcctagcctaacttttatttttagggattttttttcccctttaaatcttatgagctttctttcaagtgaactttgaggtaaggattattaaatgatagagtaattgcctggttaaaaaagaatcagacataaaaaacaaatgcctagtgaccttccataatatcgctggataaccaccccctggataacagcctttcaaaaactgttcataatcagcacaacaagacaggtcatgtaatttaaaattaaaacctgaatcatttaatgaatagggatcagcatttttttcaatagtaccctcttcttacctaattgcattggatgaagataattttggagaagaaaatgaataaatgaaaacacaaggaactagataaatagatggggcgggtggatggggggtggagagagagacagcaagtgagagagagaagcttttggacctctctctccaaaaagccatttatgcttttccccattgcctaggggcaactgatttaatcaggattgttcatgtggattatctaaactatgaaaagcaacagggagcacttcccaagaaatccagactgggtgtgctgcagaatacttggtttggggcctggagctaagtagactgttcacattgtactcagggtcctaagaaaagtggctcagtgtctctgtaattctttgtccctttgatctacctcaacatttggtgtctcttggcattaggaaagctcacgaaaatgaccctgcctagttaacagattcatagtctgggcacacaaaaaaagggtaagaaagaaaaaaagctttggtaatgagggagagaaacgtaccttcttgctatctttgctgggcataaataaaaatcgaaagatgtgatttttggagatgtgaatcccgttcttcccatatttagtaatagccttttcagagccaattcaagaccttctatcaaccacctctgttaaacatatcaagttagatttctcattcattattttcaagctggattttgcataatcttccttcaaatgaagaagtttacttttcgaacatgtcatttgctcttagcactgttgttctccttcacccattttggcttcttatcctcaaatccctgattccttattaaagtggattgttaatgcagccattctttagcaccacagcacatttataaatcaaaaattagtttactctgcctggcttccaaaaccatttgctgcttgaaaccatttcatgagtttgtctactcatgtgaataaataaaaacttgcctataatgtgactttgggaaaggaaagagcaactatatgaaacgaattctacagaggccaaaattattttcacgagtttcatggattcagcccttgcatgtgccattctacattaactttatctctgagattaggattttgcttctctttttttttttaattatactttaagttttaggctacatgtgcacattgtgcaggttagttacatatgtatacatgtgccatgctggtgcactgcacccactaactcgtcatctagccttaggtatatctcccaatgctatccctcccccctccccccaccccaccacagtccccagagtgtggtattccccttcatgtgtccatgtgatctcattgttcaattcccacctatgagtgagaatatacggtgtttggttttttgttcttgcgatagtttactgagaatgatgatttccaatttcatccatgtccctacaaaggatacgaactcatcattttttatggctgcatagtattccatggtgtatatatgccacattttcttaatccagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactcacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccatgagtaggttgtgaaaattttctcccatgttgtaggttgcctgttcactctgatggtagtttcttttgctgtgcagaagctctttagtttaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacacaattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactatgcttcataagtgaaggagaaataaaatactttacagacaagcaaatgctgagagattttgtcaccaccaagcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaatccacacataacaatattaactttaaatgtaaatggactaaattctccaattaaaagacacagactggcaagttggataaagagtcaagacccatcagtgtgctatattcaggaaacccatctcacgtgcagagacacacataggctcaaaataaaaggatggaggaagatctaccaagcaaatggaaaactaaaaaaggcaggggttgcaatcctagtctctgataaaacagactttaaaccaacaaagatcaaaagagataaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacaggattttgcttcttaagtagatgtcatttttctccagtaaaaccaagtggtttaccctgacatttagtagtaatttagtgatttcagagttccttctaaatctaaagtaaatgttcatgagactcatgaacttgtatctagacaattaatctgagcattttaagacttccctgaggctacatataatctctcacaaccccttgcaaaacctgagattttgaaccactgtcaagtttgtggttgccctggtaaggagtaaagcaaaatcattacttatggcaactaccacacaaacattgtagtgaactgaagtataagaaaatcactactatactttagacagaacattaggattaatgctggtaaccaaggaactaagagcctgtaaatataactggcttaagaaggagaacaggattaaacaatattggagtttagaaacaaaagtagtactgtatcaacctgtcactatgcagccagtcattacaataaaactaaccaaaggatggcggcagaaagaaataaaagtatttttgtgtacaattcttcttgaagcactacttgaattgcatctgtagggaacaggtctcataggtctattatttgcccacctccccaacacacacacacacacacacacacgtactagcctaggccgatatctactgtggtaagtttgcatctgtgagccactgagcagctgctttatatatgcagcataggatgaaagagagaaaactggggtactcatggtttttgtgtaatatcacaaagaaaagaaaacaaaaaaaggcttagagaaagttaaaggaaaatgggcagtggtacatatacagaacaagttaggattccctaggaactggtaataggactaaacttgcttaacatctatcaaaatgacttacttattccagggtcttgcatatacatagcagaagcacaattaatttttgctgaatgaataatctggaacaaggaatgtaaaataaattatccaaaaatgttgatggaatgaaacttttctgagcaaggaaaagctaaactgatggaacacaatatttatccaggtgtgcagaaaggtgccagtgcaaatagagaaaaacaaaatattcaaatacagtcgtttgccgtgtaatgacattttggtcaacaatgaaccacatatatctataccatggtggtcccatagattataatactgtatttttgctgtaccttttctatgtttagatatgtttacatatgtaaatacttaccatctactctgttacaattgcctacagtattcagttcagtaacatactgtacaggtttataaggtttatggcctaggagcaataagttatactatatagcctatatgttagtagtatataccatctaggtttgtttaagtacactctatgatgtttccacaatgatgaaattgcctaaggatgcatttctcagattgtatccccatcatcaagtgatgcatgtctagtttaattataagtcttacctaggaaagggacttaaaggctatgagctctttcaggcaaaaaggccttcaaaattttggcactcattaagtaaagtaatgaaaataaggtttataattcccttatattaaaccctctgcaattatgtgaaactatctgtacttcaaatgccatgttcctataacataacaactcagggtgtcttacacaggacagtcattaaagagtttaaggtagattaaaataatctgcattagtagagaacaaattattttgcggtattataacaattcattgaacatgagaaaaagcaaacaaacacgcttgttaataaatgttacttaacagacatcacactgacatttcttagtgactgactgccatggaagctttctaataagtctaatttttcccacgctctgagtttataagatagcaatattgtagctttgggtgtttacctttgtttatttattgggcggagttttattgcgtgcctcctccagctgtgccaatctggtaagatcaaatggaatcctttagctattgtcactatcctaaatggaccgcatgcttcctttgtcccttgcattctctgattttcgctgggggttatctatcatggctgtacatccaagtctctaatctatctcctttctcatccgtttttcctgacttatttcccttttccctttgtctatttccctgtgagaagccaaaagactgtatagttcttagtagcggtagtagtgctatctagagttggcatccaacagcaccagtgttataatacactttctacaatcaagaaatgatttgatttccttgcctcagtagaaattttacaagttaacagtggttcacctgatataaaccataatatttctatcatatcatgaaagaattctaaaaaatctgttagactttcttctacaagtttgcctatttcctctgaatacagttaattcacctggcaacaaaggagattagctatttctttttgtatgcagacagaaagaagtgtgatctttctttgccaataaaaacttctagtaagtggtgatagacttcaaaacccttctttttatttgaaaatcatggttcagttatcaggaattccaaattcagaatctaagaacagtgatcctatatagtcttgtgattttgcacatgctagggattggtaagttgctgaagacttcttaaataagagaggaagcatttttcttttcacttgcaaagaaccaggaggtacattaaaagaggttttagagtaactagaatgtgtgataaactgttcactttctgttttaaaactgtccatgaggttccctttagagataggacagactacagagaacgtggtgtctcgtttctatgggttgaaattccacagaacaatgctttgcaaagagtcataccaccagttccttttcctgtgagatgcaaatactaaaaacagatatgggctggacaagattattttaaaaatagatagaaggcaataaaagctttggtgatattctagattacatatgaaatgtgtaaaagcgtaaaatgaaaagttctctactttttaaaagctgcatcaaaatttccttcctacactgtaatcgtgccccttaacccatctatgcctgaggttgcaatttctttgaatttctgcaatcagaccatggcgatgaccttgagcagtaggatataaataactcctccatgcttagcgttccaataatggaacactaggcataaatgggataaaacacaaattgctaggttcatgataaacagagcacatctgtaaacaaaataacttttaaaaaatatgcctacatatataattttattacttctagaaacacaagtgttattagacttaaagagagccagtgaattgaatcaacttattctgatatgaacctcaatgtgatctgattgcaggctgcaatgattaacacgttttaaaagaaatgggtccatactatactttccaactgcccacccttctgttcttcttatgctacagatttatggcagcctaacctccagccaacaagttagagaattgggtaagacatcattttggctttttaagaaaattatggataatcaaaaaacatgacacaaaagatttagtggctattatcagggtataaactaataactaaaggcatttatgtgttaggtaataatgatgcttagaaaattataaatatcaagatgctctttcaacaactatattccagatttaggaattttgtagaggatatggcataagagtgttaagaaatgtatacttttttgaaaataaaataaagtctgatttatttattatccaagttcctgtgttttctgggaaaaatgtattaatgagaggtagcattatttgatagttaatggagagtggaaatcatctgttacaggcccacatgctcacaagcaaaataatattctctcaatcctcaaatggaaatggggattataaaatgctataagactctgtcaacatttctgataaattccatgaaaattttgtgttacatattttaaaaattgtgtactatgattataacatagttgattattaaatatgtaatcctttctttcagattattcttcttccttaaatgtaaagggtatattattttcttgatttattcttttggataaatatcctgtacatagatgtctgaaatccagcccgtcagtttccctttaaattctagcatattttaaaggaccttaaaagatgactgtggagtactgcctgatttggaacttgcctctgtctcttacacactgtatgacgttgggcaagccacttaacttctcagtacttcagtttcatcatcagtcagaacagcacaataatagtaccctgctcctatggttactatgaggattagtgggtttcatactgtcaataataagttgcctttctgggtctttgaagtacttgaaatcaggttaattaaattaagcagagctttggtccctttgtttgacaagtaatctccaattttcatttccaggttctgatcccctaaaatcagtggaataaaaccttgtttgtgtaactgccatcttcctgccccaaagccaagattaatttacctgttggttttagttttcactaggtctctctttagctaggtgcttctaagggtaaaatatcaactattaaactatttgaggcaggagatgttgaaaggggaatttaattgttaagtcaatagcagtgtgccagcttagtctgcctttcagaaagatcaccatagtaataacgagaccaataaataaataaaaagtataaaatatacatctatgcagaatcttagaaccctttctctaacacataagtcattaaaggaagctctgaggtctgcctatgtgattcaacatttacacacatcatagttctatggaagaaattctcagttgagagctaccagctttcttcagatcggatcagatttttctatactccattataaacaacaaaaacaaaagcaaacaagtgaacaacaacaacaaaactgtagttgtggttcactccagtaatatatactaccaattcagtggttcttaactgggggacaattttgccacccccttccccaccaggggagaactggcaacatctggagacaattttgataatccaaactgaggggtgctccaatggggagaggtcagaaataccactaaacatcctacagtgcacagaacagacatctaccctgcatcccggcaaagaattatctactccaaagtatcatagtgccactgttgaaaaaccctgtgctaaactaacatctgagagccactggccttaaaccatcagccacatcaacacgtaagacactcagcctatgggatagtctaacagttaaagaagacaccttagagggaactacttcaaaaatatataaactgacaaatctggataccatactaaggaaaaaactggtaaaacaggtagttgtttgaaagcttcttatgcccattattataaaccaataattttagattactgaaccaaccagactaatattccctttgaattccaggaggtataaaaatatgaagtcatcgactatgcaacattatcctgctatggagacattctgaaatggtttataaaagcagtgaacacattaaaaaaaaaaaaactagcccaaatgagttatgcaaagttaaagtcattttttctaggaccagttttttttcctgtgcatagtattttccatatgtaccgcaaacattcatttgtgcagaacatagcaccacatttctaatacaactcctctctgaagacaaatcaggctaaagctaagagttgcagaaccatttctgtatgagtcatttttagcacaacataagccctagagtaaaatttattttctaaataagccacaattattctgcaaacatttaacctagcacctctcaactgttaaagaatgtcaattatatatgaaaggaagaacaaatataaaggaaatttgaaaatcaagaaaattttttctgagaaaagtttgtgagaattattatgaatacagctaaaattcaaatatgtgacattttatttttttaagggtttccctgtcaaagacaacacatatttttctaatgaaagaggatgcctgaagttgacattcataagagcatttggatactaccaatgtgaagttgtacagatttactcatttctgcaattaccctcttgtgtttgaattctactttggttagtggtagcaagcactaaactgtactgagggcttcgcaaaagttgactttatttctttacacttagaaccccaaaaatttacttcctaggaagatactagggaatcatatcttactgaggaggaaataagaggtggaataactggattagcctcacaaagaatgaaagctcagtaatttctgagttggcaatatttttcaccctccttttctccatttaaatttctagatttaccttcaaaacacttgcctttttctaccttaagggaagttctaggatcagggagatggagatagagaaggtagagatagttttaggttttcacagaagttcaattaaaaactgccaagtacctcctaccaagagaccaccactaaaatttatttctagaacaaggtgcagaaaaataaaaggtagaaagcaggaatgttctggtactgtaaaatatttggggaaaaagtctaatttctgttctcaaaatggttactatcttgctctagagaaaaacataaaccctcttaaaataactgaagaacaataagaaacagtataattaagtgtaaaaatgggtggtagaagcaaaatgctgtggggcacccatgtgtcttacatctttccaacacagagaaaagagacaatgggtcaaatgcagcctactctagtctctgatattagtttcattacacagctataatcccattacaaagaacttgaaggaactgttgacattttttgctgccctggagtttattgtctcaagtattgcttgaaataccagggtacatgcagagatgtctgctctaatggtatttgttgacctacattatgttagggttagcctgaataaatggagaggaacgctacatggaatcagttagttagattgtttgtaagtaggcgtgcattatttttaccatgttttattatttttaacctaaagactacgcatttaaagtagggtattatctgtaagtaatcttgttgttatatgaaacagtaatatttattaaaagtgcttttgtaaagcccaaaaaggggatctgcagaggcagatttactgcatatttaatggagcttaaacctcagggaccttcacttgcgcagccccccttccaaggtcctgtacttaactctgtaatcataattttgtattctttttcttcaagaggaccccccaaatagtttaagcttctggtaaaatcttgatctagcctaggtataaaataatcttgaagggatccaaactgatagttctaaaaggctgatgctgagaaagatacaaaatgtgcttttacaaggatatcatatcaattatattttccaaatgtatctctcttattgttgtcgctcccccttccctgccaataaataaatgccattttttttttttacctcactgttaaaaggttattagacccttttaaataagatcggtctgttcagtgactgggaataaccagagtgttaaaaaaaagatgaaaaattcagaggcagaagataatttccaagaatgaaaagatatcttagagagactcacaaaatgtttcactaaaacagcaataattattatccatacctaaggagtacatgcatttgagaaaaggaagggcatggaaagtctctcaatacaatttacagtagtacctactgaaaactgtgctgagtttacacagagtgtgggaatttttaccaccagtaacaccacgtgtctgtttttctggtttctgaaaaccccaaataaatcccacaagcgcctctaaactccaccatggaattctcacacttctgagtaagaagttcagaacagaataaaaactttggatgcagtatgtctgtctatagtttttcctataatgccttgtcccagtttttgaagaaaactgaataaaaattaattcaagaaaaaaaatgaatgaaattacctcaaatggaatattaaattgaaaaataatagtcaaattgctcataaccacttcctgttaattttttttctcttttagaaatggagtaagaatgcttcaaataaaaaacgtaaaacccatcccatcccataaagggcccactcacgtaaacaggaagcttattaaaagaacttttcttggtttcctggcaaaatccagcttttattttggtggcagcatctattaaggaggagactcattttgtgggcaggatgaaaaattaaacattgcaaatccatcaggtacttgctggattagagttagttgactgacttgttggctacagggaacaaggtagttctgaaaccaaggaacaagctgccaaggaacagtccagccctgcccaaaagatgatggtcttctccatccaggcagcacaaatcaactcgaggttccaagagggccagtagacgccagcctaccttactgtaaagtgtctcacatgcatatctaactgttctctcctttcctttacatttaaatcctgttgtattggcttctctgttttccctttcctggaagcgctgtagcgtaattaaaagagtatgagttttggaatttcaaaacttggtttatagtccagcctctgccaaatactgtgacatgttacctgcttgagccatcattttctgatatgtagattgggactaacaattcttccttaatcagctcaagtttcacaaaatatgggtaaacatcacgtgactcaaaatcaactgaggcaaaaattcagatgtcaatggccctttcttgacttattagaacctccatgagctagaaattcttggaatctgaattttaaactcactcccaagtgatttccatacacacagaagtttgagaaccacatcccaccttgtcttgtgtcaggattaaataaaaccatataggtgaaacttatctgtaaattgcatatcaagacatgcttagctgctctcaatagtatcattttccagatagcccaaagcaccaaagtaaggacagcgggccattttcccaagatctttcttccagcttttccctgccatgccaacagcattcttcatcttcaggtaggcagggcaggttcactgggggttggggtagagctcagcactgtgacacaggcagtacttccgtagaatttcatttatgtgactgtacctaccccacagggtgatataaggattaattcctatttggtaatttactgtgtgtaaaatgccttgagccccttggaggaaagtgctatataaatgtaaaataattattataataataataacctcgactatttaactgatcagtgaattagccagaagatttaggctgccaagggacaaggctgaaaccattataagtagaaacactttacatcatcatatctcaaactgttatcacgaaaaagggaaacaaagggtgaaaattaagataaatccatgttctcaactgatttaaatgacagaggatcactagtaatgattcatgaaagccaggaaatgcaaaaatgacagctgcattgtaattctaactcagccacatgtcctgaggttttgtacactttggtcttttatttgtagggaaaatatctcatcagtgcaacatctaaaatttagcattatgaaggcacttgactatgcttttgcttagttgaaatacgttcataatgtatcccctatttgtaggtaatgatttttctacctaaaaagcattgacattattctatgaagttccaggtaaattttgaatcggttgcttacaatctgcctccccacatacacaccctaagaatacactctaacaaaacaatggtgtatttctagatctaaatttaggaaaccaaaatatatagaagataccttttcttcccaggaagaaaatgctttggtatataaactcacatgagctcaaccgtcttcagctcttacattatttgttttatttatttattagattcatgaagattcttctaccaaaagctcaaggggctgaacccagaactttcatatattgaatgtgaatcacttcttaaaccacagaaaggaaaataaagggctatagaaatcttaatgggcaagctccagatgctcaaaagcaattgtttagttactctacttagttatgcatcattcaaaacactttctaacaatcgggcaagaaaggttcctttgtgaagaacaggctttggggtcttggacaagttttaattctagttgttttatagctcatacaaaatagttgtggtgcatatgtaaagaggtactgtacttacatgcaataaagtttgcagatgaatattttgaaaatcaaagaaaagaaaacaaggggaggaatgagcatgtggtaccttgctctatttttaattattaacttgtagcctcaaagatttccatttagtagaaacacatgtaaactacaatgaaggagtactagaaaataaagtcaattggtataactcaaattattttgtaaaatgtgaaattaagctttaacctgtctatgtggaagggtgatgaataaatgaatgaatgaagtaaaaaatcaaagatacagagttgtaactgattttctttgcatgaagtagtaaatattaatattagaaatatcttttgatttagataaaactggccttgggtatataatacacaacactgaaaaacatttcaaatgtggtatttgtttaaatatatacatacataaacacacacatacacacacaagtcaaaaatatgggtgttctggtatagttttctgccttcaaagggtctctggaaaaaacagaagaaaaggtatcctataaactgcttttgctgaggtctctagtagagagcaaatcgaggcaagtgctgcccaaaataatctctattacaaacatttaaaaaatctatctttcatatatatatatgaatatatattatatatattatatatatacacaatatttttaatttttaattttattttatttgctgtatagctaacagcatagccaatgccctgatcttctagccacactgtaatttcttgtccttgcatcacaaccccagctgtagtcatcaaagtggaaaaactgacagcattgtctgaaagacacagcttgggaaaattgctccttgtagctcccctgtcaatgaatattatcatatttttctcatggataaggttactgtgttttttttgctgggccgggggtggggaggcttctacatacttagctactaagcacattaccattccgtttgtggaatggactaaacgtgacaatgcgagctgtagggttagcattcccaacattctgttttaaagtttttgtgtgtatatcttcaaaaataatattcctttatgtattcagaagaagtaaaatcacaattatattttacttgacattactattttcttaaggaggctaacagaaaaatcaatgggtgggcataaagagaaagaaatcatatgaggctaccacacatattctgttactgaatttctttcacctaaatatacaatggaatgctctgaattgtatgttttcttttcccatcatattaaactaaagcaaagttcttgggctgaaagtagaaaaactgcactttagtgttctaatgatccacacctttcacatattcacttcgcttacaattctagatgctaactcaataagaaagaaagaaacaaattcagagtatttcagtcaccaacaacaacagcagtaacaataacaataatattaatatcagttaatatttatttaactcttagatatactagatgccattgtaatcacatgtattaactcgctaaatcttcacaactctaccagagagtactgttattactccgattttattggtgaggaaatagaggcacagagagatcagaaacttgcccaagatcacacagtcagtaagtagaggagtcaggattcaaacctaggaagccagactctgttacaggatgaatattttggttgctaaaggccccatcttccttacttctcctgatcctcttccccaactgatcagcttgcagcattcatttgatcttctcaacaaattacgtattcatttgcacaccgtccatttagaataacacagtagttaaaaacttaggctctggagtctaatatgagggtttactgccacatattggtagtgcttaacttttctgtgcctcagtttccttctgtataaagtagtaataataaaagcaatttcatgtatttgttgtgagggttaaatgagataatgtatgttggagctcaatggaaggtcaatgttctataaacattaagttcattattattgatttttatctcttaataaatagaatccctttttccaattagattgtttttcagaaaaattgtgaatatgaatcttttttgtctcgtgtaggggttcccaaatgttcagtatgttgaactcttagatgtcctaggtactactgaaatcacgtgtattaacattcataacaactctgtcaggtaatacttacatttacccataatattataaatgatataatataccaatgtctaaaatttagtgagaacttactcactggacaagtgcattatggcattatctcattctccctctaagcctctgaactaggggatttttttttttttttttttttggagatggagtgtcactctgtcgccaggctggagtgcagtggcacgatctgggctcactgcaatgtccgactccctggttcaagcgattctcctgcctcagcctcctgagtagctgggattacaggtgtgcaacaccacgcccagctaatttttgtatctttagtagagacggggtttcaccctgttggccaggatggtcttgatctcctgacctcgtgatgcctgcctcggcctcccaaagtgctgggattacaggtgtgagccactgtgcccagccaactaggggatttttataatctcaagtttatgcaggaggaaacagaagctcacctcggtcatcagctggtaaatgttcacaaatgtaaattcttaaccacaatgccatactacctgctaaaaaatgaatttaaggtagatctttagtaaatatatttggtcttgatgatgaatcaattgaattctttatttctgttaccagaaaccttgcacttaacaataaactaatgtggccttgaccagcagccgccagtccccaggcttcagacactggtacctgttaggaacttagctgtacgggaggagatgaacagtggacaagcaagcattactgcctgagctctgcctactgtcagatcagcagcagcattagattctcattggagcacaaaccctactgtgaactgtgtatgcgagggattgagtctgcacactccttatgagaatctaatgcctgatgatctgaggtggaacagtttcatcctgaaaccatccccacacctccagtccatggaaacattgtcttccatgaaactggtccctggtggcaaaaacgttggtggctgctggcccagacaatatcactcattctgttaactattgaaaagagatgactgtatgtcaggtacatgccaaatactggaaatttgaaaaatatatatatatacattgtgggtctaaaactgtatcattaaaagcagctaatgatttaatatcatttcatttactatcattttctgtttactcttacaaaaatcaaacttcttcctctccccttcctctctctgcctactctttcttattccttcttttaaatcaaagttttacagtattaaccttacaaagatttttgcccataagaaggttatatgttaaggcaaggaactgttttaattatatttactcttcattttgagtatatttctttttcatacctgacaaagacttttgaaatgactaaagaaaggcaaagcaatctgattctttataaaaaaatctttcatatgcaatcttttgtctgtagtattctcataatagcttagaaattttaaaagaaggttttagctggttttgttcttttcaaattggcagaatttgatttttttcctcttcacatttggattcactttaaaaatcaacaaacaagaaaataaaaacatattcaatttaaaaaatatgctctccattggtgccttggcatcatcaaccaatatcagcatcactctgaaaaccatttctattctgtttttaaaaaaaagagttttaaaatgcacacataaaatgcacttaaaattgatcctactgtattaaggagagagaaaatttaagggcaatggagagctttgctgtaaccaactcttcagtcaactataggatattgttaatactgccttcacctccacactgaagatataggtaccattttgactgtgcttttgaacaatatatagctaaagatttgaagtgagtaacttcaaagtcagtagttttcatgtatacgtcgcagaatcactgcatcttatgtatgactttaagttgtattaagctgataatttcaaaaagagagactttcaatgaaagaaaattcctgaaatttggtcattaaatggttcgagtacgtagaattacttacaatgtaatgccaaagaaaggtatattgtatttatccagaaagcacgagcataagaatgacctcagaaagttattataatttattacttcattaaagatacatttctagtccatctattatgtgctaggccttataatagacaacaaaaatgcaaagaacaacaaatgtgatctgaaaagtagtaaaggttagggaagatgggactagtaagagagaacagaagtaagaaaataaagtgattataattgtaactgccatgagctgagggcatatcatgcattgaggtaaggtcctaggtgcttaatatgaacaagccctgcaagacaggtatcataatctttgtctcacaggtggtgttgggaaaactggctagtcatatgcagaaaaatgaaactggaccccttccttacaccttatacaaaaattaattcaagatggattaaagacttaaatgtaagacctaaaaccataaaaaccctagaagaaaacctaggcaataccattcaggacacaggcatgggcaaagacttcatgactaaaacaccaaaggcaatggcaacaaaaacccaaaattgacaaatgggatctaattaaactaaagagctcctgcacagcaaaagaaactatcatcagagtaaacaggcaacctacaaaatgggagaaaatgtttgccatctatccatgtgacaaagggctaatatctagaatctacaaggaacttaaacaaatttacaagaataaaacaaataaccccatcaaaaagtgggcaaagatatgaacagacacgtctcaaaagaagataattatgcggccaaaaaacatatgaaaaaaacctcatcatcactggtcaatagagaaatgcaaatcaaaatcacaataagatactatctcacgccagttagaatggcaatcattaaaaagtcaggaaacaacagatgctggaaaggatggggagaaataggaatgcttttacactgtttgtgggaatgtaaatatagttcaatgattgtggaagatagtgtggtgattcctcaaggatctagaatcagaaataccatttgacccagcaatcccattactgggtatatacccaaaaaaattataaatcattctactataaagactcatgcacacatatgtttattgcagcactattcacaatgtcaaaaacttggaaccgacccaaatgcccatcaatgattgactggataaagaaaatgtagcacatatacacatggaatactatgcagccataaaaaaggatgacatcatgtcccttgcagggacatggatgaagctggaaaccatcattctcagcaaactaacacaggaacagaaaaccaaacaccacatgttctcactcatacatgggagctgaacaatgagaatacatgaacacagcgaggggaacattacacaccagggcctatctgggggtctacggctaggggagggatagcattaggacaaatacctaatgtagatgttgggttgatgggtgcagcaaaccaccatggcatgtgtatacctatgtaataaacctgtatattctgcacatgtaccccagaacttaaagtataacttaaaagtttttttaaaaaatatgtgataaaataaaaaaaagaattaaccacagtgccttgcctattcttctataacagtatctatttcactctattttattttgaagctatttatctccaagtttctttctagaatctaaacagttaacagcctgagggcattgaccttgactcttgtctaagttttacaaacaaacaaaccaaaaagcacactgcattgatatacttggccaagtaatgatgtccaaatgctacaatgtcacaaccagtgctcagtaactattagataaataagatagagtcattcactcaatcattcactcctgcatgtttcacttagtaatcttgtacgctcattgaataaattaaaagctgctttatgaaaatgttttctgttaatttgaataaaaacctttacacatcaactagatacaaaagagaaatctattgtttgacaatgatcgttactgaatcaaaaaacagtggggccatctgcagggtacagatcatgctagagtcagggaaaactggtgataaacttcagaaagccaagaaatataccagcttacaacttagcagcactgcctccacacagtcttcaggtatttattgactgtctcacactaatgcatgagtgcctgtggtaatggtaaaagtatataaatttacttgcccagagatactaattgttaaaacaaatacaacaatttaatggcaatgcaagagaagacagactaacatttacaaagctatttcttgtttaggcaagatagtagactctaaacatatattatctcatttaaattatcatttaaaaacccttagattgttagtatttacccattttaattaaaaacataactgagcgtataatttttttttttttttttttgagacggagtctcactccgtaacccagattgcagtgcagtggtgcgatcttggctcactgcaacctccgtctcccgggtttaagcgatccttctgccttagcctccaaagtagctgggactattaggcgtgtgccaccacgcccggttaatttttgtattgttagtagagttggggttttgccatgttggctaggctggtctcaaactcctgacttcaggtgatccacctcccttggcctcccaaagtgctgggattacaggcgtgagccaccacgcccagcctgtaaatcttgacaaaattcccagaggcaaaattattagaaggctgggagccaggattaaaaaacataaaatccttggcttttccatttatttcacattgcctcttcttagaatccacttctacaccaaagcagttaaaatcaatgtggatttgtattttaatagagggtttatggagtagtgggaaagatagcaaataataactatgtttattgaatactactgttcctaacattttgaacctatccaatcatttaatcctacaacaatcttttggaagtgagtgctattattattattgccactttgtaacagagaaactaagccaaaaagaagataaacatttgaaaagtcataaagctagttagccgctgtgcagctgaacttgacagcctatagcccacagagtttaaccatcatgctatattgcttcattaggttgaaaggttattaaatgaaatggcttaaacaaagttctaagcacatggcatggcacagagtaggtcttcattaaatgttagtttctgttttttctttaatctctaaaattctataataataatacctttattttcaaagtaattctgctttttaaagactttatgacatctgatttaaatttcacaaaaaaaggatggtgaatgtggaataaatcttcacaaaaatgacactgaagattatttaaaggcatagaatgttactcacaacacagatttaagagacaaaagtagaaacagtgttcacagtgttttaccaaaaacaaaaagggtatatatgcacaggaaaaaaaatgattagaaaggtatatccccaaagtttgaaaacaaattacttctagacgattgtggggattttaatcgtcctcttgtaatttatgctacgcacagaattctacaatgccttttgtatgctttctatactaagaaaaaataaaaaagaagagtagtactccttttttgagatcataatactgaggggggagaaaatcagtagaaatgtgtgagatttcaccctcagtgatagagctggaatagaattcgcactcttcatctctaacctactgtgttttatctgacccttattttctattcagtgcttaccataattgatgaattcaaaactaatctatgatgaaaacccctgaaagtgattagagagactgtgattgtaaatgtggtatcaatcactaacacaaaagtcccttataactcatcaggcttcttaagttgtttattcaaaccatttgtttctgagtccaaaccaataatatatgtgatagaccggattactttctctaattcttcactccctctctataatagaactttacatccataaactttaccatatgacttgaatgtaactctcagtagagtatgtgttaatgtgggagatgggatatatatctctgtctcttggctttgagcttggttaagtgacttgctttgactaatgaaatattagtaaacatgaaatgagcagagactttaggtattttctgcgggaacaaattctgtagttgtcaatagtttattctcctagattaaatgtttgataaacttttctaaaagaaggaatttttttttcagagagaaatatagctaacatggaatatcatgtccttttgtacttacctggagccaaagtaaactacttggaaaattaaggtaccttttgctggactattcctcatcctttagtttcttcagtccagactgggacattttggttaaaaaggagtaggcttgtgatgttaaggtgatcatcttggtcaccataccccagaaaaaatctttacatatccatgtcttagacactgaggtacagaaagagagttctgaactttccattccattgtcatttgtgttgtggagtcttattaatctgtctcatggaaggtgggaatcaggctatgaatggacaataattcatggggggcagtcaacagtagagaagaagttgctgcaaattgattaatacaaacaaaccaacctgagtacctggctcattttaggttccctccaaaggcttcagtacaggcagtaacttagaaggtaatctcagagggtaagataataataaggattgacaataataaggattggccaggatctctgagatttacacaaaatggctccagaggtagacattataaagaaatagaggctagaacatctctttttccagctctattcctcctttagttgagagtttccccagggcattaagccctgggggcttaatgtaagccccactctccccatcctagattttttgagatctcccagcattggaaaaggtcctggggcagaaggaaaagcatacttgaggtgggagtctgggttagcagagaacggcttcaggtgcagctgaagggaccatgacagcactgcctgacatctctgagggactatgacaggattctgacagccatatctgctacagaagcctgtaaagacttggggtggggggcagtggtgtataatatactgtgtagtctgatattgcatcctttaaagtatgatctggggaaggttaggctgcatcttctttattaaattatattccaaacaagttgtctcctctgactcctgcatgaagtcagactttgggacagtaaatcctacactgtccagctaagaaaaatgacatgttgttaataggcttaactgattctcttgctatgatggcaagatcagatttttagcagtgcttctgaaaatcctgacactcattcaccaattattttcttctaggagtctaatatgtattcatcttcccatatttcagggaagaaatagttgaacgactttagggagcttttcccaaaatgctgacgcatttttgcagcattttgccataatggggcctattgaaaatttttctgacattctgaattcatagcattaagatttgtggtgttgtttttgtatctggtttgtatttatttttgtttttattaaaatacaggagaaattgggacaggttaagagttgcacctaaatgtatgaagcttgaggtctttgaacataaatgagttagatatacagaaagttattaagacctttaagcattcgtaaacatttcatcattgctgacaatatctatttactttaggtaaccctgcctgagcagctcctgcattgctacaaggatgaaggtggggttatttaaaaatttaccaagctgtgaaagagttttctggagaaaactggtttggggactcagagcataaggataaacaatggatacttttatggttacaggagaggagttgataaacccctcattcctctaatgtaatgtataaaagaaaatattgtattcctggtcctcacaaatggggaggtggtagggtaggtaggttatatgaacacacatgtcttccctttgacaatgagtgggcaggcctttaaaaaaaagtctgaaaaaataaagagccctggggaccatttaggctctatcagtgagttctatcctgagatatcaaatccagttgcacagaatctaaatgtcaatatttacaaagctctttccatcttatatcccgcttcctttttcttttatgctctttctaccccttttccttcctccctattcccttgatcccctacatcattctgttttcccatttgctctcatttcctaacaacccccatccccattagtcagtccaaaatctgttcatcccgctataggcttcagtgatggaaaagaaagggccccaaacaaagccaccatccaagacaaggagctccagagggtggtgaattggtgattgaggtaaagcctggggactgagaatgttcaccgctctggaggttcttagcccgaaaagtgattaggcatcagcaggcttgatagctgtatcaagcctcatgatttcaaagctttcatgagctgacaaggacttgctaatttcaaactttctaaccaattacaatcacaaagaactcaggacaacaatcagtgagcaaaatgaaactgctggagtgaagcagccctcggcaggtttcactcttgtagctctgctacgcaatgtgcagctgggactctgcttcaataagtaaataaaaatacattataaaatacaaacatacacaatggatcccacttgctgtcttgttcccagtaaaggggtatgtaggaacgctgtcttgcattcattcagtccattaatttctgatggtgttaattaaaaacttttgatgctggtttgaatggaaaatacctcaaacagtgtttcctttattgaaacaccaagttccaagtcttggattattaggttaagctctgtcagtagtgagaccaacataaatgcttttcataccgtatgctttgacaaaagagaatagtaataataataaataaataaatgaaaaggaagaagaaataaagtgtttagactgaaaactcctttacttcaccaacctgtttttttaaggactaaactaaaaatccaggtccctgaatgtagaacatataattttaaaaaaatcttttttcaaatctttatagaacattcaaatcacccaatgttccaggacctgaattttttatattttaaaatgaagaaagctgcttaaaataagtgaatcagctgctaagtgatttctctctgtcttttcctctactctctctttaaaaagactggaaaatgcttaaaatggtatatgcaattgatatgtgcagcttaaggagcttaatataattactgaggactcagactttctatttaaaaataagatagggtagggtaacagaaactctgagtggtgagtattcatcccttgtgatggtgaggtgtgggaaatgtttccaaatgtttaatccactgagcaaggtaaagagtgcgaagcagttattcacagaatttggtgtccttctgaaaacctagggaagcctaggaaatccagagaacaactgaggaggatagtatgagagatgctgtgcaggaaacaagcaaataaaatatccatttcttcaatccaatgcttttgtgaagtattaagccaaccaccaaaacattctgattgatttttaagactcttctctaattttattttttaattactcttccctttgtgtattggggtctgaagccttgggcacccattctgagaggtcttgtaaatgtgtctcacatatgcccgtttctcttttgttttctaatatacctttctctatcatttttcatttcccaacctgtttattcacactgtctgcaatgtcatctgaatcctcgaaaaaccacaagactttctctttattccccctgaaggccttcatcactcttgttcttgttttgatctacatatctctaacgagaatgaagttctccataaaggctaagcagtttggcagaacttccttccttccctccctaaccgcaggctgtattgacctcaccctcttggatcagtttgctaaaatggcctccaaactttatgtgatatgatagtgaaccttcaacaacaacaacagcaataacaacaacaacaacaagagcaacaggataacttcagtgtaaggcatgtgagaaaaatacgcagagtaatagaactaaaactccatgagggaaatgggcctgagcaaaccacagcatgggtctttttgttaacaaaatgtatgatttttccccagagtacattgatagaggacatagcctacaaaggaccagtaaatgtaaattaactaacagatatgtagcaaatgaatgcatttaaagatgatttccagctgaaatgtttttttttttttttttctggagaccaagtttttgttaaacttaatccttactctctttcctttccagcagcagaaacatctggtcggttttagattccccttggatttccaacttcaaagggaattataaagaataacaaattcatgtaccggcactaaaaaaaaattagagcagcaggagagaatggtaaaattgtccttatttgactgctagtgacaggcgccacaggcagaactatgagaaaagacaaaggcaagatcaccagttgacaaccagagttcctgcaagagactgaatctttggctacatgcaaatatgcacagggcccttaacaatccatagggagatttacttgcttaaggaaaataaataggtaaataaataaaaggagttgaaaggtaaaaaaaaaaaaaaaaagaaagaaagaaatgagttcatgtttgcctgtcacatagtttgttgaaataataacaaataaaccaataaatgtttattgaaagaatgacctggaaataattttaaagatccacttaaccccttgggttttatttgatttaaagaaaattgtgagagttctgattctacaaagggctggataagtcatccaagaaataatacaggctcttaagagtccactaaacttggatctccaaagttcttaaaagtagtttctgtttctcctttggctccagatccttattatcaaaagatgtgacgagaaatcaaagtcttcttagtggccgggcgcggtgtctcacatctgtaatcccagtactttgggaggccaaggcaggtggatcacttgaggccaggagtttgagacaagcctggacaacatggtgaaaccctgtctctactaaaaatacaaaaattagctgggtatgatggcgcgcatctgtaatcccagctacttgggaggctaaggcacaagaatcacttgaaccggggggacggaggttgcagtgagccaagattgcaccactgcaatccagcctgggtgacaaaatgagactccatctcaaaacaacaacaaaacaacaacaacaaaaaaccaaactaactgttcagtacatgctcagtacttgggtgatgggatcatacataccccaaacctcagcatcacacaatatacccaggtaacaagcctgcacatgtatcctctgaatctaaaataaaagttgaaaaaaaaaaaaaagaaatttgtaactgtgtcaagttgtgtttgacaccactttatagaaatggatttattcttctcctctatcattttcttagcaaaactgaaacacacttctagagtgcaggtcttgatataatcagacatgagaaaatgagaacagttagagaaaatacaattttgccattgtaattacctcttacaaacagcctttcctctttcctgttttatgtgcaatgtgtacagcaacaacaataaaaataaacaaagacatgattaaccgatcaatttgtttctccaaagagagaaatagttaagggctaaagtgcctttcaataattaattataagagtctttaaacttagtattgagaggttacagatttccataccacaaatacattaggttgattcacagagtggccatcaaatacccagaaagcaaattacttttgaccgaaatgtatacatcaacagtacggttaggaatgttttcatagaggaggacagaacatacataaccagttctctatggagcctagcatagtgtcccatggaccaatccacataagataagaccatctacagagcatattcttcatatcacagactctaggtaagaagaaagtattctctaggtaagaggagaaaaataagtgaagatttctttcgttaacacttccaccatgaaaggaatgagctgactacagaaccattttcttgaatatttttgtcttgagtggggtttttatccttccttcaccactctaggtagagcagaatcaccaaagttctctcattacggtaatgtcataaatcccatcctatagcagttgtgcatgatcctgtgttatgcatccaataaagtttattcagaaaatatgtcagcttcattaaacagggatctgatgatctgaacaaaccacttatcttgcttttgtgacatgtattggtatccttaggtctaaaatgaaaatcttggttggtgggggtatctgccaaggattccctgcctcatgtaagcagaatcatctaaccacaattctgagcttaactgggggaaaggaggtggaaggtgtatcgtactagttcgttctaagaaatgtcttatagcttgaggatacgtgaggtcacaaatgtaacaacaactgaactagcaccaagagccaaagaggccaagcataaggaaacctgaagcaagagaaaaaggtgtacgcgtacatacaccaagaagcaaatgctatcattaataataattattgttattacagctattagaatgatgaggcattgatggttcacttgggtgaaatatataatacataagctagaaagaactgtgggtaaacttatggatctttttaaaaggcagtttatattctaggtttatgtgatatgagacacataatttaacaccacatataagaacaggatgctgaaaaaagtgaagaagacttgcagctttaaaatagtataatggctagttcctactggtcttttcttgtgacacctgccttagtcaagccatccgatatagttctaaccttttctgatattttaatgatgatgacaggcccagagtaaaggagacaaaataatcagaagattcagaggggaaaaagaaatggaaagaaaaaaaaagagtttgtattgtttataccatctaatctgacaaattttatatatgctctctgtttgctcaggatagtttattgctaatgttatgactttctcttttttttccatgtgctttgctctaccagttttggctgaaaatattttgtatatgtccatactgtaaaccctcatatttttctagagatttagtgtggtggggaaacttttttttcttccccaagggttaggcacatcaatattctagctactcacttttgaggccaatggaaaatgtgctcctaagattaaatagacctgagtaacacataaattcagtttatactgatgcagtatgttgcatagttacatcctgaatttctgatgcgtgtaatacacctgttggacaacacatcactactgaatagtcactgacctacaattcaaagacagtgagacagcacaagactacagatacaggttctctacagacagcctgatttgtacagagcattcctcatctgtggaactctgtgtgtaaaggatctaggctagccatgggaagctggctcatagagggttctaaatatttttagaataaactagagcaataatacaagcacagagagcaccctttgttatacaatgcataatttctttccccccaaacatgttgtttaaaaatgattcagatttttattatataattcccccttttacatatttctaaatgcctcacatacccatcacatgttttccatgtctgccaataatcttaattaaaaattataaacttttaaagccagtgttacatttgatttaagtagatttgccatatttatctggtattggttggctgtagccagactggagttctaagtaataaggggactatgctttcctttcacctcaggtaagaaattgtattcaacacatgcttaaacccaataataagtataattaatgctgtatagatctggcaggcaaattagcatcctaaatttgagtcaagtaaaaaaagtaccaaaagaaaatagttcccccaagaaacctagccaaatctgtgaaatatttctctaggcaaccaaattgccctgtggcttacagatgtgtctaagaatattaggcaactcactgatgagattttacaatcaactgttacatgttagaaaatatgatgtcaggatactatgaagaaaaatactactatatacaataataagaactatttatctgaatagtttttaacattaacgtgtaaaaaatatcctgatggatctgaaataatgatgtactaaatactacaatgtctggggtttgcttcaacataacatggtgatatagtgagaaaataacaggccatcagttagtcattgtgcaagctggtgatgagtacatgggagttcattatagtaatttgtttatattcatgaatttaagattttttatcataaaaaatttaaaaacatatactgatttgaacttttattcatttattatttgttgactgattcatttactgtttatgcaaggtattattgagatataaataataataataatgctcttattgggcatttaggttaaatgagctattcctcttcaggaatattatatatttattttaaatgtttataaggtctatgtaattacatatttcttaggttaaattttgaaagcaggacacaaaattatatagaaagtatgataacatcatgttttaaaaatatatcctcggggaaaatgagagtaaggaaatatatcaaatggttattaatgattggatttaaattatagaaataattactttaatttttcttcattttactcctatgtgtttttctaaattatttttaatgagcatgtatcattttaaaatgaaaataaatatttcttcattactggaaaagatatgttctccttccccaaggagcttttcatttactgaaacagagaaactgcaaacacacagcattgcccagatagtttaaatctccatacctagaagggaaatacacccacaggaaaagaaacgtcaatacagattttatctgatcatagaaacataaagagctttctctgtgttggacagcaatagggaagaaactggcttgtttgcaagccagcaaaagcgtgaaattcagtcctttttgtgatgagatcattttgtgataaatgcaaaaggagtgacaaattaaagtcaccaaataagcctttcccttgagctcctgaggcttactaatacgagtttcttttggggtagcatagcaagtaaagcgtgggagtggggagggaggcggagctacaatcccgaaggctcctggccttcactggtgagatggatatgctcagagagacagagatagatgtgcaacagaatcagaaacaacaacacagtgacaactatggattatgcacaatggatatggaaagtctctgttagaaaactatctttattaccccaagagattatttccctcagtttatgcacgttcatataaagcgaagtcaagagtgtaacttttaaaggtttggatgaatatgatgttcatgactaaacaggcctagatggagccaggcagaacacagttagatgccagggaagtcacccttttcctcctcctccctctccagtacagttgccagtgcatttcaatgcaggtcagcctctagcaaagtcagctgtttcaagctctgattggataatactttatctatacacccccagtcttgacctgcactcttctcccagtcatggaaatatcaagaattctagaaggccacaataccaatctttttgaaactttacaaactttacaaattttcactacaagacacctagaaaaatcttcaagcctatgcttacctgtagccctggtcttggtcctcttacttaactggtaaaagaggatagccttatttatgtctttgaagggtattttccttttttgcttgttggtaagtacaagagcaaccatgtctaattttaagattgatccaaatgaagcaaatgcatttcaaatttacagaataccatagaatactaatgggtagttcaaagtatcactaaatgtgtttggagggttttgagttttttcaaaacatacaatgttccacacaggaaacatcagtgccaacttcaccctatcactctttctgtccactcaggagtctcctttggaaatatatctctctggagggtcttccaaacaaatcctttgaatacttccatcttgtttagcagagtattctaaaatatttgtcaaaatctgtgataataggttctggagatcatgtttcttattcttctaaatgctggtatttcaaatgaacaaataggatattaaagatctgtcctttaccaatgtcaaaatatgttctgtcaaaatttagtattgctaaagtttagacccaaagactcaccacagcctttggatctcatattttctgaggttcatggaaagatatttgacttctttgcacctcaatattttggactgccatttagagataatgagagttacttaccagacagcaatgtcatgaggaatatcctgttagtaatgatgaaacattctgaaataaaaagagtacaggtaagtgctaggtatttattttaataaatgtatgataacatggtaatcatagaaaataacccatttattcctcactttgggatactgactaagtggtagtatataaaaagtaaaggatgtttccctttgggaatggaaatagaattgtgcactaagaaagtatcttttgtaactgcctgcatgtttaactttaaggtctctaaccagttgcaaccagttatgaatgacttgctgcccatttctgcaattcactgtaacttgtgttgagaaggttatgttttatggttaattatccatggtctgtttaaaaaaataaatcaaaccactgtaaaccactaggatttgcagctccatttgagctttactgtagttttgatcaaacattttgtacataaaaacaagctggtttctctttgtttttagttgtttgttatttgtgttataaatattgtggcaatggtgggagaataagctatggattatttaccctcggtttcatgagttgtgagttattggccttatcctcctttataagtataaataaatgtataatattatattccaagtcttgtaagacaaatggaacgagtgaactgaaaccttttagacccaaaatcttttatgcgaagtcatagaacaacaaaacaaaacccaaattaacatttaaaaagcttctactgtggagcaacaaagtctttaaatattatataatctgcatttaaaaaactgctcatctaacaggcagcagtctatcattctacaagcttttcaatgcctttaacattcagaagctacaggtggttttcccaaagatcactcagcacccccaatatcactaccacaatgaaagccttgaaaatggccagcatgattactttaagccaaaatggatttagaaaaatcaggaattcgtgtagctaaaagtaatgaaacactgtataaaagaagaaccctatagaattttttttatagttaccatcctaggacttatataaacaaaagaagtccaaaaacaattgtccagagaaaatgagaaaagccaagattcaaaggaccctgtggcagagtgcatgaggagcatactcgatagctagaatcataagtatctaacacatttgcatatgaaacttaatgaggatcaccaaagtagcttgccaaaaattatgtttgttaaatcagccaacagtctatgtagcacagacccctaaaaagaacctctaggaaagatgtaaaattgtcttctgaaatttgcttcttttataaaggcagaaaggataaaaaggcctttctcataaaatgaagtgattggtccactactacagtctgaagagttctgtatcagatttcttcttaccctttattacttgtatggcttactgcttacctgcatcagcagtctgcagggttggccatagcaggtcccttacgagttcactgaaacacggaaaatatttatgatggtactattatgtgccagacacaactggatggattctgcttgaaaaggtaagtcagtaactgaggttcttgttgccacattaaaagaaaaaatctatccctactgccaacagcaataagaagagaagctagggtgaaagagttgtcaaagacttatgaaaaattcgaaactgtttaaaattctccctagcttcttttcttgcatgtccaagtaacagaaagcttaggcctgccacctgtcttaagcctggatcccatattaaaaaaataaaaaaaaacagaaaaatgagaaacagctaatgtgttcccaaggccttggttacaacagaaaatgagagccgagaagtctacattggcacacatcgagatttgaaaggtcagtcctgccctagtatggttcagagaccgtgaaaacccaccaagatgaaaatggaagctattctgacaacaagaggcagggaaaaagttcaaagacttttcctctgcttcttttataacgagatactttcaactatttttgacaatcaataaaatgcaaatctccctcacttttgtgttctaagttttttttttttaaatttaaacaacccatttgaaaattagggtactcagaataacttcttgtatacagaactacacatttaaaaagctttgtgcagattgttaatcatattaaaattacatcataaacaatgcactttacatggtgcaaatgttttatgtttttttcttttgacaatcaggcacctacatgcaaaactgcatattggaatccaaactcaactataatacatgtagaggaacccttagaaaaatgcatgtgggaatatgatatcccagttagagactagaatattctgaccaattttcattatttctctgtaataaatttatctgagctatagatcctgttaagaaaataaagctaaatggaaaagtattgataaaatacattaaatatatatatactagcttagtcattattcatattaagatcagaaaagatttccgcaagtcatcacaaatacagagatgggataataccaataatctcgatcacccagttgttaaaacagagaacctcacatttgggcaataatagttttgatttttatcttgtgcaccagatttttccatacaaaggaattctaaattgcaatagttaacacataagacagtgttaaacaaattcataactttagtaaaattaaatgaaccaatttcttatggctttaatatccagaagtaaagtatgatcttaaagaatgatgctgatctgagatacaaggagatcaagcgcttcaatagttcctcctcacacactaatgatcgcatccatcctctcttccacccacctcccaccttttctggttgtattaaaaacaatcaaaactaccaccactgctgctacccttcacacacctgaacttaatttcttctaagagatgcctaacagtgcctagggctgtgctatcactttatatccattttatgaccgcttgagaggcagaaactaaaaaggaagaccaaaacaaaacaaaaaatccctccaacctcccttatcagacaaatgcctggttcccagaggacaccagtcagttaagcaaaaccaaatattacaacagggatgaaggacttataaattgcatacaaatctcactgtgctcccacttaaggtggaaagggagttactccaatgaaagaaaagggggagggggttgtgggaaggagcgaagggctacagaaagagcgagagaaaaagagagagagaaagagagagatttattgtacatttgagacattaagaaggcagtacagtgaaaccaaaggtgttccagggagaaatgtgacagaaagctctaaatgagaattacagaaactattccttcttaaataaaactgttgtttagatgatgaattctataggaagtctgaattaactgtctctgttgtagcatctagatgttttctctttcattaagactttggagtttgaatgtactttgttaaaaaaaaaaaaaaagaagaagaaagagaaaaaaagaaaaaaaaaaaagcattagagctttatatagctcccaaagtaaaaagcaagagaaagatgggtttatataactggcttttttacataaatattacatcaggatacatttcaagtgaaaacacacaaacacacacacacccgtcttccttatactctttctattttaaaattcatttcatactttaaatgttgttggtttttcacaaaataagtaaaaacgaagtcaaaacatctcaaaataagttgccttatattacctggaaaattaacccatcatacaggtcacgatgtctcatttaaagccagttaaggtgctgacaattatgggacattttgctgcagcctagggcaactagaaagggccatggatgttaactaactcccttttaaacagtctgagaaaagggaaaaaaaactgtaagtttccccatctgttatttccttttttttttctttttggctgtggaaaagtaaaattatgcaagagcttttgaatgtaaaggctgtgtgtgctttttccctttttgtctctgtgtaccggttaagtgatgttgcgtaactgagtacagagtaggcggttagcgtttactattgatttacactatgccatctaatgaattcagaacactaaaaagaaaggagcaggagagggagggaggaaaaagagaaagggagaaatagggagaggaaaaaataggaatgaaggagaggaagaaagagcttattcagagaaacagttctaatgactggaataggttcatttttattcctatagctctgacttttggttattgttcagctctcacaaaaaaatggtcttgagctggtgaccccaatattccaatcctatttctaataaggattactggcaggtgaatgcctgaaagttctaatgtgtcaaattacttgaaaccaatttcactatactgtcagactcctccatatgcatctatttatgattctctctatgcatttgtgaatctgtatctgtgatcaccatggatttggtcctactggcttacccaatcaaaaatattatttgaaatatatcacgggaatgtcatcagggtaaagagaaatacattctattttacccatctcctttaaaaatacataaagaacacatttagaactttaaatatatcactattttactttgaaaacagacatgctacaaattgtttggctgaacaaaacagcccaatataggataataaaagagaaataggcaaaatgaggaagaacgctaaattgaggaacaatattcataaagaaatttaaataatttcttatgtctatggagagccttttacttttgtttgggtggaatgcctgtagcattctcagtctttgaatgctgctcagtgcttcccatgccatataatgaattcccaaagcgtggaccagaaagaaagggtgaagttgtttctgctgctaggtacaggtccttcctgtacctgagtgccctcctatggctgagaacaaccactaaggtgagaaagagaaagagaagttctctttagtaatcagctgaaaagctgggcagggaacttgatttctccctcaatgtgtgtttgcaaatgatgactgggaaaaatcacaggaggttatccaaaggaaagaacaagagttggggtttctagtcatccagttgtcttctcttttcagccatctgagcttagaaaatattaaacagatgcgtactctgtccacttgtcaaagatgctttaatgacccatggtggtatgcacacagttgtatacctagcacttgccatggtgcttggcacattttctatactcagcaaatatttattgaaactgaaaaatgatgatgggagaaatatctctgtagaaagaatgcactagaaaggcctgaaaaaatatattccgatgttttacaagaaatcttaggctatattgctctatcattaatctgcacacaaaataatactgtaagagaaatatcaggcagttatttaggggtcagttgacttcagttccattttattaggaaaaagcttaacaaaaattataatactgataacatcagcaaagttttgtgttcatttccaccagcccttttgggctgtctttcatttcagtcttgggcacagaaaagtctattttaatttccatggacacattctaaagaaaaagtcatgggatatcaacgtaattcatcttttaaaaaatactgagacaaatgtagccatttagtaatggaagagaatatggctttttgttgaagggcaaggcaggtggagttttgattaggttacacaaatttaaattactagaaggacaccaagaatgtactgatttccattttcttggttaaacagtttttttttggaaaaaaaaaattctggtttagaaagtcagaaatgccatctttcagttaattggagaataagacctttagaaaaagaattgcaactacaatttctcaaaaattccagcgaagattcaacttaaagcatgtttagcaatagtagccatattcttttaaaaaatggggctaccatcttgttaattctgtaggactgagcatgtagatattagtcaaaaccttcaaaaagttttttatttctctctcttggtcatctatttaatgtaatcggattcagcaacttccttcaataagcattctggcaatatgtcaacaagatcattcatttcatgattcttaaaagtggatgagaacttacctgttcttcttcattttatatatgaagattctgagactcagaattaattttctcaaaagcatatattttgaggcagagctgggactagtatctaaagctcacagttcatttttttcacagcacagactaaatcaaagttgtataaattcaatcttattttaaatgccataggggaagatttcaaaggattcttttataagacaaggaattcttacattatgtaaaatgttcacctcaaagctatcttatacttttttttatcttaaatgtgagcctactgttcaaattgttgcttctccttttccttgtcttaatttttgactctttagagtctttgcctcctgtcctctcacttgtactctgtgtctagttcatatatggcccttcctgacttcatattcttccttctctctctcttttcatctttttatcaaacttttatttattcttgttcctcacagaaataatttccttgttaatgtgatatcctcagaaactacaaaggaagaaaaagtgtaaatttagtattattataataaataggcctttggtttatatttaaaacaaaactgcaataagatattgacaaacagagtaaactacagctataggcttccctatagaaagttacagctgtctagacctccatattatcaatatgaaaacttgggggctagcatttcaaagtatctcatcaaagacagagagcaaaggctcatgatctccagaccactcattttccactacatcaggacacctttcgtttcccttttctttctttccattctacattattgatatttgagactgattacggcacagcaggaggagattcagagaaatctccttggcttaatgtggtcaaactctctcaattccaaaaaaagtcagaaagacctgcacactaaaattgtagttacacagaaaaagaactctgaggaggttaaaagagtcctctgacatgagaaagtagtctctggatagcagggacattgctgccaaaatcattgtaattaagattgggtcattgtttccattataaaccttatgcttatggggtttgtaattcagttaaaatgatcagctgtaggctgaaatgcagccccaagtatcttagagtgggaggtgtttctcccctcctatttcttaaaaaagaaaacacatagcaactatttaataatttcaatgagagttgtattctgacccttcccctacaaagggtagttaatcaatgagcttaatctagagtgagccaaggtgagcaacatccactgtggaatgaagcacattaacctggcatatgaatgggcaataaaaggatttcctattatttcataaggtttaatgtacatcactccattccactgtattgatgtgaataggctttcagcaacaccgtgttgaaaaatctcccacttctgtttgttaactcattattgtaggaaacattacaattataggagacaggaatttctgatggtttccttagatttctttcctcataagctcattcccagggtcagtattagataatcaataatttctaaaatttcttgctcctatttctttagcattgtctacaatatctgatacctatagtgtaatgctatgtgccaccatgatgtagagggattggggaggaaatcatagctatatattaaaattaacaggccagaggaaactggtatttactgagtacatactacatgacatatattccattaatattatttcatttaatacaaacctgcagtgaagtagctgtggcccatgttttatagattagcaacatagttaaagagctgttagctaacctgcgtaaggaaacagagctaatttaaaaagttgcgaagtgaggtttgaatcaagatctgtttgactcccaggcccatatgtactgcaatgcaatgcaacaccaggaacagaatatgaaaccatctaactgaaaaaaaaaagtctccatgccaatgatgagagctacctcatgctccaagtaggaggtagaaagggtaaatgactcctaaaaagagattcttgctttgctcttggctctgataaatccctgtttattcatatgcaaatatccaaatgcatatttggaaaatgttttgtcttagataagaaaatgcacaatctcctagaaacctttaaatgagaccagacatttgaatgtttacaaaaattcctttgaagatttatattaggagaaagttttaaaacataatgcataaaaaaaaatcagatgattggctaggcatggtgactatcgtcaccatgggagtcgctttgggaggctgaggtgggtgcatggcttgagcccaggagtttgagaccagcctagacaacatggtggaaccccatctctacaaaacacagtgaaaaaaaaattagcaggcatggtggcacgtgcctatagtcccagctactctggaggctgaggctgaggctgaggattgattgagcccaggagaccgaggctgcagtgagccatgatcgtgctactgcactccagtctgagcgagagaacgagaccctgtctcaaaccctccacccccaaaaatcagatgattaatacaacattaacatttcaatctggatgtgtgtgtttgtgtgtgtgtgtctatgtgcatataaacctataaatatacacatacacagatgaatttttttgtctttgtcaaaatttctggtaattattataaagtatttgacaaaagctaaacagtaaatatgttacaccaggagaaaaggaaacaaagaacaagaaaagaggagtatgtgtatgtacatacttccctcagaaatctaatcctaaaacattttttaagctaaatgggacatagtgctttagtctaaattgtgtgtgtgtgtgtgtgtgtgtgtatgtaaagataaaggacttttactatgttattttggcaagtgattatttttctaaaatctttgctgaatcgttttatgtagatatactataatactcttgaataaataaatacttgttcaagttaaccttagagctcatcaggtaaataacagaatttaaaaaagaatctgtagtctgaaacactgtagagtatgccaactttacacattacattaagtattcgttcaaaataatttataaattgaaaagtatactccattttattcaaacaatgcaattttttaaatgaatcttacacaaatttgtgtgtgtgtgtgtgtgttagagagagtgtgtgtgtgatcctcaagaccactgagtcattctttaaaaatattttaaaatcataatttggtgaagaacttaacaacaaagtaactgaagccagatttgagagaagaagaatgaacagttcttcaggaagcaccaattcattccttaacattcaataagtctttattgcttcgcccttccctcctttttttcctctagtctaaactctgatttggagcagaagttaggaggaacacgtattctggtccctcttctctcatccctgtaaggaaaagcaatggtagactaatgacagaaaaagcaattgcaacaactttggcagttttgtggtactgggaaaaagcaggctttgtatttgtacatttcaaggaatttcttcaaattttagcttctttgaatgttcctacaacaagctgaaggggagataagatctgctagggaaatagatgaggtttagagagggaaaatggagggactactttttttttattcaaatagcattcaaacacatgagcaagatataacttgcaacattaaaaagtaaattagctagctaaaaataactcacaatacccttctcactaaaacaaaataaaataaagcaaaaactcacaaccaattattttgactggtaaaaacagacagtgatatgaaagtaacagatggaagcccagttttactcacacaacacactcactaaagacaattgcaagtgtccccatgacaataacttaacaatggtcactttagcctgagatatctcctttaggtgagtttccttaaagacttcagaggggcttgtagaaaatactgtagaacgaaaccaactcatttgtctatatgtagaaataggcaagagttgcaaatcacagcctgtggacgaaagggatccaggtgtcacatttgccaaatctttttgcaagactggaatagatattcttttcttatttattttttgttgtatggcagtatttttaggagtggtgacatttctgtacttttaaaaacacaacactacacagcacctaaaaactttcctaaatcaaataattaacagtaataaatcttcctgctaatttctcctcaaagttgaaagaaaggttattttcttacctcacactgagccttctgatatgacagtgtcattcagtcaataatttcaatgtcagttactgatttctaactcttttattacaaagacttcaagcaataatgaaatggtgctgatctgcttgctttcactctatataacgtctatatttatatgcttatgcttctatttggatctatatttatctgctttatctgcctacagtgcatctgtttctcatacacacagacatatatttatatatatacacacatactgtatatatatatataggttatatataaacacacatacccacaaaaatgtatgaatgtatgctagtgagcttacttcaacaaccatgcaggtgcataaatattcaggcacatgacaaatatacaaagaacataaatgaacatgtaaacatagttacacaggaaaaagaatatcttaacaacagccctgtctgccatacttggctgttggcctttgagacttatacactgttgaatgatatgtcatagactactctgagaagcagaaaaatcttctgaaggcaaaagtatatgactaaatcaagataatgaattctaactctctcattttcgcaatgaggagtctgagatactaaggtgaacagcaaagattttacagctttctggaggcagagctggaagttttacccaagtctctgcctgctagacaaatgctctttctactactatgctgaattgaaaggatgaaaacaattttttcaaacccaatatcattattttctaattgccactctttcccatttttcccttttcttgctgtgtgaaatgtaaacaaacaacattcactcagggtcaggcactgttctaaatattctatatgtactataccatttaatctgtaaaatatctctatatagtaggtattattattcaaaatcttagtttagtgaattaaataactcactcaaagctacacagctagtaaggaaaagggctgagctcccataatactcaagacccatgtttttctcacttaactatgatgccttccctaatacatatttgtatataatactaacccttccctcaccaccacagcctgatagtcttagaaatctaatatttgatctgtttcagaacacataacaagtttaaaggttctctcagcctgaggaaaaaaaataaagggaagtagagcaggtataagttacatccctagtatgcagcacatgccctatactagagaactgaaatatgcaaaattcccccccaaaattactccaatgatagtgtgatgtgatttaaagccttaataacttccagtctatgaacattttatgtcttttgcaaaggattatggcaaactgataatatagaatcagattggaaataagaccacaagaaggcaaagggaaaatagcaaaaggaagaaagacccacacccacttcttcttcctctcttggcacaacacttccaaaaacaaacacccattaaaaacaacaaacccagtatcaaaatttggtatttttttccccactcaagtgttagagacaaattcagaaaagaaactaagtctacgtatggtaggtagttttatacaaatctcttcagatagtaaccagttgtgagccatccgaacacggaggaattttacactttggccagctaacccagaacccagcactgggagatgtcatgtggatttgtgaaactccctggggcatactgcatccataagccaaagaacagaaattatactgatccatacatgcagctcttcatctgtgccatattgataattactcttcatttgtgaattaaatcctagttataaaaacaactttcagacatttgtcacaaatggcacattttacttaactctttcataacaccatctagccacggtctataggaaatgggagctaccatactcccatataggtcatgatattataggaagaatatgatgtagagaaagagagagagagagagagacagacttgagtttgaatcccaggttttccatttattaacaataaagctgtaggcacatcacttaaatgattctgaaacctcattttcatcacctgtggaataaagaataaaaccacctattttgcaggaacgttgtgaagattagagacatcccagcacaaagaccccctcataaaagggggcattaaatattaattattgtatatttaagaagtctatttgtgtgtgactttctcttgtattaatgatacataaatctgctgggagtaacagaagatgtgaggtactttttatgcttttttaatcaaagacaaactttttggtgatcacatgtgttccatgtaaaagtggaaataaaagcatatcacagtgtaacattttcagtggacgattttaaagcacttaataacccttgactttttgtgattgctggcactctcatttaacagttgggcaaaatggggttcagagatacatcctccaaatcagtaataataataaagaaatcaccagcaggggttagtagaaagtctgtttttaacatctaaatcccacagtgtccagctaaggaataactgctgcaaggtcacagatacaaaaggccacactttccccaaagctctttgagattattcactgaggccaaaacattaggtaatgctgtgtacatctgctgagataacaagggtgagtcagggttaggtcacggtttcaggttagaggggtggggtgaagagtggctttcagatcaaatgacgagagtagtttaatttaagcaaagaacaaaccatacagtattttaagtaagaggggaaaaaaagggggtgcaactacagccaagagaaggtgggtgggaatatagaccctgtgggggtcaaatgggtaactgtggctcaaagaggaaacccacccacattcacacacactgaaaagcgaacaaaaagcccagggtgcagcataaatcctgctatcccaataacacacacagatgttccaccattgttttcttttatgcacattttaattaagagatcagaatcaagcattaaaatgttattaaatggcttgtttacatttttgctatatgtcatttataatgcattttctaaatgtgtgtatatctattcggaaggactatttggaatttttacatcagtgctacaattgtcccactaactcacagtcatttttgctaaccaaatatgtgtcagaaatccttttcagtttaagcaactggacaggagctctcactctttaattctcagtcaagcaattccctacccccaatcacacctcctttaagcatgacaaagtccaccacagtacttcaagacaataggaaggcccaggtacactggcaacctttctgatttttcacaagagtcccagtttcaaatattctcccattgtgctcacaagaaaatagtcttcatatacatgcccgaccctttccctagaacagttttgaaaatgtcgggaactcaaagctaccacatgaaggaccctgacctatgagtgtcccctggaggggacacagtggaagaagcgggaactagtagatttttttttcctccccacaatccatcttctatttgcagtctacaacttatccctatttgcctgggcaggaatttgagttctctatattattctggagttaaaacaggtatgcctttcccgtctctcagattccacagatatcatgactgatgcacacaatccacctgcatatgtggatcacaagtatcctgtagtctgctggcaccatataacttaattacttttaaccacagggcattgtcctagaagcccactatttatattgtaccttatcaatcatggtacttggaattgcaaagtctcagaaagcaggaatcatatctcctccacgttcagttcaatgcctaatgcattgtgagtgttcagttaggacaagcaagagaggtaaggttttttctttctttttgttatttgtttgttatccaggataagcagaatgcttgtacagaacatgcataagaaagaaacgcaatctaatctcactgtcaatttatattctgtaaactgtctcatttgcagcataaatgactacaaaaatgttttggttactctaagtgttaaccttaaggtaagagttaaattaagtctgctataactggtggaccagaaaggactcagagaaaagcaacagcatggctttgaatcaaatcacttttggaagaaaactttaagatgttaccaccgaaaaaataaaactggcaaaatgctctggagggcatcttagcaatatgcatcaaaaatttaaaaaatatatgaagactgttgacccagaaatctcacctctaggaatgtatctaaaggaattactcaaagatctacacaaagatttagaagcaagaatgtttaccatggcattatttataattgtgaaagactggtaaccttgtctgacaatagagagttgattaaataaatgacagtacattcctagacttaaatactatgcagtttaagaaatcatattttagataccacttaattacatgaagaaatgtttttggaatactgttaagtgaaaaggcatataaccaacaatatatgtacaggaaaatatattgtttaagtaaatattgctaagttaaatattgttaacttaaatattgtttaagaagtgatagttgtgtacacacaaagtgcaaaaagaccagaaaacactagaagtgcttgtttctgggtagagaaattataaataatttttgtttatttgaacttttccataataaaagcacatttatttcatagtaaaatattacttaaaatattcatctataccaaccttccttctctaaaggcctaaaagtgaccctctgtaggcactcttttgtctctagaagtcttccttctcctgtttttatagatgtatgtgttgcattctaaaatcttaagtatttgggactatgtagttataaaagataccctaccaattaaacaaataaaaaatcttattaaatctgtggttttaatcttaggttcctgcttagaaaaaataccaatttctctttaagtcctatattttgctttcaattcagcctccatagtattaattagttatattatttaggcctgcagcagaacagtttcatagttcttctcattctcacagttctttgtaagagacaccacccctctcatggttcttactcacccctacacccacaattgaccataggtaattgtgcaagagaccacaaatagaaagaaaatgaaggaagccttaaaaggccaaggtagttccaagttataaaacagagaaaggctgaaaatttaggcagagatgtggagaaaatccgagccatgacacttaagaatgaactggagtaaagatccatgagcacctggtgcagggagagacaactctacctatcaatccagtacatgctactcacacaggactattaattctagtaaataaccacagctttaggaggggcaaatgttctggaataggctgcctgttgaaaatacaagtgctagggcctttccataacctataatcaggacttccagaagtaatatccaggcatcttcattgaaagctccaaatgtgattctgaattatactagaggtgagaaccaatgggctactggggaagttcaaatcccttagctctagccaacttttataaattcatctcccttaacttcacaaacatatacactctgctgatgctagaccggtgtccttgttctccatccttgctccgtcataaagagaaagctagtttatgtctttgtacaatctacttatgactttatatcttgaatgccctgactgctccttactacctgtttaaatcttcactaattccaacaatgggttagagtttcaccttcctatgaattcacattgatttttcctacacattaaactacagaatctgtgtcttcccctatttctactcttacatcaatatgaaacaataatttgtttgtcttacaactcaatatgatcataaaccatatgtgcccttagaaagtgttcacatggttttgttggtacctctttgcaatgtatatcagggaattttaaaaaatagcagactgaattgagaccagtacttgcatgttcatcatcatataatatgggacatgtatatttacctccaaacattctcagagttcattcttcgtaccctgtaggcttatgctgtaaagaaaatacatatgcagaaataaaaacagagtttgaatctccagtcctaatccttcctctgaactcctgtctcatgtatccaactgcctactacatctctttatttggaaaagaatttcaaattcaacattctccaatactaactcataatcatctctttcccaaatctgctcatttctccatatcccctatagctcccaactccatgggatattgccatttatccagtggctggggtgaaatgcctgaaattcatcacacctgatgtctctctcatgtaaaaccacattgagaccctcagcaacttttgtcagccctaccttcaagttatgcagagttgaaccacttttcatcccctccccactgccattgccctttgcataactgggctactatgataactactacatgctcttcctgtatcaccctgaccctgtagactgttctccacagtgtagccctggaactcttttaatatgtaaatgagatcatacatgcttaaaaaaatcctctatagctttctgtcagtctttatcatggcctgtgtgagctggtccctacttatctacatgatcattcttactttggtccacttgagccacacatttcttcttgctcttcctggaaaatttcaagttgttcctactccaaagtctttacaatatccatcccctttccctaaaatgttcttcctgctggtcaccacatgcttaggttcttctaataatttaaatatttgctcaaatatcttccactcggtgagacctttcctacttaccctatttcaaatagcactttctaaattatatatccctattttctacctccttattatgcattattttcttcctagatctgatcattatttaaaatgatttttttttgtttacataattattggctgtctctccttccactataaaataagtttcataggaaactttgtttaatttctcactatattcccagtaattagaacaatgtctgaaacattataggtacttgatagctattaaatgactgaatgaataagtagatgaataaagtgttccagtacttataaatctcatcccagtcacataaactttaaataggaaatctttattctgcatggtgcagcggcttctctggattgtcccagaggcctctattctttccatctgactgcacaggccagtctgggaaaccacctacatgcaatagctcacatgtcttataataaacttcttgggaggagtaagtcaaattagatagttaactaaaaatagtatctctgagtttataaaggagacgttttcccagcccaactggtcctggtaagttagactggcatcaaatgctgacatggcaatcttatgcttgatgaaccctcaatctggagaggagtgagctatacttttatactatttattttgtgaaagttccaagtatagttcatctttgtatccacaatgtcaagaacattgctgagcagagagtagagcttcaataaatgtttattaaacagatgaacaaactaatccatgaagcaaacaacattctaagtgctattcttctatgtctaagctttgacgatgcgctatataaaattcattcttgcaattttccttcatagattagactgaaaaactcatcgtgaaggaccatgtcttatccatcttgtatcccaagttcttagtacagtgctggatgtaaaaggaagaaaaactccaaagcaaaggatagagaagttagaagtcctggcagcgatcagtgagtattaaagaatgccagtatgacgtgattatcagatgttaggtgatgaaaatcatgccagctaacatatggatttctaccctgtttctgtataagacttgagctctaaatttagttcctgaacacaggggatcagagttgaaggtgattatttactatgaaactgctattttccacagtatacatgatcaaagtgctagaaacttaatgcatgaaaatctacacttctttactcaacctctcttacagttatataaaattctttagaaaattaatgttataaaaaagagttcaggccgggcgcggtggctcacacctgtaatcccagcactttgggaggctgaggcgggctgatcacctgaggtcgggagtttgagaccagtctgaccaacacagagaaacctcatctctactaaaaattaaaaaaaattagccgggtgtggtggcgcatgcctgtaatcccagctactcgggaagctgaggcaggagaatcccttgaacccgggaggcggaggttgtggtgagccgagatcgtgccattgcactccagcctgagcaacaagagtgaaactccatctcgaaaaaaaaaaaaaaaaagagttcagtttgttcactaaagggctcaatttgttcactacataaaaggatatagcagtttgttcacgaaatcaaagccttttcaaatataataagcaatagaagaggtgacaaaatatataatgtaactattaaatcagtatgccttacaagtatccatcatggttatagtactaattgccttggtttgtccaagactgaggagggatgtgagcttttccgtgttcaaacagagaaagctccaggctagtcaggacaagttggtcaccctaataatggtataacctgctaagctggttatcagctattccgatgtatctatatgtaggatctataggtacatgtagaatatatgatagataactaggcattactaggttataagatgattaagaattaatcagtctgtactagtataccatatgaagtgcaaatcccttgtttcattttctcttcatttcccctcgatgttggacttcttatgtttttatatcgtatgcttatattgattttattatagtcaaatacattaatttggggtgttaggacaatttcattttcttcagaagaaaaggaaaagtgagtagcagcaatgcagatgggtctcaattgacgcatgagctcatctgttttttacaactccaagtgtggtaattccccgtagaattaaaatttcctaacacagaaattaaaattttcctagctgaaaatgccggctttttacatatcccaaaactgaacacataaagattaaactccaaaagtaaggcaagatctacagaactatcccagccctaattctgccgagatatttattataagacaaactgagacagtcccctgtggtctccttaaggtcctgatggccccctcaaagcatcatctggctttaagagaactccaaaatagtaattggtctttgggcacagaatagccattggaatctggattagagtctgaaaaacactgcattttccaaagagattacaatgccaggctttgaacattgaagggtaatatcttctttctaagtatctctggtcagtctcagtaactagacctacttttgaggctccatttcttttatgtcttttaaatttaatgataaaaaagaaatatctaaatttataatatacacgaaacagtgaaattaggagaaaaaattctatttgatgtgtccatttttttaagctcccatgactaaaaagatcaacagttacctacatttgtaatatttatgcctcccaggctcagtgtaatgagtttcatctctgatcgaatttttataactgactttcacttacctgtgaaataggtaataggaagccttggtaggtgctttccctaaagaatcagatgcaaaagttagacctactgcaaacaatacagaggaaaaaaatgtcactctaatatactactactatatccgtctgctttttgcaggaaaggaaagctatcatcctagacagaaatactgaaataagtgaagtacagacaagtgattaatcaaaatctgaaaatcatagtcttcagctttttcttccatgaaaccatggtgtgtcctcttaactttggccaagtgcccagctaagagaattcttccatgagatgaacatgcttcagggcaaaaccttattctaactgatggttttaaaagcccaactctacattctgctcaaggctttggttacgtaggtaagccaaaacacaggagacatgacttcctccattaaactggctgaagcccaggttacactaattgagcctaaatagaaaacctctgcttttcaatccctttgttctcttggatgtcacagcttcctgctctattcgcttccttttatagtcttctctcaccaagcatttcaggaaaaaaaaaaaaaagctaaataaagatcacagcctgttccattgtgtccccttcttcttcatcatcttcttttccatgtgtgcaatgttgtggcacctattaactaccaatgttttcagaatgacattatacaaggtgcaggctgtaccactgtgccctaaaaatatcaacaactgcattagtctcacaataattaatggcaggcattatgcaaatgacaactttttcgctgcaaaataatgacatttcttcattttgagcagagttatgcaaaacaatgaatttaggatgataaatcacacaggagaattaagaaagccataacgttcctgcccaggcaggcagaaagatagacagaccaacaatttagaagacattgttttgttctcacaccactataaaaaatcatagccagtcggccattaatgtgtgtaggtttttttccttctcccctttaggcaacaatgcataaggggatgctaaattctagcaattggatcattacaagtcacaagcaaatttttctttattaaccttaataagtcattcactcagagactatagtcatcaagcaaataaaaagtatcacatgccattctgctacacattaactaattccttatgcaaacatcacaacatatagcaattactgccgctcaaaaaaacaaagtcattttcaatttattttattgcttttatacttggccatttcctgtagcacattatcgtttctttccctaacaacccgaggtggaatgaagaagaatttcggtagcaatgagccccttcctctagccacctttgtcatacctttttcccctccgggaggcttttaaggaaggttagggataaggtatgtgcacgctccttcacaggaaatgtgcatcaagctcagagaaatggtacattcagctcctattcttgcagcaaagagagtgtggggtaggcagtaagacccaagtctgtctcccacatttgctacaataacactgacagctttcctttattcagtaaaacaaggtaaaagtgtaggcttagacctgtccccaacaggtgaacgttaaagtcaatatatgcaacgttgacctgagagatatagtaatggttaatgagaattatgaggttacttcgtcttgcttcactcagcacataacttgtcccttccagaatgctgaatgaagagcaataataaatactggacactaccccacaacatgcacagtattaaataagatctttgtgtgtgtgtgtttttaattctataacatcctttatccaagactcccaggatgtgaaacaaatgctaaacaaagcttacacattgctaacagattcttttagcccattttacagactgacaaatggattctgagcaactagaggctttacacaaagttggactggaacaggtcagactatctttccaatgttctaacctctgaggcccgtggcctcttataatcatgagcattctttcctgctgataaacaattatgctgtaaacagcctgtacatgtcccttttcacacaacaggatgataatctctctccgttctcctaaatccacaatccattcccccctttttaaggtagaacatttccgaaatacacacgggaaaagctctgttttcagtttctcctcctgaaggtaataacattttgcagttctccttaaataaaatccagcccatgctggatcaataagaatgatgcccatttccctaatggcagccgattgccatttgctattcaaatcagactagataaattacagtacatgccagggaacaggccagtgaattaagacaggcctccagaggaccagcgatattattaatcttttaagacactatcatatttcttcttgacagtgtgcgtagactcacagacacactgcacccagattgaaatatcagctgctgaaaaaaatcaatagtgttagaaacacaataatttttggtctgcagggtctacactaagcaacacttgtacccctcctgtgccatctcttctcccacttcccctttgccatatttgcctcctacctttttgctcttcccttttcattctctggttttaaaagcttgtaagtccaaatgacaagatattatgagaaggtttccactgctaacactggccattgtggttacagcgttgatttttcatgggttgtttgaaatgcaattttactagtctggcaaaatgttttggcgtgggattgtttttcctatgaacttaatatagattttcaacccttatgcacttggttctgtattatgaagaaatgaaaatatttataggggtggccatacctgaaagttctgaggaaagtggaatgcacagaagggaaaataatggaaacctggcccagaaatgaaaaaaagtggggggtattcattgaagatccaggagaataaacaaaacaaaacaaaacaaaacaaaaggctacaggggaggtgtatgtagagcagaacatggtaggaagaatattctacttagattctgaaaacttgaagttgacctctgcctctgctgcctgcacactgtgtggttttgccagttacttacccttgcagagccttggtttccttttccattaaaacaaaacaatctaaccacctacctcatagcattcttgtgagggctaactaacaagatgtgtgtgttttctaaataataaaattgtgaatgatataaactaatttctactagagagaggtttatgaaatgtgtctgcttttttcctttttcatagatacagaataccataaaggaactttagacgttatcaataaataagcaaactgatagccacagaaaggttattgaggttcacattaccagtagctagtagaactttaagtagaccaagatctgttgaatctgagccagtcccttttacattttaccagatggattttaccttttccatgtctctttctactagagatttgaggctttgattcttgtccatgttgcttttccactggggaggcagataaacaaaatgccacataagaaaacaaaaacagaaacaaaacctaccatgtttgtgtatatttatatgctattcttttgatcccaagactccctccagttcaccccccattttgattcttcctttcataacaaaatgtattagaaaaattgtccgtattagttattaccgtatcttcactttctattcttttcttaatctattccaatcaggcttttatccgttccactctaccatatctactgttgccaaatgcaatggtcacattttaattttcatctgactcaacttcttgcaacaatttaacacggataaccgcttcttttcctcctcgaaactgtaatatcttttgggatacccctcttttcaactttctctactatcttacagggcacttaagcctatttaagcctcatcaaatttgaaatctgttactagcaattcattcttatttctgaattgggataaacacagtatatttggaaaaacagtggactgtcagatgttttgatggtctgattttatgactttgatatacaaaaaagagtagaaaatcttattcttggtttggcttgaagcttttttattccacatacctcatggcaaaatttatgaactacttttgaaaattcataagtgatcatttacctagatccacttaattgctccacccagtttcttcaaacacttgttctttgaggtctacatggcaagaagtaaatacgaaaaccatttccaagtgaactaaagtaacctgaatatgttttctgtgttaggttgttccccctacccacagcaaaagcatgaagacttcctttaagaatacaagatatattctaagtctaccagtactccatcttctgatgtcagatggagttaaagttcactttcatctcaagagaaaaaacagtcattcctgacttacaaacatgagtggagggaagtacctgaacacagggattgctttcctcacatctggctctaagatacaaccacgcgctgtgacatataaaaaggtcactgacacgagaaaatatcgcaagatattacaaggataatcaaagccaaaatatatccaaacccacttttggagagaatcccaataacttcttttgaatgtgataataaaaataacatgaataaagatcattttcttaagaaaaaaaaggaacgtttctatcacttgcctgccacttgccacttaggagtagactctggctcccttttccgcttaaattcttccacagagtcagcttgccagactcttaaccaaggtttttcttttatctagactataacaaatactccattttgggtcatgagaacatagtagcaaaattcccagagttaatactttaattatacacatatgtatttattattttgtatgtgtgtgagctgttccactaagttaaactttaaccatattaatccaggaaaaaaatccctgattatcaactaacaattttgtaaacagttatctcacaggttaaatattaactcgaaaaatttaactcaaaactccacacaagcagaaggagccaaaaggccaggaagaagaagtaaagattagctgctttaggaggaacacagccaggaaagtgagcattttggtagctggataatgtgtaggaagtccagggggttgtgcaggggggggaaatagaagcaagaagggagcctggaggacacctgctgcttatcataatatcaaaacataaaacaatgaggtgagaccttaaggaaaagaaaattcatggagatatgaatccattgataatggccacaggaattcaggtgcaataaaggtttgaacctcaatgatatggacatagctaaaagatccaacacaaagctagctggagcggactgcctgcctgccactgaatatcatgaggaacattctggggtccctcttccactagaaataatgggatgaaggctgctctgcctgtcctgtttctgtttcctaacaataaaacaaaactgaagtgtctccctccagtattgggttattaggggcaccgattgcaagttctaagcctttatctaactgtccatcaattctctccctgattaacagaaccatatcacgtaagaaaaagttggaaccagcagtagactaagtcagaaggcttttctgtaccggaattgctgaactacaaatattgttctctggttaggattttgactaaaaaatgtcaagaaaatccacatggccagagaattcgcacaatcttgatatctgaggtacagggtaaagctgatgtattttaatgctgttttaggaaggttagaaactgttaagattcttcctgtcagtatgtcaaatatcagatcagtcctgcttgctgatttttaaggaagtcattaaaaaaatcctcccagtgagtagctttcaaggaagactcccatttgcccggcagatctaaagaaataatgaggccaaataatgcaagtttctcaagagaggtgtaggattgaatgaaaaaagggaagatatagaaatgtaggagaaataattcttacatatataatatatataatgtatatatgtatatattgtgtataatatgtatatattgtttatattcaagaaatatgatatagcttatcatatattacttttgatatttttcttatacatctagtacatgaatacatgcttattggaaaagtacaagtacaaggtgtagtctctattatctaaatatattatttaaatatatatctaaatatattatctaaatatagatgacacctcgtacttgtaaagctttttgcagtttataaaatatttttgcataaaatatcttttgctttcctgacaaccacaaaaagtaaaaagggtgggttctataatttctgttctatagacatgcaagtattactctaccattgacgtaactggtgcagaataaacctgaacagaggaaatagaatccattagtagcctggttatccatatccacatgccaagtaagaaagcagcatgatgactgtggaaatgtaaaggcattataagagtgatttttggagaggattaaggagggagacatcaaaataattcaaaaggaagtttagaaaatcagtagaaataaagggctaaatttggagtaacttttttggaaaaaaagtgtttagaacaaggaaagaaacttccaattcagaccatgtattcatttggcatatactaattgtatatctatgtttgattttctttgatagatgctattgggtaaataatgatgtgtatggagacactgacctgtgcctgacatatttaatatctatttgttgggataatgcccagaaggaattattatgcaataaaattcagatattcagaataggggtttagagagaaaatcatcactgatatgtaggctgacaaaggaaagcttcagtatgatgaacaaatctagttatactttgaaaaacatgtaagatttgggaggtgataagacatttcaagttgtgtgaagggcatgagagaaagcatggaagcagaaaattgagatatgtatttgggagcagcaaataaacaagttagttggaattgtaataggaaacaatgctggaaagatgggttgagtgtggaatgcgaaacggggtccttgaataatgggctgagtagtccactttattctgtgaacacaagaggtctattaaaggcttgtaaagtaggacactggcatggtcacagtgatattctagtataaataattgggaatggtggacagaaaaaactgaaacagggagagcataaaggtaatgagagagaaagagagagagtgcgagcttgtgagagcaagagaatgagaagtgatccactgcaacaacccaggtactatgtgataaatatctgacttcggtagtgtcagcagaaatgtacaggaaataacatgttctagagacattgtggaggaaaaaataacaatatttactaaagttctactctgtgccaggcaccgaactatgtgctttatgtagattaacccattaatctccatgctaaccctaagaggtaagtaactttattgtttccattttacagataaggattaagcaactttttcaaggttatgcagttagtaagtggtgaagcctggattcaaacccaggcaatctgactccagagcctgttctcctaacccccacacttactgtttttcctaggtacaagggatcttttggtggattatatatgacaagatttgatataatttgatgactgactacatatgagcaataaattcgtgggattcttgggattctcaattctgagatttttgggttatattatgaataaaaagaaggaaataaagaagatcttcttgacttcacattgtacatttgttcctaatggtccaattgctttttggacttaaagtatcaatttacaataaaagccacagaagcaactgaaccaccaaaccggaaagctctttgaaaatgattcttctttctagtttcactaatgtatatctggagtatagcacagttcttcgcatataggggatgcccaacaataacatgatgaatgagtcaactggagaagtattaattgtaataagtgagaataagggagtggagggtgtaaaagtcaaaagagtatgacccagagtcagacaaatattggttcatatcctggctcagggccctttctaactacatgacatacagaaagttactttaaacattttgtgtaatatggggtaataattcataggaaagctagctaccttactggattcagtggttttatataaaggcaatgggtgtatgcaaacctagtaaggaatgctcccaaaggctgttacctctgacagaagaaaatctgcaacccctttctctttgtttaacttacaaaaccacatgaagacctaagaaaaaaaatctgccaaataaattccagttacaaaaggaaaataaattattttgaaagtaaaaactataatttcaactgaagaagagattttaattgcagggagatagatcagttgaatggtttaacttggacttgagaaatcagtagcagccagtgggatacatattaaagaaaaaaacaagtttaattacccttaagattttatacagcttggctcttccctcccacacctagtctgcttccatcaggtcagactccttttcaatcacactctcttccatccttttctcagttgctgtcatgacaagccaatgagagaatgacataccgatgaaaacaaggtttgagtaattactgcactgtggctggttgttgtctgggcatcattttatttcttccaatcaaacaggtccttggacttcacagctctgtttcaggtgggggtgatgctgattatattatgacattatagcaaagacaggcagatcagatgaagtgaatttcactcagtaattaaactgcagtttctttcgtctaaagtccagggcaggattaatcgaaacgtagctctttatcattcctattaatgctgggatttgaagagtgagctctgatttgatagctagccctgaatctggctgactggtgtccccaaatctgtctaacttgcaaaaataatatcagatcaagatacatttgcaaggttatacccttcccttttattttacttttttttttgataaggaaatgcaaatagattcaaatatgctgccatttccactaccttgttttctattacaaaaatgtctgtgaaaaaaatcaggtccttccaaaccccacagcattttacaaatggttttccataattccacttaacaccatgctctaatggcttctaattttgtgacttttcattatctgagactcaatatgaatatttggatggcccaagcgacagcttttcagaggctcaaaggttctacttttattttaaaggactcattctgggacttatatagagattttgtttcattcaatcactcttgtaatgcatatgatatcaccaaattctttaacaagtatgagttggatcactgattctcaatcctgggtgtccatagaaggacctgtgaagctctgtaaaaaatcagcctccagcctccactccaggccacactcacagatcggaatctctaggttttagacacaagattttatatattcttgaactccataagtgatttgaatgtgcagctagagttgaggaccagagtcagccacacagtgtattagctgtatttgcaaaatatttattaaaacaagccattgttcagagaaattagcctcacattattgtgagagatctctcaataaaataataaaaagcttattccagtagcctttgcatagaaaaagatatacttgggtttctttccttcttttcttttttttttcttagacggagtctcactcttttgcccaggcaggactgcagtggcgctatcttggctcactacaagctccgcctcccgggttcacgccattctccttcctcagcctcccgagtagctgggactacaggcgcccaccaccgagcccggctaatttttttttttgtatttttagtagagacggggtttcaccgtgttagccaggatggtctcgatctcctgacctcatgatccgcccacctcggcctcccaaagtgctgggattacaggtgtgagccaccgctcggcctcccaaagatatacttgggtttcttaagggaagtagaggaaaaggaagactgtaaaaacagacaggtaactgttgatggggcttccattgttctctctgataacattgaaggtgatggtttactgattgagctcatcacatggtaacactatagctaccaaccatataatttaagatgacagttgactaacatcatagaatctcagagtttggacataaacttggaattagctgtcatctattttaaccccttctctattcagctgcctttttagaaagagaggcagaatttagaagactttatttcaaattctgttttcagttctgtttcagagtttaagaatacacgttctagggtcaaactgaattcaactactagttgggtggcctagatatttacttctctaagccttaattatcccttctttaaaatgcggcccagaatatgtatctcaaagagctatttaggttttatattaattaatttagataattaactagaatgcctggcacacaaaagtatcagaactcaataaattaagtctattgaaggaaattgcaatagtcacttttaaggttgtcactgagactctatgcttaacaactatcagtttggtgactcacagatcagttttctggaagatttgatttgccaaagaaaaagagagtgagtccaaataggaatggctttcacatttaattgagccataaaataaaatacattttattaaataaattttataaaatacaattttattttaatgatcacctggaaatgatcattaaaaatgcaaatttctgggctccaatcccagagattctgattcagtttgtaggagtggagtctaggaaccatccaggtgattctgactcagggtcaagggtcttcactttaataaagacagttataaaggaatataaattagccaagcatttatcccccaaataactacagtgtggcttgacctggaagagaccatgctttctattccttaagtcagaattcagttagatgagtttaaaccatgtgcaaatacaaaatgtttatagagtatatttatgcacacagagttaaaaaatctatttctcttcaattaaatatgccttctcaacaattatcatttagccactaacattatcttcatctcttttcatcactactgggtacatgtaagtatacagacaagggtcagatttgctatcgactcatccattttcttcttacaaaataataaacaggtttcataaaattggtaaattccttgaataaacaaaagcagctatttcctcctctaaatgcattgtagaataaagtattttcaaaacgcattaatcgaaattgataatgaaagtcaatatataattgtgagttgaatattttaaatgcaattgattacttcgctaaaatgaatatactcaacttacacatggagactgttctggatctaaggagaaatttaaacattttcattcccaatcagcgaaatcccagaaatgtgtttagagtttctaatacaatataccaacaaatgtgcattaactctctatattctaaaagttattgtgtaacaaataacaggagaattatggtctctaattgcagttgaacataaaattgagctggggagaaaataaggcatcaacatgagaaaagtttttcagcattatacaacaatataggctagtggccaagtgtaaggctgaaggagaatctttttagtacatactgtgtgaggcagggtaagctaccgaagatctgcaaaagtcaggcacagtaactcactgagggggttgtggtgaccacagtgggtactgaataaatgtaacctattatttattataatagttgacagtttattttagtaacacaagatatatcacagataagactatgtaaccggtaaaaggtgaatggtacaggcactgagagttacagggagccaaaactgagagaatgctggcatgactggtaagggttttgtgaggaagagacatttgaatggataatgcaggagagagaggatttggctagacagaggaacaaagatcattttagacagggtggggtgttttgatatgaatcgcaggtcaaagttaaaaagtgtttaacgactgttaaaaaaaacagtttaggatgaagccataaagataaatttgaagtagaacaacagagggttctggattccaaaaatcacttgtagtttctggtagaatttttaattgtcaaaatattttctcagtggaattcaatatctctttagatcagtggttctcaaattttagtatgcatcagaattacctgaagtgcttgttcaaatacaaattgctgtgttccacctcaaagtttcttattcagtaggggaaagtgaggcctaagaatctgcatttctaacatattcctaggtaatgctaatgctgctggtcacttggagaaccactgctttagaagacagtgagataggccgggcgcggtggctcatgcctgtaatcccagcactttgggaggccaaggtgggcggatcacgaggtcaggaaatcatgatcatcctggctaacatggtgaaaccccgtctctactaaaaatacaaaaatttagccaggcatggtggcaggcacctgtagtccccgctgctcaggaggctgaggcaggataattgcttgaacctgggaggcagaggttatagtgagccgagattgtgccactgcactccagcctgggcaagagagagagactccatcacaaaaaaaaaaaaaaaaaaaaaaaaaaaagtcagtgagataagagaagagttggatgaagagtttcatggataagaaagagttggacgactatttcctaaagtcaccatataatggaatagccctctttatttcctataaaatttcaccctccctttcataccaacacatagagaaacctacatgaagattacctagggatcaaaattcttctttggctttctaatccctctattgggttcaggtccttaactgtgggaatgaagaggcccatgatcaaaaggagcccaggcccaccaacctggaaacttgaagacaacttaatcactattaaggatattcaagaattcaaaataacagacccaagagactaaagaaagaaggtggaatttttattccaaaaagcctctgtcagtttcatgttgaacattttgtacttgggctgcacttaactgcctgccccttaatccacaaactaatatcatctcaccttggttcacctttttcttttcttcaaaaggcagtcagaagcaagcaggggcaatgagaactttctacctaggcatgggccactgtttaagcatctccaccttctgcttcaaaatctttctccaaaacaaacttccactatgtggtaactatactgtaagaaatcatttaaaaggcagaaagaggaaatgaaatgctctgagagactattttctcatgcataacttcgagggcagtatctcacaagtcagtactttatttttgatggcagacaaaaaacatgttgtgtttgaagattcatgtagaaatctttgtgaaaaaaggtcaaaattggatttaaaatgttcaaaactccaaaaatctctaaagaacaggagcttgtttattttctagcaatttatctttccttaaaataagaagctatataattacaaagtataattaataataataacaataattaccacaaatacaacagaaataatgatagtaagcaccatgggcccagatccccatagttacaaaggataagaatttgtctcagtatatttgagaacagacagcagcccaataatacaggaaaaaaaaattggaaaggaaataatctttcttgtgctccctggaaaataccacagaaaaatagacaatcaaatttaatacctgttgttaaatatcttcattgtacagattaggtcaggcaatttaaatagacaacaacatgaggcctctaatgtctcttaggaaacagtttcaatgtaaattcctaggaggtcccaattcaatttctagttaagcatccccatccactcgtaacactcataagaaggagaaatgcatttgtatggtgttttacagtttataaattattctcacaaacgtgttatttgattgtctcaaaaatcctgtggggtaggtaagtagagaaagtattaatagtatacccattagaaggtgaaagaattaaggatcagagaaaaaggacataaattaatctttattaaatatccacattgggtcaaactgtgcagacctggaaagaagtccaaataaagttttacataacatggataggcttggagaatttgttaactgcccaaagtaaaaaaatggaagagctagaacttgaatgcagataatgcagctcaagatgtaatggtctttccatcagaccatagactaaactctcagttgtaaccatcgtctagttacagtaactgcccctctcaagaggaggctatttcattgccaagaaataaaaccgtgaatagtggtcaggttttctgtttttagttagactgaaagaaagcacatactccttgagaagacgtgcatctttttaacatgacttagtctgtcaagagaataagagagagaatgtgttatttcattcatgtagaatactgacttttaaaagtcactcaatttctctaatgatcagtgatgttgagctttttctcttaggtttgttggctgcatgtatgtcttcttttgagaagtgtcttttcatgtcctcaggggagggcagtgtgggggcagagagaatcaagaaaaatagataatgcatgcggagcttaatacctaggtgacaggttgataggtgcagcaaaccaccatggcacatgtttacctctgtaacaaacctgcacatcctgcacatgtgcccaagaacttaaaattaaaaaaataaaaaataaaaaaactgactccagctacccatggacacaagagacaacacggtcccatttgtcaccaaaatagacaacacagtcccatttttcactaacatactctttgcaagaaagataaactaaaagactatccaacattaatagctagattctggcatagtctcagcttaaactattagtttctaaataagaggcaatacatatgcatagtaaaatagagaataacagcaatggatgtattaacaaaatgcattttccattaattgttatgaattaaaaagtctcgaagctatagatcgagactttgaaacttctggaacaaattaacctatctctttttatttttactttatgcatgcatttacttgtgtagttggtgttgctatgttttcttaaatttgtttttaagataattatattctccctctacttttatacatatatcttctgaggcatttaaaggtttgacaaagcagtgtcttctcacaagagacagaggtttcacttagaagccatcttgggaatttgggctgcagaaatcaagggaggtctagtacgtaagtaaatattagtgcaataatattaaatttttgaatactaaaggaaaacatttattgaaagaaaattgctttatatccttaacaactaccttgctatcgaggatttttagagaattgcagaatttcagagttgatgctatatgtaggattttcttttcttttaattttttttttagagacagggtttcactctgtcacccaagctggagtgcggtggcatgaccatagctcactacagcctcaaactcctgggctcaaacaatcctcccatcttagcctcatgagtagctgggatcacacatccggctaattttttttttttttttttttttgtatagacagggttttgcttgggggcccaagcttgtctcaaactcctgtcttcaagtgatcctccctccttggcctcccaaggtgctgggattacaggtgtgagctactgtgtctggccccaaagattttatttttataatgacagaatatcagtgttagcagagtccattaaaattatatatgacaatcatctgtttaacccatttatgccaaatgttgcaattttgtgtgtgtgtgtgtgtgtatgtgtgaaaaatcagaacttggtgatgaccttgagcaacaggatatacataactgccacaagcttagcattccaatagtggaacactaggcataaatgggttatggcttcagtatcctgcaaaatatccctgtaaggtagctgtctatgcttaaacaccttggtcttaggaaactaggatttgtggatattaggcaatgttatgggctgattgtgtcccctaaaatacatagggtgaagccctaagctcctaccaactgtatttggagataaggcctttgaagaagtaattaaggtttaatgaggtcataaggttggcactctaatccactaggactggcgtccttataaggacaggaagagacatcagaggttctcttgagctcacaaagaaaaggctgtgtaaggacacagcagcagaaggctatctgcagccaaagacagaggcctcaggaaaaaccaaacctgatgacacctcagtattggacttctagcctccagagttgtgagaaaccaatttctgtttgctagtccacccaccttgtggtattttgttatggtaggcctacagactgatatggtgcctgtatcagtgcctatatggtgcctatctcatcacaacctgtaaggaaggaattacttaaagccaatttataggtatagaaacagactatggaacattcaagaaatgtcccaagagacaaggattcaataagtggcataactgagatttaatctaggtctatcttccatattattttttaccctcctattttttacctttgaacacagaaggctgctacaaagttagtgtttcatattgacttgagtattttattcttgtaggtttcatcactggctgatggtctatttgttggagtaacagaaagcaacataatttatcttttagatgactgtcattcatatacttgaagatagttattacattccttcctcctgaatttcctgttaatcccggttcccttaaccattgctcatatcacatgtttcagttccctaccattctggccacttatacctgaagatgttcctatctatttaaatttcttgtactgggttggaaagtcatatctctgctacgtcattcatgactagtctttttaaaatataaaggcaatatcttgcatttatccatttagaaaatttcatctgttagatgtagcccataattccagtctttcaatgtctttggaattcgattacttcattcaacaacttttctatgtatctggactcatgtcatctgcaaatctaatgaatatgttttcattccagttattgaaaaaaacttgtgaccaagataaggccgaaaatatccttgcaatatgccacaggaatcccctatattatgatattgagccatttgtttgtacctaatagtgtggtcaatcaaccagttactaatccagctgtacctacattagttactaatccagctgtacctagattagtaactaacccggctgtacctagattagtaactaacccggctgtacctagattagtaactaacccggctgtacctagattagtaactaatccggctgtgcctagattagtaactaatccggctgtgcctagattagtaactaatccggctgtgcctagtttagtaactaatccggctgtgcctagattagtaactaatccggctgtgcctagattagttactaatccggctgtgcctagattagttactaatctggctgtgcctagattagttactaatctgtctatatatctaacccaggagatatcagatcacatattgtagacatcattttactgaagccattctattgtctagcaagcaccacttctttcagtggatcatgatacattgttttatactttattgctttaataatccattctagactgttgctcaggactaacagcaagtagttgcatcatcataaattgcctttctatactttctgtaaatcagaagatttccacatctctagttatctaacattgtttctcttctcctcaaacatggatggtagtaattgactatctcattgacaaatcctctcatgagtatatggttctctatccctatttttaggctcttctccttttcctttttttcctgttatcttccaaggaaagagtcactcatgtttaatcatgaacggtatgttggtcagagatagacctgcaaactggaacaactgagaagatttatacaaagtgttgtcctagagtccctgactgtgcccgtagaggaaaatgtactatgattaggtgaggctttgctctcatctccacacagggctctgcatggcttttctatttcacttctggcagtactcctggggaaggctacatccttttcctattcattctgggtgacttcctttgccaaagattcaagacagctttgtatttttcagtctttaactgagaaaggttgtgatatataatgcctttattttcccatgaagactttctctgaggcatgcacatagccacgacctttacctaatcaagaaaagttgcttgggcagtgggggatggggatgcaggttggactttaaatgcacaaatcagttctaataaaaacactgagattcaggtgcctgaggttagaaatactggagggaattcaattacactaattaatatttaagaagggctagagatcacacactgaatgtgggaaactaggccagtcagacatgagcatatggggagggcaagatcaacagataaaagtaacaaacaaatcatacataaatgctccaacaggaatgaaatagagaatataaaataaatgttccaacagacactgaagaggaggtaaatggtctaccagacataaaagcaaaatgttccaacatacacaagacattttattggtttaatgtaaacacatatattataaaaatgatttttccacataagttagtaggaaatgttacccatttatagaaacagacttacgggttctatgaattcacagcatactatatttgctctcatttcctcactggctcatcatgcaggagtctcaataaggcttgactttcataacaggtagttctccaatgcctaagcctacctggatacccaacgcctgacagaaggctgaaaagctgcagagtgtgcctgcttctgcacaagtttttctagttccggttgctctaatgtgatttggttggtgtcacagctaataccacattctctatttgatctgatttttcatctgtggcccagacagttgattctgatttttggtcattcttttatagacttgaaagttttctagagaaggcactagtggtgccaggactatcttgcttccttctgtcctgtctacactagcatttaattacacttttctacctcttttctacctctatgccctctcaccctccttcatcttgggagcttccaaaactagaagccaagagaattaactaggttgctttataaaaattgtatatatgtagggtaaacatgacattttgatatacattggattgcttttgctatcaacggcatcatgtagaggtagtagtagaagcatggaagggtagaagaaaggactgagactgatatttggactcctctttcaagttttctgatgtacacatagagtaactagatggcctggactgtctatgtacaatacggaattttaggctcctggaggaaacaaaccaaaacaaaaataaaaacaaagtccttttccttcagtagctttagctttagaagaataaatgattcacatataccaaaacccacaagatacggtatccccaaaaagttaaattgtctcttacctaatagaggatcagaaaaagaaaagatagttatttcctaaaaattgtttgaaccaaatttgtggttttcaaactatgcttcatggtccccagacttacaaagagatgattacaaaaagattatcaaatagatataaataaataaaaaaataaatacatatataatatgtagtaaatacatatatatcaatttgcaattgtgataaaaatgacatgcaaatttaaatgtattatataaatttaaaaaacactggagaccaatgtgttattacaagttaattatgtacaataagaataagcagctttcatgcaggcctctaattaaggctctcagattggaatacaagctgttgaaaaaaactgttacaatatgcaactacttatcagtctcatgatttttttgataccatatagtatagtacagaaagtcttcacttattgccatccataggttcttggaaactgtgattttaagtgaaacaacatataatgaaagcaattttaccatagactaattgatataaataagagttaagttcttatggcaaattttgggtcacagaaacatcatcaagtttctaaataaagatcaaaacacttttgatattaaacattgaaataaatgtgagctgtacatgcatttaagaaagattaataaaagcaagaaataaatgtgagctgtacatacatttaagaaagattaataaaagtaagataattatttaatcaataattccagttcagggtcatgagtggatggagcctatctcagcagctcagggactggtaaggtgggaaccaagcctagacaggatgccattctatcttagggggcactcacacacagccacattcactcagacacacccatgagcctaacacgcacatctttgggatgtgggagaaaacccactacccagagaaaacttatgcagatatggggagaaagtgccaactctacacacacagtggctcactgggaatagttcttttttttttttcccatcagcgttatgacaccatgttatttgagtatctgctatattccccatacaaaaatacattgatttttgagccaatacaataatccaatgctgagtttttattcctttgtatatttgccattatattcttattgaatgactttataatattcaatatgataaataatctgaatttgaaaatgagtttatctcaataaaatattactcattattccatatgttaagtttctaataagatttagtttgaaaagaggattctgcttgtttaaaagaaatatgaaaaatgtctggatcaaataatatatatgtatcctgcaactcaaggcagtatgaatctcatatggctccaggctgctcagtttctgaatttatcaacttgctggcttagaccactgtatacagcagatgcattgggcccaaactagattttatatatgggccactattccttcaggcttaagaacagtatttttatactgaggaatagcttatttatcatgaaaccatcatacatcaaaagaagtcacgttgccttaaacttatccagtacatgaaatttatcaccctcaaagttctagattatcagaatttaatatattagtttaaaatataaccagttgataaccaagaaataagtcaatggaaacctctttaattatctaagcagctcatcttgtttataataattgtataacttacagatacatactcatttatttttcaatcaaaatatattatattgaaagacttcagaagatttttttcttaatattaaccaacattacttatagttaggaacagagtgagccaaaaaggattctcaccactacagagaataaaactagcaaacctggggaaagatccattttccaaaacctgaactacactctatgatggtaacgtttcaagtatttataacacttaagtataagtcaagagttgattgaatgaggcctttcatgatgtttatgtagagtagtcaaaccagaattatttatgtatttgtttatttttaaaggctgtcatttgaaagttatcacagtataaaggtaaaggatacaccggagtttccattctagctccacattcctggctgtgtgaccttggataatttagttaaactaaacttcagttttcacttctgtaaaatgaaggaaatagtagaggttctattgtcatgaatttctagcaagaaatcaatgaataaatgaaatgatgaatgaatgttgcttagcatgttgcctggcacataaaaagctctcagtaaatattaactgtaattaaaaaatatctaaaagccggttgctttcttttggttatttttttaatatgacttgattttattcataacttactgactatattttcttcccttctggaatgatgttctattgaggtttctttttcttttattccagaatgttctctgagcaatctcttcatttctgcctcattcatcagataggattgtaggcgttcattttggtagttctgcatttggttttctgtcactgcttatgctgttttcttgttctaactcagtggtttaaaaagtaaaattcaagtaaggactaaacataagagaatttactgggactaatggttatcaaaattgggcataaagggatgttattaaaaataaatcacacagagggagaacagctgatgacagcagctgtgaaatggatgtacatggtgggaatcagtgagccccaaagaaacaaacaaaaaacactggagggccatgaaacttacatgatttacaagggaaacccaagctttatgaacagcctctgaagactacagaggccaagcaagtcacttctggatgaaaatttggataagacagcaatactgaaaggagttatgttccctgatcaaatgggagctacagataagaaaagaatgagaaataaaatgaaaatctttaccgagtttgatttctttattgtataacctgcactgaggggacaccatctctgggtataccactatagatacacttaccaaatgcttagtgattattgcaatagttagaagagaatatattttaagagccaaagttacaaatctatggacaagatgaattaatattagaacccatgttgagatatatagggcccaagtagtctatgacacaaaagtttgtgtttttatttaaatagaactctaaagacttagttgtttgaaatatatttaatgtagagaaacatttttttgaaaatttggtttactgtaaagatgaatggagatgtctaactttttgccttttttttctagatatggacccacctctctattttcaagagcattaaattcagttaaaaactaaaaacaaaaatactgccaagggattgagacggtaaagtaacatcatgcctgatagaataaactatcaagacagcatgaacaaacccaactgaaatggaacaagcaagcttaacacaagtcaaagaagctctctagagtgttaaaatgaaaatacaactaaacagaaccaaaactgctattcatgggaatagcaaatgaagaattttcttcagaatctacacggataacttctatgagattattcaaaatgtggaaatttttttcagaatttttgtttccaaatggaatttaatacatttcatgaaacaaatgaaattttatcagaaataaaacatttaaattaccaaaagcctagcctccttaggaaggctgttttaggaagacatgggtagaaatattttcatcaaagccctgatcatcttccctttttgaggtgaaatcactctactctgctggaaacctacatttagttatttataaaccagtattaaatgtatattgtttcaaatctctatgtaggaaaaatatcccacattcattcccattttactatgaactgtataaacttccaaaatcatcatgaaaagaaaaacatcaccctttctgctaattaagtgttcttgctttttttctagtaatgggtatttgaaaaataacaatatgcaagagtatgatcttacagtgaatatagccactaggtcaatatgataatttaatgtgagactttaaaattgagctttccttttatgctactattctctaaataacttctttatttgctatgattaaaatatcttttcatcaaatttgatataaatatactagatatggtaaatatatttatcatttaaaataacaattgaattgtacaataagcactatatcattgcccaatttttattttgataaaatctttttaagtgatatcatttcatgttaggctttttgtgctgcttaatattataattaataattcatatttttgtctttctcctctctgacaacttttatttttaatcggtgggcatgtgccaaattggtttgttatttatttataatgtaaaatgacaagggaattgaatatgtgaaataagatagattttctttcatatgacaaaaatttcttagtaatggggatgcttcttgcttacccttatagattcaagggttttagagaggttaggtcaaatgtcacacttctcatataacaacatgtggtaagtgcattaaatagactgttcattttttaaaaattcattttagttttgtgaagacatctgggcacatgcataaaaaacaggacaaaacaatatcaaaatttgtaaaagactccctattccgataaatcctatagtgtcaattaagtaaaaattctgaccaaacagatgtatttgtattctttcctaaaaactaaaacaggcaaacgtaataggaataaacagagaacgtttcaaagatacagaatttccattgaaaaaatcaaatgttctgtctgtaggactttatagaacattaaataatcttttcagtactgtccataaccagaaaccacataagctggatgctagactattgactagttatgacaaaaaattcacagtttgatctcaagggcatcagcgatcctgggctcaggtgatcctcccgccttggcctcccaaagtgttgggattacaggtgtgagccatcatgcctggccatcgtgccaacgtattgaagtggaaagaactaatgctgagcagagaatgggccatacctgggtggttttaagaggtgctgctataatgaaaaatcacaggctcacccaagaactaccgtggaatcagaacctctagggatatggccctagaatctgaattttaagccagttcctgaggtgcaattcagtttgagaactacagtcttaaggcaaaacctttctatcataccagagcttccaattgtcaggccctttgaatccaccctttgtgtcaaaccttagataattcaagagacataacaaacgtgatcatgttacatgcttcctcacagatttcagtgtctcccatttcttctattagtttaaaaaacatagtccaccatcacagggccctgtttaagccagctcctcctctgtggctctgcctttgtggtcaacctgtgcaaaactttgaggctgtgacatcacttagtcagtctccaacatttggaacaagagaactttttctaacaatttgatcccaattcctattttaagcttgagcattatgaaggctgtatctgtatataatattgaacacttcaaaacaattttagatcttaattattttgttattaaaatgttgggggtgtttaagttgacattgagtcagatgtaggaactgatatacagtgaagttaaatcctttagggtaaactcattcagtggtagaggctgaactacagagcctaggcattctgacattccaccactgtgcttatcagcttgctccttgagcaaaccttttcctgcctttatgagaatatgcccattttatgggctctgtatctatgagatattttacctatgcttatgtacacatggtgtttatctttcaaagctggactatggaaaagcctaattttacaaacatgttagtaaaagattatgtaatctgaggtgattacgtttaaaatggcaatgataatgatgttaattccagtcctgtgaggtactgtttctgatctggaaagagcagttttcttttttaacagcttattttgtattttcataatccattttaaggtttggtattaatatagacatgagaaataaaatataactgttgccatgccaaatgtatatcaaaaagttgctaatagccatgactgctatttggttaactgtatttcactatttaaataaaatgatggaaaatggtgtgtctaggatctcattcataataatgaaagacaatagaaactattagcataggtatgatgctaatgaatggtaaattttcaatagagatccatcgaccagattgtttgaaaaatgtttcctgtgggtacgaaaaatgcacacaaacaaacacatgcatcaaaatgtccataattaagtttttagggaaaaataacaatatatgttggttaaggactttcacttaaatggcattatagatctttcagaaatgagagttgatttatacttcagtattttggttcccaaaggttgggacagtgggtggtagaggagaagtagagtaaatggaaggtatacatgtatgtgtgtgcatatgggcaactttaagcaccttgaatttaatgaacaaaaaatgtcattattctgtgtttatatatttttgtgtgaaacaagtacctttctctatcactggagtttacatggattttctcatgatatcttttgagaatctctttaaacactaaaatacatttttccaaatgaaaactcccataattctgctttattaatatctgaatgaatatttccattgatttgtccagaagaaggaactgagtactgtttagagagcaatctttttcatgataattggcagcaatgtttccctgctatcagaaagaaaactatagaaatacgaaactttagataaacatggagataaaaataatattatggagtccaactggtatctttgaggtgaggacaggctgagatggactccttggcttccttctgtccaaaaatttcctgtttccctatttcctacggttaccaccatggaacatgttaaaatctcagtagggactctgtttcaacttttcctgtcaaaacacagtgaaaaagcttaatggaaaaaaatgtccttcctatctccatgccaggcacagtgtaagatccacaaacttaaaagccaggaaaatattcttttatgtgccccaaagctgggcaagtgacctagtactacaaaaattcccaaataggcatgtgacctgactaatgtgtgctgtgagatgagtcaagaaaaatggaaccatctgtacttttattggacagtcaaataatttctttctgtccacccaaaaacataatttctatgttaagagtgatacaaggagacttttagaaagtctaatttttaaaatcagagatattaaaatatatgaaaagtataacctattaaacactggtggagataagcaaataggcttatgaaatcattattgctttaaaaatttgttacctactcattgtgtactaaggcttctctacgacatacagaagaggccggtgcggtggctcacgcctgtaatcccagcatttcgagaggctgaggcaggtggatcatgaggtcaggagttcaagaccagcctggccaagatggggaaaccccgtctctactgaaaatacaaaaaaaaaaaaaattagctgggcatggtggtgggcacctgtaatcccagctactctggaggctgaggcagagaactgcttgaaccttggaggcggaggttgcagcaagccaagattgccccactgcactccagcctgggtgacagagcaagactgtaaaaaaaaaaaaaaagaaaagaaaaaaagacatacagaaggaaatcagggaaaatgggaaaatgaagggaattaacaaattgcaataatctttaagaagtagagtatgaacaattttccttttctaggatgaaagctaccaacaactgaactcttagagtgagtgatggcagaaaaaaatagcaatcaagaataggggcatgttagtttttagacatgtttacaaaactctgccttttatttcttaaacccataggtcaaccacccatcatacctacattaccccatatgacaagtggatttgttgtatgtttcaagtttttaatcttggtgggaagggggagggcagagaagtatttattggtaaaatatcataataaaggttgagcctgtcaatgattgtacctaacaataataaatatgtgtaggaagtaagaacggcaaaaatgaagccgggtaggatactgtggatatggtgacagacaagtatctatacgaaatcctgagatatttgtcctccatttcataaattaaagtgccccctcttttgctttacagataaggaaactgaggtgcattataatagcaacagcagctgatgtgtagtagatccataccacaagccaggtacgatgtcaaacatttaaatgtatcatttaatttaattttcatagatctcctacaagacaagtgctattattttcattttacatacgagaaaactaaagctgacagagattaaataacttgtccaaggttgcatagtaactaagtgaaagagccaagatatgaactcagatctgtctgatttcaaaacccaggcccttaaacactaggccagtggttttttaaccctgattgcacattagaagcacctggcaagcttttaaaacctactgatactcagaccctaccccagaacaattaaatcagaatttcttgtacctgggccctgatgtgggtgtttgtttcaaagcctttctgggtgactgtaacatatagcttgggtaaagaagaattgttgggtgtctcccatggaggtcagtatatctgtgccaatatgtgaggtagtacaagactcaagtgtcctcagtctgtctgcagtggtttttcccttgccccatcatgttcactttgacatcttttttttattatgatttttggagaagtaatatacaagtgacaatttttttacaaagcattgtcacagcagaacatggtcataagtccatcaaagagaaacctgttcatatctatgtacaggctatgatgaatgaatacaaagaagactatgtttattactctcatccccaaagggaagtataaagctggccttaaaagctgttcataccaaagctaatcactaaaatttggaatggcttcctcctctcctttcacaaatgcaatagggtagccactggatctaaggggaaaagatccaattaccactctttacaatgctttttcacttaggatctcaagacgactgacagtcattcaaaacataaaagtaaagtgaaaatatctctagtagaagtgaaaagaaaatgtctgtagtaggaagaaggcctaaatttgtgtctatactctgccactttactgcaatgacttgaggccaaaagtaaagtgacagagtatagacacaaatttactgccatgacttgagccttgatttccttttctatatgtacttaagccatatcatccttagggcagtgatccaaaaaatgtggtccccatcagcatcatgtggaaacatatcagaagtgaaattatcagtccctaccctagactctgaatcagaaacttggtgaaggggcagtaatctgtgtcttaccaaacattgcaaataattctgaccacctccagctgactctgatgtatccacctccatggggttgttgtctaagaataaaaggagatggtccataaaattgttattttttttactatctactgaaatcagaaatttcaaaattctctcacagagatattttagagaaataatgttacagcctacattagttagataataacctcatttctgaatttcactttgaatgtgtagacgaggcacaagtcaaccagaggttatgcaattagcttggagtcaaagagaaagcaaggagtagagctgagaaggaaaccccagtgtgaacttgatttttattcaatcaaactgttaaggtaccaaccacgcactttcatctataatcacaatgaaccttttaataaacatgtttctatcctcttagcttaaaaaatataacagtagctttttggattttaaaacagattgacttctatacttctgggctaaaggcagctcaagagtcaataagaatcacaagctttccacagtgagaagaaagtgcaattgcccagtcctctctatctatgaagtgcagacagtattcctcttcctcacctcacactttcgattattgcaatggtggaaaccatgataaataaaagcgcttatctagtggtttggttttcactaaaattacagacttctgtaacattatttggataccataaaacacaaaccaaattttaggagatgctttagggtgttttttcccctgccctcctgtcggaagccctctatctttttactgtaatttatctgatatagctaccaagatgcttgatacttttacatgcaagggtgctgaaaaacaaagagcgagggaatgggttgttaatgaaattctctgattgtaaaaagcactctggaatgatcaggtggtaaataataataagaggaaataacataaagtgcttaggtgctacagcgatagtcaccatataaatgcagaagagatcagacatgaatagaatttgcattttatgcagctgctgtgtgtgtatatagaatatacagtagctaatttttcaataatgctggtaaaatattgttcaaaatctattcttgctgtcttctcactttaaaaggcattatatagaaaaacacccatctgtcctagtgcaatggtgaatgtgtgcaaagagcctagaaaaagagcctctttgcatacgtgaaaaaaaagaactcaaataaaaggagataatgaagaagagacaatagtaacactattagaacagctatgcagacaagcacaaaggtgatctttgaaaaacatcagggataaataactctgttaatgtgtggcagagaaactacagttaagacatacagtaatataccaaaaatatagacatgcttttattttgtctactgggctattgtgatagtgatggttgtttttgaatagaaaggaagaagagagtgggaagtaggatttcgttgtttgttgttactgttgctgctcagtttagaacaacaacatcaactacacaccagacccgtccaacagttccacaaacaatgcttaccatgaatctgccctcaattttcttgttgttattttcccttaatacttattgataacccaatgcccattcattagatatgctaaatcctcgtccatggttactctcctttggaagagactgagaagatgctaagagggagttcctcttacacataagggaagagtctgtttaggaatctgagaaagcagaggccaggataaagagaccactagtcaatcaatactaagcaccgaagactgaatcacccaaagatacaattatctcccttcctttgttctgtctcttagtcaaataaaggattgtttgtagaaccttttctgttcctgatctctaaaaagcaggactggacttgcacatccaactataattcaaaatatctcacacttccaacttgaaagaagacataaactgtttcaaagaaactcagagagagcaaatgcatattcacaaaacttacacttattcctagaataggaaaatggagagagaactaaccacataagaaagggctaatcataataataatagtaataatgatgatatcaatcaatactttggattctagagaatgatttatcacaaaaattcacctgtattaagggagactccaggacaaggaggtcattaagctacatttccatcttcaggattcagccaaactcagactctccggaaagctgtaaatgctctcagaacagactttagtaatgagattggaatgaacactgggcctatggcgtaaaagcatctccctgccccttgttctaaaagttaactattaaaccatgtgcggttcatcctgatttggtttactcaattctagaaacaaggacatgctgatcagattgccctgggcaattgaatacctactgaagcctttgggaagacagtgttcttcccaccacccctacttaaaaggcttctgttaccagactatcaattctgtgttactggtgaaggatagaaagtatcttcttttgaaggacaagtttttcactcactgagttttctgctttgggtatatactcaacatgttaagtgcttaatcttttttcccccattcccctttttctactgtagtgtgttttgtttgtttgttttttgtttttgtttttttttaattatttgaagagtcacttgtctggatgcttcgttctagtagaatttggctgatttttttcccaacaccttttagtggaatgcagtaacagatgcatggagggagaattggtcttaacagtatttttaggtttcatctgtgtcagagagagatctcttccctttattgatttcttgcatacactatccacactacagcttgaaacagctacaacagtgtttgaaaaattggttgttcctcactgttcaaaccatttttcaaaacagtcgttacaagcttcattttactttctgttataaggagggttttgtttgggttggtttcattttccttgtggcgtcatgctagcagagaaacacagtcaggaatatagcttttaaatgtggtatgattgggattataaccatatcagaatctatattgaaaatttattagattgagccatgtgcagttaaaaagaaagaagtcagaagtcttcgatatttttcacaaacatgaacaccatctcatgcaaacgttaaaattcaccaaacaaatgataccccactgttggaaagatattttctcatgtcaacaactcaggaaggagtggggagggaatgggacatatacatgtaaaatttttctctatatttttgataataactctctgtgaatatgttttactacctaggtaatgcttatatttgtaaaaacatatagttatatcagaaagtcaattttgaataaacctgagaatggcaaactataatttttaaaatactaaccttttagaactgttcattttcacttttatttccaggactcactatcttaaagagaagaataaaagttgaagatccttgggattaacagaaagggtggaaatagccaaatgtattcatatttttggccaggcgcagtggcttatgcctgtagtcccagcactttgagaggctgaggcaggcagatcacctaaggtcaggagctcgagaccagcctggccaacatggtgaaaccctctctctactaaaaatataaaaaattagccaggcatggtggtacacacctgtaatcccagttcgggaggctgaggcaggagaattgcttgaacccaggagatggaggttgcagtgagcaaagactgagccactacactccagcctgggtgacagagcaagattctgtctcaataaaataaaataaaatgacgttcatatttttaaaatacagcaatattcatttgtttaaaaaacaagattgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaaaaaaaaaaccaagattgagagcacagttatatagtgacttttgatacatacacaataaaacttattgaattttcaaaaagtgagaaaaaaactactctgctttaaatttaaagtaataaataataatgaagacatatcaacattggtaactgtcagagtgagaaaaggaaattgaacattcaatgtgaccagaggaagggtgaacatgggagatactgcccaggaaaagtgctcatgatgagtaattcaaagacccagaatcttaacataaattttttatagttttcttttcaagggactatttgaaaaaagatggttctggggtttttgttgtagcttctttctttctttctttctttctttctttctttctttctttctttctttctttcttctttctttctttcttttctctctctctctctctctctctctctttctttcttttggctttgttgtagcttcctctttctctctctctctttctctttctttctagctaaaatttcactctaaattccaggaaattttcacgagatccttttagaggttctgacacaaataaagtaaaagtaaacctgttgtggcaaagttactaactagtctacactaactctcagtccttgctcaaagcaaaataatggagtttggggtgcaatctggtgaactcaatggtccaactgcataaaggcaaagaggaaagccaggcttgggcacttctgtagaaaatgaagattactggtttgaaggccagtcttctcactgcttcactgtatgtggtgactattgttaaattagatatccctattctgatgaaaaggcaatgtgctatttttggggtatacatgtttcaagctgtaaactgcaaagtgctgtataaaagtaaagtggtgttaatgcctcataagataaacatatagattgatgatggaggcatttaaaatgctttaattgcccactttaataaagcactaaataattataataaaaacaattcttcagaaaacttggtgggaaaaaggcctacaggatatgtttgttaagaataattagattttagttttggaggaaaaggtaggacaagtcacaggaggcactcgatgagaagtcaggaatgcctagtacataagccacacatattaagttgtagtttcttcaaaactgacaataacatgtcctccaaaaccaaagggaaaatcaaaggatgttgcctatacttatgtaccttttgctactggagatctagtcaatctatagccttggattcatagttctataacatgacaacatagcaaaatctcaccaacactttgttttaaagaaattggcagctgggtgcggtggctcaagcctgtaatccatgaactttgggaggccaaggtgggcggatcacaaggtcaggaatttgagaccagcctggccaacatagtgaaaccccgtcgctactaaaaatacaaaaaagtagctgggtgtggcggtggatacctgtaatcctggctacttgggaggcagaggcaagagaatcacttgaacccaggaggcggagcttgcagtgagccgagatcgcaccattgcactccaacccaggcaacagtccgtgactccatcaaagaaagaaagaaagaaaaggaaggaaggaaggaaggaaggaaggaaggaaggaaggaaggaaggaaggaataaattggctatgcctccaagtgaattatactataaacttctttcccattaccaataatgtaaatatataaccaggcacaagcatgtggaaatggagaaaggatgaacgttagtcttagaaactttggtttgtatcccatttccaccttttaacaagtcatttagcctctctaggtcaagattttcttacctattaaatgaagataatggtacccatctcacaaaattgttttaagaattaaatgtaaaatgcttggcacagagaggtcactcaatacatggcagccaaatcaccacatgcagtaaaacccagataaaatatattcagccaggactgttgctctgtgagtaggtctggtatccatgctacaaaatctattaagcctaaataatttggtcattttagcaatactctttagagattttttaatgacatttcccaaaggtcaagctagcttatggttatgtggaactgctgcatttataagagagtttagtgggttcataaaataagtcttgctccccaaatccggatcataaagaccttctatcataaaggataagagtgacatttaaaaaaccagtttttaaaaaatgatggtagcaaataaatgcagatgatcaggatgacagcaagtaccaagtcaaagcaacacggagaagaaataggccctagcctgcaggttacactttaaacactgaggagaaatgggagagtaaagagcaacactgagcctcatcggactgtaggtgaaaaaagattcaaaatctgactctaaagcaataggtaaagaaatattttaaaatgcttatctgtaggaagaaaagcagtaaagcagaattcctaggaattgagaaacacttaggaagaaaatgcttaagtagtacgatccaaggtgaggctagctgcagaaaatacaaatatttatgggttaaatcaggactgaggaaaatataaagccaaatatgggcagctctgagggggaaaaaataggcagcttggtactcaactgtcatcacaattcatttgtgtttcacgtcccactgtttgtgacattaacagaattttgaatttagcaatggactatttttgtattgtgaatctctgcagccattttccatatgtagctaccactgtaactagcaataacagccttttgagctttaaaatgcttccaattaataagattcaaaataggggtcacctaagagttttccaagttaattccctttgtctactctttgaagcagagtggtattcctgctattcatttgcattgaggccaaattatttgaccatttcagtaagatatccttaggtagcttttgcttttattgtcattttccaaaggattaagttagttttagatttttgaactgcattttcatttaactaaaataactaaagcaatctttttatgagggtatttaaatagatcaaatttataccaagttcctactgtgtgtcaaacattagcaaagcaatttaaaatgttattatttatatatcaatacatacaaatcatatgtgttatatattaatgagcttatagccattatacacaggacttttatgtgttattattgttgtggttatttctgttgttcgcaggtatcagttatcaagtacctattatgttccaagaactctaccaaggactatacacactcaccatgtaatgaagatattattggtttattttccatttgaagatttagtcacaaaaagtaacttgtccatgagcatataatttgtgcattctcttaaaatcacttaaacttccacgtaacacctggattgacgtatgctttttcttacaaaatatacttcaattcaataaagattctttagtcacctactatgtggcacctgctaggatagttatctttgtttgctattatgctaaatcacagatctgaccattagaatctcttccttcctgaaaataccctctttaggtaaaactgtatttcttatcattttccatcactgattgaataaagaaaggtggcactatctggaaaacataagagcgttggatttacaagtttcttttaataaaacaaaccaagttaatcacaaattgttgcaacaaaatatgtgacatgaagggcatttaaggcacatttagacattatttctatctagaaacagaaatttagtccacataatgtcatttatctactgagctaaatcgtattacaattttcatctataaaatccagattcttaatgtgtgttggaaagataatatctctgacccgctctcagtaagaaatgtgttttgaattgttttgttagtaataataatggagttgtactggacaaaatatattttcagcaagtttctctggtaataaaaataactataatagtagtaataatactagtaatcaccaataaataatagatagcatttattgaactctactatgtgccaggtactgtgattagcactttacatgtattatcttattaatttctcaaaatattacatgaggtaagtaccgtaaatccaatttaacagaaaagcacattgagatatagaaatccaataatttggtaaagatcacacagatagaaaagaggtacaagtcaggattggaacccaaggaatctgactctcgtatctatctactctaggtgggggatatagcaggtgctatggtgtttgttcaagagaatactccatttgtgttgttttatctaccttattagggttggggcccatttggtctgtaagccaaatctgaagacagctgaaatgagttaaggtttgaattagtgctattcacactatctgccaattaaaatgctcccttctgagaagctgtagccagttggcataaccttaggacataatacatgctcaaaaaagtatctgatgaatgttaacaatggtttctctaagtggtgattttactttctttaaaaaatactttttcctattgtctgaaatattttcaacatgggcacattacttaggtgatcaaggggaaattcaggactttacttaaaaaatgtttttgttttgttttacaattaggttgttagtctcagttaaaacataactcctgctgggaagcctttcctgttgctgtactctctgaccttttgaaggacagtactccttactctgtctgcctcagaaccttatgaaggccacatactattgttaattatcagtcttctctgctttatgtgaagtcccttgaagattgaccccattacttatctacctcttagagctctaagcatcttgagtgcctaccactcagttcaatgaaaaaacccagaacacacatacaccagaacaagcacaaaagatgaaaaagaattattttagggttgacaatgcacactcttggtatttgcagatgacttgtttctccccttacattatgtgcaggtccccatggaaagaagtttcccacaagaagtgtcttgaatttactggtctcttctctggaggattttacaaatgcatcaaggaatacacacacacacacatacatacacattatgaaataatatgaggataattagaagtaatggggaacacaggaggcaatttctaaaaaatgaagcatattttttatatatataatgtatatatgtatacctgtatataatgtatatatgtatacctgtatatataatgtatatatgtatacctgtatatataatgtatatatgtatacctgtatatataatgtatatatgtatacattatatataatgtatatataatgtatatacacatacatgtatgtatatatatacacacacgtatatatatatatatatatacacacacacttttttttttgagacagagtttcgctttgttccccaggctggagtgcaatggagcgatctcagctcactgcaacctccgcctcccgagttcaagcgattctcctgcttcagccacccaagtagctttgattacaggcatgtgctaccacgcccagctaattttgcatttttaatagagacggggttttgccatgatggccaggctggtctcaaactcctgacctcaggtgatctgcccgccttggccttccaaagtgctgagattacaggcgtgagctaccacacccagccacatttatattttatattaagtaattttgttcctttcctaccccattataatataaacttcatgaaagtagaaactttattttattcactacagtatccctagtccataaaagaaggcatggcattacatcctcaataaatatatgtcgaaaagaaggaaaaaggtatagatgtttccactgtatttcttatatttttctggaaacaaaggggaaaggtgttcccaaaaggtttccaggaaaacttcaatcaccaatgaaactgcaagctcttgtcatgttcctcagaccactacctaattaattcctttatgtgcaatacatcctttctagcctgttgatactcaatttctggcgctgctgtaacttgtggagcaaagagtgccacgtgagaggtgcttgggccccttcatactgtgcctcacctgcgaactggggaggccactgccatttaggctccagcatcttttacaggccagctgagccaccagaagggaaggggagaaagagacatgcaagttctcagaatgtctggtatattcactcacacacatttctcttctcttctcaaaaaggatcctggcaacaaatcactgattaatgatgagagaaatggaatcaggaggaccccatgataccctctcatcctagttttgggagataaaatctcccactgtggggaggaggaagaccctacagggttttcttatgttttgcagcttccaaattgtagtagggtcctattctataaaattgctaccaacaactgtatacttagtgatataataccatatggaaccttgagttttacttaaagagtagattatgtggcaattcatagttatcctagtatggataagaaaatatcctagtaataacataattattctagttatgagtttttttcagacaagaaactcttttattcatctttttatctctagtgcccagactcaacatatgactttgtatatagtagttcttaataaatgatagcttaaaaattaaataatatttttaaaatggtgagatatggcttaaaggggttcaaacaaattcagagttttgtctaatctaggtgtttctagatttatgagcaggcaatcacatattattgagtatgtattagtgttttagttagtgttaatacagtataataaaccctcattgattgttgtagagaaatcctactattttacactcatatactagaaatgtttaaagtcacaattttaaaatagtggacttcaaactttattatgcacaactaacctgggcagtttcctaaactgcagatccaggctacattctcagagcttctgatttagaaattctggaatggggttcaggaatctccattttaacaggtgctctagataatcctgatataggtaatccctaggtaatcctgatacagttggtccttggactacttaccatggactaggctacaaggtaatataataataaatctatacagttcaccttttcaatacgaagagaagagactagcctattaaatgtgacttaactatcaaaattacccgtgaaaagaataggcaatttgctaagacttctcaaaatgaaccaagggaggacataagggcgagaaatattaaatttcaagccagaaatgactctttttaaaacttcaaagagactgacaatctgcttaaagtaaaagtggaagaagaatggcagcagtacagaagtgttttatgaacaatttaggaaagcaacattgattcaagaggtttatttgataacatgttttaatggttattataaaagtgaatgccttctaatctttgatttgctgctaaaatatatatgtatttatttacatgaaattttttttttaaattccccccttaactccctactttccacacatttttagcttgccaacattactgcgttaatggtgtcctttttttctctctctagaaacacatgccctgggattaaaaggggattactttggtctacttccacatccatgtcccagggaaggtactgcttctgcttccgacctgacctttaggtatctgcagccttcaattctttacagtgggagttgctttagcattgatttcttggaaaactaagagctgttttcaaaagccattttcaagacaaataatgaaaattattttcttatgcttatggatgttacaaactgtgtaacaagcttttctctttaactttgctgcaagaaagtttaaaggcaactgtatagcacttcactgaatatagttttatgctgacctcacttctaactccatttttatatcctttcctttattgttttatttttcttacctatttctaattcatgtattttgctgcaatcatgtatttatgtttattttttcattgtcagccattttaattcccttattggtgcaataaatagtaaataagacaaataaacaaaacaaaaacatatgtatgtatgtgtatttggtatttacatcgcatgtactcaaaataaaaaataaaaactaaccacctaaaataattgacatatttcattattctttgggctatagattcacttgactgcagcacttccatttagggagatataaaattaaaataccaccatgaaaaaatccatatgaaatttgacataggtattttcagccccaggtcattaattcagttctgactgacatctttcagttctgttttaaaatttttgtgttcagtctttcgattacacacacaaaaaagttttggcttaatcagcctaataaagtgtatatttctgaaaacatttttatgtaaacaaatatagaagtatacatgatacatacacatacattttttacttagagtcttcaaaccaaatatttcagtcctttgcttccagtattattttcttttaagtaaatacttttcattaagcaacaaagagtgatagtcatctcaacaccaaaaacttgtattcaggctaagtttagtctactttgcatattttcctctgagaatgatccagccagtctcagtctgattctagtaaaactcaggtaatgtggaagaactctaattgagtattagacattttaacaattatattcatattgatatgtccttatacgaccactctaggtgaaatattactatgcttgggacttaaatatgatttttgttcttttattaatttctgaatctcatatccttccagataccaaaggaatacagtaccacctgggaataatgtcaattttcactttaaaaaaatattttgttgcttttcccctcagcatgggcaaccaatagctgattcatactttcattacatcacagttggattacagaagggctctttagtctggcctccgcatgtctcttgcaactcatttgtagacagcccagaaactagcagctggacttcatttttgttccagcagtcaccattttatagtgtttctctaagtcactgtgagtttcactgatgacaagtctaaaactccacaggtattcatatttagtgggttaaatcagagagaaaggattatgcttaactttctataggttcatgtcactcaactatactttgccattcacttaccatacgtcaaaaaggtggaataatactattcttacatagaggactaataagatatacttagcaaaagtaggtggttgcaaaacatttttttaaaaatcagagtgctgtatttttaaaatcttgcatagaactctggttcaatttttgagtccttccaatttctcataactctgtggtattcataataaagcaggcagatggttaagtctctgaacatatgctttaaatgccccctttgctatttctaaataatggaccaaattttgccctcaaatagtcacaggaaactttaaggaggctgcctcttgaaatctgaggacagaatgtgatccagtgggaattaaacctttaaaaaatatattttctaaactttcttatgagctctattccctataccaagacaaattacattttttaataaaataggatatagtaagagaaaaatcctaaccaatacaatattacttggctcaaggaatagattagaaggcaacatatgttttatttatttatattttaaaattctgattttctaaaacatgagagtcatctgattaatttctgtgtgattaccagattttccatttttattattattcctattactagtatcatgtagatgttatattgttaaaacatcttgcaattattaattagttaatttagtttaaattatgattatgcctttgttttaaatcaatgtttttcatagttattaaaagccaaaagcactatttttccagtcacttactttcatttcaaaaacagtttgttgtcgatgaaagcgcattttccaggttatcacagaatatgcaattcatctgcaatggatatatatattctggtaatgttgctcacataacctagctgtacttgtaagagtatctctgtttcttaatgtctatattttatacatggaattaaccttcatttgcacactcatatttctatgtatttaaatttattcctgaaagacctctgaactagtctctcctgtcttacgatgtccacaaaacttagcagtctgattaacattacagataaaaagaccacacaattgacaataaggacactttagttattatagacgtctgaagtttaagtattccaaaactataatgtccctttagaaattctcaataaggattagcttggtcctaatgaaaacagtgtttacttttaaaaataaatgcaatagttgtacccaaatatgttcgaaacactgtatgacgtgtcataatcaacaatgttgaaaataactaaagatctttaaatcaagtgataattttacacatatatccacaaatatctgaacaaaatttataattactattgggacaaaacattaacatattcttctgctaataaagacaaacaactttgagaaaatcctctctcattctcacgtctctaactttcacaataaatgcagcactgaaactaaatttccaactcagaaatacgctgagctccaataaacaagttgattttaaaaactcaccagactaacagttatgctttttcccttatctttcctttgctttcccttgttctttcactttccatgcacacacaatcacacttacctgcacaagtctgaaacatcagtctatgtattttttttgaaatgtactctgtaccgatgcatttttctgtgtttctttctaaccctcgagaatgttaagaatttaggaagagagccacagcttaagagtgcaattatttgccagtaaatactcaatttgcttgtcctgtgatttttcttctaacttgcatattcaataatccgtccctgactgcgtcacgagcacaaaaagtcttttctccaaaggagaagactttcgccaatcaaccttcagccatgccagggcacagcttgtcagggtgatttgttagctttaattaataattcctcacactggccattttcacaaataatgcagtgaggctgggaggctagattgctatgattcagacagataaaactacagtggaaaggggatggggaggggtgtgggggaattcagatgccgtttataaacacctctaatcatactctttcagtttacaatatagaggacatctcagttgaattaccacgttatgtccaccaatttgtattcagatggaaaccatatgttcctccactttatctgctagggactccctggtgccaacacagtcattgggcagacaacattcacaaaagaggtctctagcctctggattgcaaaagtttactgcagggtgaagttgagaaatcagacatatactgcacttctcagtgagcttgggtaacagtctggaaacacagaagtatgagttatgagtgtcagattttctcttatcctgctatgtgatactgggcatttcatttagccttaaaaaaaaaatctcatacctcatcctcaaatcagtttgcaacaatgactgatttgttcatgcattctatgaacatttattgactcccaaatatatgctacacactgtattaaatgctgagaattttgcttgaaagtaagacttttccatttaactgacaatccatgggcttgaacaaagccaccaaacagatagtgtgcaaataaaaataaggatttctaacagtttctgtgtggctcaaccaaataatcagtaattgacaacacacttgagtccattatgcaaaagtaatgctcggggtaaaaaagaatatacagagattaaaaaatatgtttttcaaagattaaaaaatttccctcaaagtgactagagcactaagaaacatattaatatgttcataaacaatttccaaagattcacaatcactttaggaacatacaaataaaaaaattttattaatgtccttaatcttatataagaatatatgcctgtgtttgagactgcaaatttattaatttattggatacatatttattgagcatctactctatttcaggaactgaataatattggagataagtaaagcacagcctcgttattcaagaagctcacaatttagtcaccagactctaaaagagaaaacacacatctcaactgaaaactgtaatacaatatagccagagcaatgacacaaatatacataaacatgtaggatgggcctcctagaagtgatgcatcaactatttgtaaaggttgggtagaagtaccagtggtgagaagaacattctagggagaggcaaacctttgaaccctttctcaaactgttactagaagcagagcaccagttctagaaaagatgggatttaatacatgacaatttcagataaatgtttcagatggtaaatattgcaggatttaaaaataaacttattaagaaacaaatgttccccaaaactataatgtcttgatatcatcaaaaaagcatgcagcatctctagcactggcacatagtaacatacatgtctttctcactttgtgtgtttcagttctctgaggcaaacatgaaacatgcttgacacacactgcctttctgtgttttcttgcctatttatcttcttttactatgggcaggcttctactgcttctgttttcactgtaccataagataaatcatatttgcatgactgttaaaggaaggggaaaaatctgtgtccattttgtggtcacacatctacttctagtcagatagcacatgctatatgggactaagagtgcaaatgttaaatgagaaaggaaataatactcctaaacccccaaaaagctctttcatagatagtaaatactcctagaaactatacagaattcttggtgttatttaacattttgctttatattatatttaacagtgtaaggcaacagccagaatactatttaccatagttcagtaacatctagccatttaaagaatttacaaagtttattaattcattaaatatgtatgtattgagctcctactatatactgagcacttatcagtaaatgtttgatttttattcccacaatgcttacacataataatagttaacattcattgagtgctgactatatgctagggactaatctaaggactttacatatagtatctcatttaattcccacagtaacattatatgttaggtactattaccacctccatttagtatattatgaaactcacaagtagagaagctagatatacactatgtgaattcattctacacaatgagaccagggcaactaatgtccaccaaaaatcagatttattactttatagttacacagtcacaagtaatgtttatgttgtgaaaattaaagaaaataagtccgggcacggtggctcaagactgtattcccagcactttgggaggctgagctgggtggatcacctgaagtcaggagttcgagaccagcctggccaacatggtgaaatcctgtctctaataaaaatacaaaaactagatggggtggtggcagaaagctgtaatcccatctacttggggggctgaggtaggagaatcgcctgaacctgggagatggaggttccagtgagccgagatcatgccactgcactctggcctgggtgacagagccagactccatctcaaaaaaaaagaaaaaaaaaaaagaaagaaaatgatatgcttaatgtgcatagcacaaaatctagcccagaataggtgtaaaatatatggcatttgaagtattcagagttaaagattaccacatacaactaagacttactgtttctggaccaaatgaccatatattattgaagcctatcttagacaataaatgtaaataaatcttagctaaagcaaattagccttggtagtctgggagggttttcctttgaagatgttaataatatagttgaactggttgtgtttaagaaagcagagctgacagacaaaatagagatagatgacacaggaactcaccagttaataatagaaaaaattcttgtttttccaagtgattaatacaatattacattgtatttaatgtagatgaaaaagcttatttggtactcactggggaagccaccactcagtataatcatatgctcttttcaaataatcccatgctgctaactttacagctaactgccagcatttgccaactccgggcactctgatgccctctccacattctttcttctctcttgacattgactaagtccagccacccataattcttgacctaaactatggcacaaatatccatgaaacagaacatttatttttggtgataaagctggttctagatgaaatggtggtatttctttatggaggagctgcaaggaggctctcttcatttgcttgtgtgtgtaagtaaagtttctgatttgggataaaggactgcctggaccctcaattattggtgtttattctatggatattggctgagatattttgtatgggaaaaccagcagatgagttaatgagcatccgtctgagccatactaacctagtggcacctcctgggaagccagggcgttctagaatctgtttatttctcaaatgaaaatcctaattcatagaagttaaaagtatagaagacaacttcacgtactctttcttcatgatacctggattggttacaacttagtaaaattttagcctgtttggtccctccttccttactggctgtctgagtctctagccttatataggaaaaccttgtcttctaattgaaaatgatgacaaacagaagttatgacagacacatttcaaagtagatgctatttttcccaaataaatttcacatacattctaattcctaaacttatatattttcacatactttatataaatacctgacaccttaaaatgttttacttagtgagacctagataatgaaggaataaaaaggtgacttaatcccagtttttctaaacaagaagtttagaactcacgtattttaaacttgttaagtgatgatcaatataatgggctgtatatttggttgagagttaaaaatctaaagttttctcagagtactttaaggcattgctttctcagtggaaatcttcgaccttcacattctcaaaaggagaaaaatgtttcttgtcagaaaactagtcatggctagtccataagaagaagtccaagattgtatcagcttccctgtgaccttgctatgagatttgctacaagtaatttaatgcttttctatgtctcagtttactttttatctatgatacctcaatgatattattaagataatgtggatcaagtgttttgatcattgcatagaacatatgcatagaacatagaatatagaaatccccaaatataagaatgaaaacttaaattgttagaatgacactaactctgctacaaccttaaatagcatatatagtacctcagtgtctccatttttttcagctataaaatgagaatagtcatctttatgtttttcattaaacagtatattggaataaatagagattattacaaaatctgttgaaagatttcaacaaaatgtcatacatgcaagtgaggtgatgaatatattaattggcttgattaaatatttctaaaatgcatacacagatcaaaatatcacattgtaccccataaaaatacataattatttttcaattaaaaataaataaataaaattaaaatgtaatcaaacctctgaagctgattttcaaatatattagaggaattgattttaaaatatcaaagcgtaagaagtaaatgttttcaagcatattcagacacttatgaaggaagactattaaaagacagggagcaggactgccttttctttgtgtggctggctgcattttatgatggattcaaaaccccagtaatgagaaaatataatcagaaaaagtgatttttagcaggctgttgaatgacacataaaataaaatgtattcattaatgagtcagcaaaaatgttatgcatgagctttcagagccagaatttttaagcagctttttcatacttggtacagccatgttcctgaagtatcctctcacaacccccttctacctctctctctctctctttttttttttttttgtcctgtactgccaggttggaataatgaccaaagggaggggcaaaacaaacagatatgctcactgtggcagaagtcactccaaagatcaaagactcgattcagccgtggctgccaaaatcagaaccacagtgggtgctcatcagcacggtgccctcagaaccacatgggctacccttgataggttagcagcttggggtgcaggccccgcatcctgcttagaaccacctgctgagaactggatgtgcacattaccttacccactcacaacatttgatttcaactcaattctgctctagtattatgtttattgaatgacggaagtctaacagacactgtaaaaatccaatttcacatcttatagtacccaaaagggaactgtgattttcctatatcagtgagcaaaatcttgagcaattagtaaacaagatcaccaatttctagtatttctatgagatatatttctttagttttctgtaaggagaaaataatatattggtaccttagtatccagcaatcttatattcatttatagggttatctcaagttaacatagtcaaaaacccagaagagggaaaatagagcccttgggaaatgaaaagaaatgccataaggtacacgctgttgcccaaatacatcattacttaccaaggagactttaatttggaaccaatttattcttctttaatacacagtaacaccagtaatctggaccctccattcatattacatgggaagaaaacactttcggaagaaagtacaatgatatctgtaagaaatgatggctctatctcagaatgaagaggagacagaggaggtgagggagaaataaaagtatgcaaagctaagaactatgtacagcttgcaaacatctctattattgagtcctgcagaaatcattgtggtaaagctctgcacaaaaaatagtgttcataattattatgggtttaattgtgccctcccaaaattcatatgttaaatttctaaccccaagtatctcagaaaatgaccatatttggaaatagggtccctaattaagatgcagtcgtaatggagtaaggtggttctctactcaagtatgacttatgcctgtagagaaaggggaaatttggacatgggcacacatacactgggagaatgctatattaaagatgaaggcagaaatcagggagatgccttacaggtcaaggaattccaacgattgccataaactccagaaactaagcaagaggcatgaaacagattccctcccacaaccctcataaggaaccatcccttctaatagcttgatctcagacttcttgcttccagaactgtgatccaataaatctctgttgtttaaacaacccaatttatgatattctattatggcagccctaggaaactaatacaataatgattatcaggaaatcatcatgtaaagactaaatcaagttcagaatatattgtttaagaaggttgaaaaatataagattcattgcagaaaacgaatcaatatgcttttgcagaaataaagcattcagtgtttgagtggcacaaatatcgaaacaataaatgatttctttacatggaacatatggttttcaatttttcctaatccaatgagatgttgccatctttactaaaaagacaaactgaaatatactctacagaacacgtcaaagaaagagtccccaacctccaagaagcattttgactaagaaggaagataaatatcaacttatttttatttgtttgtttaaaatacacagcctaatatggatgaaacggttacaaagagaagttctgggtaaagaagaggttgtctacttagaagaaaactactaataaatggggtttgaatctacataaaaattaaaaggcattcatccagatgagaagttaaagagaattctaagtatgaagaatggagaaacatgagaggactgaacaaagcaagagtaagagaaggtaggggcagaaacaacagcagagggaatatgagaaggctagctggtattgagagtgttatcaatctgaaatgggcacagaaacggataaaaaagcctgtagacaggtaagaaagacaagaaacagtaacattcccatatttaaacaagaagttgaaaacatctagtgcaagaattaagctctaatctttaaaacaggtgctcttaaatgcttttgcatgaataagagactgtaccttgatttttcttcaaaaggattcaatagtgggatggaaatgtgtgtgtgtgtgtgtgtgtgtgtgtgtgtgtgtgtgtgtataagctaagctgttactgcaggtaggtcaatgaagaaatacttcatggaacaggaagttatagcgttatacaatgtgttccctggagaagtttaaaaaaacacacacaaaatagccctatgaagtttgtttgctctgttaaatagctttaaaattctacccctactaattgttcttaacattttatttcagccaattatcaatttaatctgggagaagaaagatctacttgactttctgacagccaagtcaatccaactagaaaattcaaaccctacaagaaaactgctttgcaacatttttaactgacaacagaaatccatgataacataatcacctttttctttctttcccaaactcattctctctaaagaaaataaacaatggtacaaagatacttggatgaaatgaaaaagtgaagagagctattccctctttatggtaataggatgttcttgttcaagatggttaaaaatgtaacctgagttctttttcaattctctatagaagttggagatggtcttgtctacatatctaaagtaactgaattatatcagcaaatataagaattacagcttaatttcacccattttctatcttaaataattcataaattaattagtctctttattttattcattggaaaaatgttggcttagatgatgatattcaagtagggacccaaaatgttaaaaacgaagataaggaataggttttgcatagatactaccttttttcccactgatttctatggattttctattacagaaataacttctgcagagcactagtacttctgcagaacagagtaggatattctcaaaactgggatggtgataaaatgaataaaatcagcatcaagtgatgagaagcagatgagtaaaggaatatgccacagcactaaaataaaatgggcccttaattaaaagtccttgattaaattttaccttatgaagagaaatattgaaaagaaaaaggaagaaggagagatgaagggaggaaagatggaaggacagaagaaaggaagtgagggagaaaggaaggaagggaggaaggaaacagaaagggaggagggagggagaaaggagaaaaaagtgagttaaaaagcaagaaagaaggaaagaaaaaaaaggtaaagccattatagaggtattttctcatcctttccccactggctggccctctaatcttccttctctgcttcccaccccaatccaaatgtctgggacacaagtaggatagttgggaaaaaggggaaaaaaggaaaatttctttctccagctgatgctcactttggtaccaatagctctaactcaacagttccaagtgtttttaatctcatgtggtcctttgagaataaatgaaacttatcaaccttctctccaaggaaggggtggggagaaagaaaaagcatatttacaaatacatataaagtatacatttagataaaatataaagtatatttgcatacattttcaaagggcttatataaactctgaaattcatccctgcaccatctaattatccattagcttaatatgaaaaaccattggctctagaatctggaccaagccataataaatggttggggatagggatttggagaaatggaaatgagatacaaaacaaaccgagcaaaaacacacacacattaaaaataaaaaggtgttccttctctccaagtcaacccttaaggatctggctcttcattgttcctggaatttagatcaataaaaaatatgacttgaccaataactatttaattaataaaaatagataaaattatatagcaatatatataatattgtagcaattcttcatgttttaatcattaattctacattactccctgttaactgtctttgatagtgcactaatatataatactgccctgattttgaacattagtctaatacttacaataacattgaaaaccaacaccatttaatattgtgattagcaactcatcagacatataggaaattacaaggagactctgcaacagatacaacaaagcaaataaacaataataaactaatttcaatgttttaatggctatatgtaagaggaaacagaccttgccttaactgtactaatgggaattgtttatatttgtttaaaacataataatgtttcgcatagtaattcataatcttcaaatgccttaaagtatatttagctcatctgatgtgactatcaactctggaaagtaaataggagagatatcattatccttttttcataagcgagggaagagaggctacaaacgattaaatgacttcattaatatcacaaatctaacatgtggtagagcaaaggctagaactcacaggttctgatacccagtaattttgctaccatgctacacagtactcaaaaagtattcattacacatagcttgcttaggcacatgtgttgtcttactttggaaatgaggacaatagaatacaccctcaaatgagttgatacccatagcacttattctttcacgataaaattttattttggcacacagtaaaacagaaagtatattagctatttaacaggtgcaaatagatatttttgaacgtgtactgcatatcttatggatgatgtttgcatgtagtacgtgtccatgtgtggggactagtgtacgtttaatcattttgttagaaaaataataccgttgagttaagcctgtgttttattgttaatcatgcatttagtaacagcacaagttgacaaatcacttataattgctacatattatagcagcacaattcacaattgcaaaatcatggagccaacccaaatgcccatcaatcaatgagtggataaagaaactgtggtgtgcatatatatattatatacacacactatcatacatatatactatatacatactattccatcatatatatatgcatatatctgatgcatatgtatctatttgcacctggtaaatagataatatactttcaaatatatctatttgcacctgttaaatagctaatatactttgttttactgtgtgccaaaatgcatatatatatatatatatatatatatatatatatatatatatataatggaatactatgcagccataaaaaggaatgaattaacagcatttgcagtgacctggatgagattggagactattattctaagtgaagtaactccagaatggaaaaccaaaaattgtatgttctcctgatatgtgggagctaagctatgagggtgcaaaggcataggaatgatgcaatgggctaggcatggtggctcagacctgtaatcccagaactttgggaggacgaggtgggtggatcacttgaggtcaggagtttgagaccagcctggcccacatggtgaaaccctgtctctaataaaaatacaaaaattagctgggcatggtggtgtgcacccgtaatcctaggtgctccagaggctgaggcaggagaatcactttaacctggaaggcagaggctgcagtgagctgagatcatgacactgcactccagcctgggcaacagagcaagactccatctcaaaaaaacaagaatgatgcaatggactttggggtcttggaggaaagagtgggaaaggggcgagggatagaagactgcaaatatggtgcagtgtatgctgcttgggtgatgggtacaccaaaactcacaaatcgccactaaagaacttactcgtatagatcacctgaggtcaggagttcaagaccagcctggccaacatggtgaaaccctgtctgtagtaaaaatacaaaaaattagctgggtttggtggtgggtgcctgtaatcccacctactcaggaggctgaggcaggaaaatcacttgaacccaggaggcagtagctgcagtgagctcagtgagctgagattatgccattgcactccagcctgggcaacaagagcaaaactccatcttaaaaaaaaaaaaaggaacttattcatgtaaccaaataccacctgtaccccaataacttatggaaaaaaaaaagaatccacttcatgtagtaatatatgataagcacttagtaaatgccaattgttatgttcttgcctgggcaacttttggttgtcaactgagtagaaaaaagcgccatcttttagaaatctgtaattccttcttatctgtatgttaccttcattttcataaaaggtaagcagtaaagtgtattgtatcatacagtgatgaattttggaaattatgcataacattttaattatagcttgaatatcctttatctacaatatctgggagcagaagtatttaggagtttaggcttttttcggattttggaatatttgcattatatacttaccagttgagtacccctaatccaagagtctgaaatctgaaatactacaatgagcatttcctttgctcatcatgtccatgttcaaaacatttcagattttggagcatttcagatttcagattttcggattagggatgctcagcctgtattttaaatatgaaagacatgcacttgttaaggacttttgcagagattttactttgcaattatgagtcagcccatatatgacttctgttacgcaattgcatatttctcagaactctattttttttcatttgtattacttaaatgtttacttaactgggaaatagaagatttgttttttgttaaagtgcaaataaatgacaaaacaaacctaaataaaaaattagttgatttaaatactcaaaaaacccaaaatgcttcatgaataacatagtagaacatactttgagaaaaaaatataaacatacatatatctgacttcaactatcttgttagttgatttgtgattacttaattagatttattaaataactaaaaactgacttacaaatttataagcatatattcaggtttctgttgtaattaaagtaaaaaaaatagttaaaaatttacaatcttattgtccttatctttcctgtttttacttgggaaattatccttcttacttaaaaattttacttcctgtttttatctctgaaatatatagtctaatatgaaaatacacaagatggcagattgcaggggtgagctcatttcttccttaaggaaatgatataatagaaattataatctagtggatttacctgtactatatttctctcttaatattcaaagcaacccttccatcccaaataccagagccaaccttgaacagaattccaaagtgtggatgaaatttacctccagttcctcttccttatcccctctttgtccacgtttccttttgaccttttggcccttcctttgaccttatctaaagatgtatttctggtgttagaaagtgttagaactttcctcttcattttcagcttaaactgaagtctttatttaacttggattcctaactattgcatccttagcccatattaccaacctatgaattgaaatgttgccatctatctgaccaacctaataatgtcttgcatcctgctctcaataggtcacactctcttagataccagtgaaagacttgagatttttctgtttcctgcatttatctcagccttccatgtgaatcacctgtattaaaattttagtaatccccactttcggaggctgaggcaggcagattgcctgaggtcaggagttcgtgaccagcctggccaacatggtgaaaccccgtctctactaaaaatacaaaaaagtaaccgggcatggtggcacacacctgtagtcccagctacctgggaggctgaggcaggagaatcgcttgaacctgggagatggaggtgcagtgagccgagattaggccactgcaccccagcctgggtaacagagtgagactccgtctcaaaaaaataaaataaaataaaaaataaattagtaatctcatttctgattcacttgatctgggcttacttccttttcccagctgggctctctctatggttctagtatgctttgtagtgattaaaaggattaggataaataaaaccactgccataaaccaaaaaatttctggtctacctcaagccctaatggtcaacttggttttccctcgcccctagttattctgtttatcaaacagaaaataaatactctttaccaagtttcataacatatatattaaaaaaatctactaatagcatttagaaggtgagaattcatactgaatcttctacttctagatcaaaagcactagaatactcagagtactctagaaatgtatgatggaggtaggtgactcattcttttagaattcatctgtgggaggcaaaataattgcaccccaaaatgcccactgcctaaagcccagaacctgtggtacatggcaaaatgttatgttacatgaaaaagcgactctgtaaatgtaatgaaggttgttaacactaaaacagggagagtatcctagattatccaagctggcccagtctaatcatcttaaaagcagagaacttttttggctggaatttggaaaagaggtgtggtagaaggggaaatttgaaagatgtcaagtgtaataatgattcaaggtgctgctgctggctctgacatatagggacagcacacatgcaaggatctaaagatggttcccagctgatagcaaggaaatggagatcttagtcccacaaccatgaggaactgaataagcatgaaagtggattttttttcagagtttcctccagttaagaatccagccgacaccttgattttggccttgtaaagcctacagcagagaaactggtagagccaatctaaacttctgatctgcagaactgtcaaataataaatttgtattgtcataagctgctaagtttgtggttggtacaacagcaacagaaaacaaatatattatccaacatactatcccagtccaaaggccaacagacacattagtttaaaatcatagagtaaagaattgggacaggaaccactactatgaaaaaagaaagttcttaacactataaatacattttccccgatattccttcttttagtcatatcctcagagaaagtaaaatacctcgagactaaaggaaaaagaacacagggagtgtatatctactcaagtgcaaattgtcctcaccaaggaacttcacaaatgtgctcttcctcacaggcaagaatactatactaacagtgcaacattactcaaaccaactaaatccactctcttcaacaggaaaaatctgaaaagagcttgaaagtttataaaggcatgaagataatgaacatttaagaaacaatgaaaaaaagagaaagaaagtccaggcaaatgtacccaaaattcacagatcacatgcctactggggtatgttttgcctactatacaagttgtcttataatcatacctttaaaggaaattatcttcaaaaactatgattatttatttttatatgtcatcaccaaagctagtttttaaaatttatcttccaaaatgaattttctttcttactcatattttttacacagctagcttctggtcttaactgaacaaaggaatattggaagaaaggcagttatttccaatgattttcggcattgaagatttagaaaagttaacctttgaaaatttactcaacttcagaacctaaaactttttgaggtataactaccaacaacatgctgaaaacaaatacttttgcaatcgactagaaataattttcacagtaaaaggtaaattctcagcacgctgcacatattctactttataattatatcacagtatgaaataatatgaaagaaaataaggggaacaaaccaatataatgatttaaaattcttatagaaacaggataaatgaagttaattttatttttctgttgagatagaaaatatactgagctaaaaattactaataccacactttgaatcttcccttttgtcttccatggaggccacacatggaaggatagctccaatgacctgggtaagggcaatgcaggatagaaatggccacgtgagaaaatgtacacacattcctttcttttgaataccacattctgcttcctagaggtccctgtaaacttattaaaaacttcagtcattttgtaaggagataccataatttcaaggggctttgaggctcatttatagcaaattaatccccattttatgtctgtccccatttaatatttctaaagggggtggataacaaatctcgccaactctctttttaagggctattcagatactaaataaaccaggaacatttaaaaatacaatctcacaaaaatctgctttgcttaaccttctctccttctttaaaaaataagaaaggcatgatgttctttttttgttaattaattcattttagacaattccttaaattttcattttaataaatttttgtgtgggtgcattaattactctcaaagatgctttacaactgttacctattaaaagcctttgttagtgaataaaaaaaaagaaaagaaaagaaaaaacttccagcatgctcccttccttctctattctgagcaggtccttgctatcaactgctggagtatgcttgctttgcacctagagctataattattttgctttaattttacaaaaccttttgttccattcccacgagcccacctgatccttatattacactcgctctattaaaacactcatgcagaacaaagcatggctgtactgattcataagtaactttttttttttcctcagtaaaatgccactggctaggcttcgggacacagtcctgggcttcaccatcctatgccaattttcatatgttagaacaaaaaaaatatgttgtatcagagtgttgtactcttccccaagatccttcctttgccccacttgttttttgtgtttttaaacatattttatcttatacttaactttactctggggcaatatacatgacagaatgttgaggatggtggatatattaaaagattgtaatcatgttgatatttcttttattcatgtggttaaaattcttaaaaatgacttctgttgccttatttaattttttttttctttctccttactccacctcttttccttgagatcttgcaatacatgtgggcttttggcaaaaaaaaaaaaaaattgcagtgactcatcaagaaaactgtttgtttgctctgaggagcaccctgaggaccctctgggctgcacacggagccctttgatcctaggaaatttatttcttccagatgttttcccgacagccacctttctgcaatgtccctcttcattatgtagcataagaatactcaagacccactgctatggtacagttttcctgaatggagtgtgacagggagttgacatttgattgagctgttggattcttcttgccttaggcacaatgatggaggaaggttaacactgaggaaaggcagaactgggtctgttcaggtacagtgtctttaggattaggatggaaattatgtgaaccaggccaaagaaattatgtaaaatctacaaatctgcagaccattgatcatggacctagttttcttcaaccctgtaaaatcttgatgcctggatctgccatgttgttactcctccaattttttttctttttttttttttttttactaacatacaaagtgcggacaggaaagttaagcctttggacaactcttgttttttcttggcctggctgacagtgctagcggaaaggagaagggagaacaagggaagaatgcagagcaggtacaaaggtaaacatggtgtggtgggctgaataatgacatctcaaaatgtgtccacgttctaactcttggagtctgaatattaatttaaatgaaaaaaaaaaaagactttgcaggtataattaaattaagaattttgacatatggagcttatcctggattatctagatgggccctaactacaattctatgtatccttgtaacaggaagattccacatggacagaagaggccaacttaatgtgaccagagaagctgagattgcagtgatgtggccacaagccaaaaaacggtagtggtcagcagaagctgaggaaggcaaagaaaaggattctcccctagagcatccagaaggaatgcagccctgctgacatcttgcttctcgcccaatgataccgattttggacttttggcttccagaactgtgagagaatagatttctgatggtttaagtcaccaggcttgtggtagtttgttatagcagccacaggaaactaatacaaatggtaaccatttcaaaactccattgttcagagcatttgtgaaatcactgaagtctcaggttgaaggcacagtggaaaacaggatgccaaggcttgaagacaaaattctctgtggagatactggagatattaagggcacttataatctacagcaagtagggaactaaaacagggcaaagagagtgcacaagggcattcaacagaagattaaacagattatgaatgtaaatgttctaattttctaatgctggtttgcattttttatgaagtaggacaaatctatagtattttccatttaagttaatgcttacacacataatgtattaccagccattttccccctaaatcaattatcagtatcattaactttagtgacatttgatttggcaaatataaactatatttggcacatatatactgtattataaaaataaagatcctctatctgcacttgaggtaactttcctttagctattcaaagaaaaatctatttttaaggtttaacccaaagataatatggaacctaaacccaagaattcttaaatagatatattaaaacaataacttggctgggcatggtggctcacacctgtaatcccagcactttgggaggccgagggaggtcaggacttcaagaccagcctgactaacatggagaaatgctgtctctactaaaaatacaaaattagccgggcatggtggtgcatgcctgtaatcccagctactcgggaggctgaggcaggagaatctcttgaacccaagaggcagaggttgcagtgagccaagatcacaccattgcatgcagccaaaaaacacatgaaaaaatgctcatcatcatgggccatcagagaaatgcaaatcaaaaccacagtgagataccatctcacaccagttagaatggcgatcattaaaaagtcaggaaacaacagatgctggagaggatgtggataaataggaacacttttacactgttggtgggactgtaaactagttcaaccattgtggaagtcggtgtggcgattccgcaggggtctagaactagaaataccatttgactcaaccatcccattactgggtatatacccaaaggattataaatcatgctgctataaagacacatgcacatgtatgtttattgcggcactattcacaatagcaaagacttggaaccaacccaaacgtccaacaatgatagattggattaagaaaatgtggcacatatacaccatggaatactatgcagccataaaaaatgatgagttcatgtcctttgtagggacatggatgaagctggaaaccatcattctcagcaaactatcgcaaagacaaaaaaccaaacactgcatgttctcactcataggtgggaattgaacaatgagaacacatggacacaggaaggggaacatcacacactggggactgttgtggggtggggggaagggggagggatagcattaggagatatacctaatgctaaatgacgagttaatgggtgcagcacaccaacatggcacatgtgtacatatgtaacaaacctgcacgttgtgcacatgtaccctaaaacttaaagtatgttaataataataataataataataataataataataatacacattcaaaaaaaaaagatcacaccgttgcactccagcctcggcaacaagagcaaaactccatctcaaaacaaaacagcaacaacaacaaaaaacccaataacttaaaattggaaaagtccaatagcaaaattattgtgaccaaaccacccagtttatccctttctctagttcatcgttaaaaacacttggtagcagcattattaataaagaactaaaaatacacctgaactctatgattcttcttagctatatggcttttcaacaaccaaaccattaatcttcgtaatcaccatgaagctaatagatgtagactacagatacagataaagaaataagattatggaaagcttaaagagattctagatcaatcagcaaatgagaagaactgagaaaatcaagtagaaatgctggctgcgttctctagtacctttgaaaagctactagagatagaatccttcttttggagaaaatagtccaatgacagaacatgtaaaagatggacagagtcatttattttttgctactttcatattaacacagagtattcatttggcagtagttttcaaaacaagaagaacagtctatttttaaataaaattaaaaaaagtaactgatgattaacataactactgtaccaaaagaaagataacataagtcattcaaagtaccaggaggctaaagaaattctaatagttatccctatacaccttcatttcaataaacatgaaaaatgggaatctcaatgtgttgtcttttcaatttcctaataataccagggggactcaaggcagttcaaatctcaggacttcagaggccactgagttccactatctggggtgctgagcagtcgatatgaattccaacttcatactctccttgtctccttgttctatttgctttaacactatgtacacctaacttatctttagaaggacaggatgcatatcctttctataaaaaaactatgcagattttcatagtgccatataattacaggtactctttatttgtttatgaacccttccaacaacccaataggcaattgttaacattcccatttatcactatctcacctatttctgagttcctagagggttgagaacattcttttcctgttactatcttctcttagttctatcacccctggtaagaagttaagtagtaactagttgacatagaactcacggcaccgaagaatgggtggccaggatcagtgcagattggttcatttgggtttgtaacctttgtgataaattattgagtgctatagagataaaatataaaataatttttaaaaatcctactacaaaactaccttaacccttttagcacagattatgatcctgaaagctaataatctgtactgtgctataacaaatataagaggatgcctttagtatgataaagtttgctgtgatggagaaatggttgagataaatgggactttaaaatcaagagtcaagaacatttggaaagatatgagatacacttaggaatcttacaaatgaacaaggacttgtctctagtttcttagtcataatgtttctaagacacaaattaatcaaaatcccaggttatcagttacttaatataaattttccaataaacaccccttgattacacacttaggtcttcaaagtgggtagatttatacaattcccctctacacaggcaaattacatacacaaaaattatgaagttatttttttctttgaagtagtttagtgaatttttaaaaatctgtaatgaataaaaccagactttaaatcctgaataaaaccagactttaaatcctgaataaaaatgttctgtatcaatgattgtcatgatatgtgtcttggtaatagattattgcataatttttttcttaataaaatggtatctccatcaaacatgtagatcatggagtcttcccatagggacttttaagatcatgtaatccaatccttcattttacagatgaagaaacaatatgtgagtgttttaataaagcctactttaagtttttcattaagacaaaaatggttgttatatgaagagaaaaggagaaaaagaattaatagtagaaagttggaagtgaagagtgaggaaaaacagaaaggctttttcattggtgcagagcactaagcagagatgcattctctaatatatatccatgtcattgctagagactagcttaaatagtacaaagttggtaacatccttctcttttcttttttttgagacggagtctcgttctgttgccaggctggagtgcagtggtgcgatctcggctcactgcaacctccacctcccgggttcaagcgattctcctgcctcagcctcctgagtagctggaacaacagacatgcaccaccatgcccagctaatttttgtatttttagtatagatggggtttcaccatgttggccaggatggtctcgatctcttgatctcatgatcagcccaccttggcctcccaaagtgctgggattacaagcgtgagccaccacgcctggcccgtagtatccatttttaaaataatcacttagattataaacacgtaaacaatttagacaggtttacctctagggaatcatatgacttaccataaataagcaaacatattctgtattaccaacatgctaactgttcattcatttacactgtatattacctctcacttccccagaatatgcaagttgaaggaaacataacaaccattgtaaaactctatcttaaaataaatattattctataaagaaaaaacaaacatttttaagagtcatataaaggcaaattttaatttgaagacttgatactaaggaataaatatatatacctaatatgtattcacaaaagttaaaaactaatttttttaatgtaggctgtggaatcagactccctgggactgaattttgattttgccccatccttgaccttgggcaaattttttctctctgtgcctcagtttcctcaccagtaaaattaggataacaacagtgactatttacaagagttgttgtgaggatggaatgccataaatttacatataaatcttttagaacagggactggcacatagtaattaataaatgttagctgttacttctaatatgtacaagcctgttaaacattttgcaggggggagataaggtgtttctcattaatgggacttgttaaggcattttgtctttcaaatggctgcctaacttaattcataccaatattttatttcagtaggattaatgaaatagtatgaggaaaagccttagtgtggtttctttagacatgtttgagacagatattctcatccttttaaggggagtaatctaaaatgctacacccatttgtggcttaaagtaactgagaagtgactctcacaagatgacatgatttagctgtgtccccatccagatctcatcttgaattgtagctcccataattcccacatattgtgggaggaacccagtgggagataactgaatcatgggggcggtttcccccatactgttctcgtggtagtgaataagtctcatgagatctggtgattttataaggggtttcccctttcgcttggctctttccttctctcttccctgctgccatgtaagatgtgactttcaccttccgccatgattgtgaggtctacccagccacgtgaaactgtgagtccattaaacctttttttctttataaattacccagtcttgcatgtctttattgtgagaacagactaatacacaaggcaaaggagaaaatgggggagcagaagaggcttagcaggatgcatacatcttctgatatggagaacatgaaagcactcactgaggaaagtggaggtgctggctcttcagcaagcaaatgctccacctatatgctcccacagtatcttatacatgtctcaaagcctttaacctgctgctttgtaatgatttgtttacatatacttttttttgttattatatggtcttctacttgaagacaaaaactgtcccattcacttttgctcagtagttgctcagtggcatatttctggattgaatgacttagttaattaataacagttactacaatgggggaggctattgattttaaagcgagagctaagactcacaggttctatccaatggaggggcgtgttgaagtagaagtagctagctattatggtactgacaatggatctctgatctctgtgctggggataaatgctctaagtgagcatgaaatatttttgaagtttatacatgtgtaagttttttttccccttaaccataataactttcttttttaaaaatgcatgaatatttgagtaactaagtgcaatgttaatgttgggtgcaaatataatctgcctaataaaccatggaaaaagcctgaaaataaattcaataaatagagtcctagataatgtgttgtgggagatgagagaataagcaattaattatagatggtggaattaaggtaattttagtagagaaggtaatatttgagcaggatcttgatgcaaatactaaatctaaatctgtgaaaatagagcttatatccttaatgtagaaactggctgatatgcagagataagttgaaagtcctgtgaataggtgacataaacatcaaaggtattcctaattcccaatatacttgaaaaattggctattatttgatgcatatatccctgtatggcaatcagtccagtaaataaaataataataatgtcctttaaaaaattcatttattcatgaatattcattcatccattcactctttcaacctaatgtgataatctactgaatatcaaattccgaactgtgctgagtacattggaaaccacggtggtcaagacagaataaagtctctgcataagaagtaggttcagacaattaaattaataattataatgcaatacatattatgttaggtaaagtactacatgttatggaaatatgtaattataagcaatttatacttaaactcattacataaatatggcagaactatatttggataaagtgctggtggtttttattgaccttgaatttcttctgatttggtcttgtttacctacagagtagactgccacatctgggtcttacttatactgtttgctattcaaaatcttgcctcttgaactacctatttaattatggattcatgaagcacaaatcaatttattttcttaaattccttaagactaaacatggcagcatttttcctactccagtgtttctcttctgttaagatacatcttttggccaggcacggtggctcatgcctgtaatcccagcactttgggaggctgaggcgggtggatcacgaggtcacgagatcgagaccagcttgaccaacatggtgaaaccccgtatctactaaaaatagaaaaattagctgggctggtgacacgtgcctgtaatcccagctactcaggaggctgaggcagaagaattgcttgaatctgggaagcagaggttgcagtgagctgagatcgcgccactgcactccagcctggtgacggagcaagactctgcctcaaaaaaaaaaaaaaaaatacatcctcaggaagatgatggtgatgatgtatgaaactgaaaaaaatatgcttagttttgtgagattagatctacagggctgagaagagtaaaatcttgtttggactagtatattgaacaaaaaccacataggagtcacagtggaaacaattataggcaataccaattcttatcattttaatgaggagaagttaaagttggtcttttcgttgtggttcttaaatgcaaggtataacctatagtccataacaaatttttctttagaaattatcaagtacacagtgggttttctttagaaaccacaattctagattttttaaagcagaaaatatgctgtcctccttcattttaattcttttggaggaatagaactttttttttctttctatagttaactagagttgccacaggcaagaggactaacagagtaaaatactaactgatccaatatatactgcatttatctaactggatttcatctagctcaacatcatggctttgtagtctaagcagtagatgaacagaaacaataaactgggcaagtaatgttttgtgtgaataacagaaaagagtgaacagaaatataacacttcaccattgcacaaaatacaattaaatatgatttttaaaaacccagccactgatccactgcccaatcataaaagaattgtaatcagttcaagtagtcttaaatatagtgaaaatgtcctcaagatacacagcatgagagaacaaagagttttcactatcatctgctggactcagggaaggtgtgctatgtggttatcatttgagtgctctgtgtttaagttaatcaatattataaattatgcatgtattttagaagttcataatttctattaacttgtaaagttattgaaaagaaggatgaataaaccatactacaaaaataagaatgtgaataaatgccagtttttcctcagattacagatgatataacatcgctgctattttaagaaaatgagactggatcagatgtgaacatttatcccttctctttaggatagcctatgaattcaacacattgacactaattataacaatagctaacagttaactggagtactaaccatgtgcaaagcacactgtaattatttcacatatattatctcatttaatgctaacaacaatactatattataaacaaggaaactgaggcaaagggaagtcatttgctctagatcaccagggtagtaacgggtggatgtaggattcaaaccagacatactccagaatccatacaatatcagaatagtctgaccccaaaagacacacacacacaaaatggatctaaccaataccttgggaacatcatctaacttttctgggctttagatccttcagctgaaataggagttgacaaaccttttccaaaaaggataaaatcttaaatattttaggctttgtgggtcaagaggcaaaatcagagatgtcatgctatttaggtaattatataattggagagaaaacttgctgtatctcagccagttagatgaaaaacacataatacaacaggaaaggataatcttcaaactattaaattatattctctttgtacgtctaatgtggagacaaattatattaagaacacggtagctgaaataaaattatttcagattagcacatcaggtgttgaatgttatcagtggttatcttagggggtgacagaagaagattttagggacagagggaagttttttcacttccagttaaaatttattttttaagtggtggaattgattgttatttattattattatattttactttgtgttttggagtagttttcagtattttttcctggttttattgaggtaaaactgacaataattttacacatttaatatgtacaatgtgatggttatcaaatacacattaccacggtcaagattattaacatatccatcacctcatatagttaccattgtgcatgtgtgtgagtatgtgtgtgtgctgagaatacttcagatcttactctctgcgtaaatttaatggatgcaagtcagtattattaactatagtcactatgctgtatatttgatcaccataagttattcatcttataattgaaagtgtgtaccctttgacgaacttctcctgatatccctgtccccagctcctggcaatcaccattttattctttacacttttgaaatctactttttttttcttaatttaattttaagttctgggatacatgtacaggacgtgcaggtttgttacataggcaaacgtgtgccatggtagtgaacagccatgttttcaatacatcacaagccatagtagtgagaaacaccatttctttttttttcttttttaattattattatactttaagttctgggatacatgtgcagaactttcaggtttgttacataggtatacacgtgccatggtggtttgctgcacccatcaacctgtcatctacatcaggtatttctcctaatgctatcccttccccagacccccactccccaacaggccccagtgtgtgatgttccccttcctgtgtccatgtgttctcattgttcagcttccacttatgagtgagaacatgcggtgtttggtcttctgttcttgtgttagtttgctgagaatgatggttttcagcttctttttaaaaagattccacataaaagtgaaatcacacaaaaaaaggaatttcagaaaaactaaaaaattgaattaatatactgtcataggaaaaaacagaatttccaagaggagtgggggaaaataatagtatcagaaatataataataatagatctttttcctgtggaaaatagtacatagaaatagaaagtactgaaaaggagaatcagaaaagattatggctccagaatcacattatcttctacagtttgaagaaaaaaaaatgtggctaaaagaaaaaaagtatttccattacacaccttttataatgactagaataaaaaaatactaatatcaagtattgacaaggatattgacaaggatatggagctactgaaactcttatacattgccagtgggaatgcaaaactggaaattacccaaatgtctttcagtgaattaatggtaaatgatcttctgtatatccatacaaaggaacactacttagcaataaaaaagaaacaaatcgtgaaacatgcaatgatatgaaagaatattttattttatttttttaaagacagggtctcactctattgcccagactaaagtgcatgatcatggttcactgcagtctcaacctccctggctgaagtgatcctcctgcctcagcctcccaagtagctggaaccacaggtgcacatcaccatgcctagtcaattaaaaattttttttccttagagacagggtctccctgtgttgtccaggctggtttcgaattcctgggctcaagcattcctcctcccttggcctcccaaactgctggaactccaggcatgagctaaccatacccagccatgaatgagtcttaatgcatcaagctgagtgaaagaagccagtcttaaaaggttatatatatatatatatatatatatatatatatatatacacacacacacacacacacacacatatatatacatatatatacgtgtgtacacatatatacacgtatatacacatatatatacacatatatacatatatatccatttatatgacacgtatacatatatatccatttatatgacaactcttggaaagacaaaactataatgataaaaagatctgtggttgccatgagttagtggtgagaggatggataaaggaagaagttcttcagtgtgatggaactctttcatattctgatagtggtggtggtgcttgttacataaatctatatatatgttaaaattcatagaactgtataccaagaagtttattaatgtcagtaaaaatattcaacattttcagaggaaaaaagggagtaactgattacatattgaattattggaaaatacaggctcaaataaagccatggtttctcctactaataagataatttggtaagagataacactgttgatgaaaaagaaacctgcagttctacctccctgccattagttgaccaaaatgagaatgtctaacatagctacaaatttaaataattctctgcttgtttaaaacatagtctctaatagttcattacagtcattactgcctgttaatcaaggataacactagtatttgaattttgtaagtatgacagcaaggtaaagactgttacttaagccaataaattaccatatttcataaaaatctaatgattctgtgaacagactatgtagttcaatttttcttctaaaccctgtaactgcaatgtattttcactgatatttttaaagagttttcaaaggtacatttttttattgtggtaaaatatatattaaaaattgaccattttaaccatttttaagtgtacagttcagtggcattatgtatactcacactgttatgcaagtatcaaaaccacctccatctctagaacattttaacttttccatattcaaactgtgtaaccattacataataatcccatttccccttcctcctagcccctggtaacctctattctactttctgtctctaggaatttgactatactaggtacttactcggcacaatgcattaaagttttatccatgctatagcatatgtcagaattttatttctttttaaggaggaataatattccattctatgtatggaccacattttgttaatccatttgtccattcatggacatttggattgttttcaccttttggctatcaactgtgcattccttttgacattattgtcagccaccagttttttcctcactagtcagactcaagtcatattctgacactctttaggaatataggacatttcatttacaatagttaggtttaaacaggatgtattcatttgctctcacactactaataaagatgtacccaagactgggtaattatttaaaaaagaggtttaatggactcacagttccacatggctggtgaggcctcacaatcatggcagaaagtgaaggaggagcaaagacatgtcttatatggaggcaggcgagagagtgtgtgtgtaggggaactactctttataaaaccatcagatctcatgagacttattcactatcatgagaacagcacaggaaaaaccgcccctgtgattcaagtacctcccactgggtgcctcacacaacacacgaagattatgggagctacacttcaagatgagatttgggtagggacagagccaaaccatatcaggggacctttcaagtttggtcacaaggtctaattaattattttcatgcataggatctaaagagcaattgtatatttatcaacttatgtgttcaaatttggtcattagcttaacatatgtgtttgtatgcatgtcacatgcatatctgtgtgatgatacatagagctgtattatgcataatgttaaagctttattattgtctggttagagaagcagtcactatccagaaaaatggtttccaatgtgaagaagcatgttaaatttgacttcactgaattgaaaattttaagatgaaacaggagttgggttcctataagcggttagcgtgcaactagactccatcttttaacaaccaaagcagaacatctgggtgggtccaatgcattaacattttaaaaaaactttataggttttaatatgcagctagaattaggaacctctgagacaaaatgatcctgagttgggggagctaagagtaaacaagtgaaggtaattttaaaagccggttagggcctggagcatactgagatgaagggaagagaaatttagaattataaatagcaaaagatccactcaagctagaaaagattaagtatccttttagagttaagagtagaagaggcatcagttacaaggataattaatatctagattataaggatctgctattataaaacttatactagaacaaaagtcatgaaaatggtctgcggaagtcatgaggtgagaagaagataaacaggtaaatatttaagcagattatagagttctggaaatgtcatcaagtctcttgattgtgtatatttttgttccatttaaacacttgtcctgaggtttataagtgaaacatgatgtaatttatcatctaagtaaacatttatcttatacaccaaagcacggtgaatacacacacacaaacacacacacactcatacacacagacattttcattaacaagaactagtaccaactacagctcaggaaatatttgttgattaaatgaatcagtctgcttacagtatgcattttcttttgtgctgcagaagttgcaatacaaatgaaactaaaacttctgtgtgctgattacttttctcagtctgcttatctgagaattaaagaatttttaaaacaattttatgtattaatttgcaaacttctttaataatagatgttcattgtaactggtgaaacaataaaagctatttaaagaaaaaattaataatctttcctgattcctttttttgttcccaactctgtgaaataaccaatgtgaagaatatggtatgaattattttctatagctttcttcatgttcatataaacatacgcaacatatttattcataaatactcattaccctgaaaattatggtcattcttccaggttaacagctatagatataattcattcttttcctaatggctgcattatcttcaataacatggatgaatcatctgtccatatcatatgatatgcatgtagtccaattcaagaaatcagtatactttttttttttttttttacaaattttactaaaagtattactaaatttttacacaggatgctcaacaaacactgaagacctatctggtaccagctttggtgaccaagaaagaaaatcagtgaggtactcctggttttttgccctccagaaagtcactgactatcataggggagacataacagtaagttttttttttttttaatttgagagaaacttctcagagaatttatagtaacaaatgcttttaaagcaactatttaaaagaagtaatatatcactagcaattcattcttcattgtttccaatgcatgatcagtatttagtagcaacagaagacttccctatatgatgactcaaaaacaaatttccaaccactaagaactcagataaaggaccttactcttgagacctcaaagtgatttacatttccactagtacttctattgtaatatatgatatttataaactagccttattccatggaactctaaatatttaatgcttcacatatatcatttgacttttctgcatgtgtcattaagataggagaaagtgtcccctacagataaggaaaatgatgttaagacaaaactgacaacacctgaatcaagtctccagatagccccatactctttccttccaattatacttgctgccttgctagtggtaagcaatgataacgtagacagtattatgtcatcaattagagagtctcacttagcttgatataatcagtttttatttaaaaatgagagctttccatgcaaactgtttttctatcttctaaaaggcttgtgactaaaacttcactgacaagtttttcaggtgagatgagtgtaggttaactactgagcagccagagtctagtcaggcccctcacactttccagtgctacaagaagatgagcagatgtggggttagatgtggaacccaggttcatagctgtacctgccaaccctaacctagagaagggaagagaacactgatggtaaccatggcaacagtaacaatgctacacatctatcacttattgattatctaacaaagtcttaaaatatcaagtaatgtaagcaaagaacaattcagtgaaattttagcaaaggttaggcaaattttatatggtcaagatagtacatttgcaaacaagtagaagaccttgtcaaaaatctaaatcttctaatatccagtaactctcttgtctgagccaatttattttcctacatctttgaagacattttattaaaaaaggttataactgagaattcgacagtaatcagaagagtgatcttcattctgtattcagtgtctcttgaccccctgaaagaatctcagctcagcatggcttcctcccttttccagttgactcagagaacggtgctttcaaattgccttttgggatacatgaaggggtgcatttagagccaacctgaagtgtaacactctttattgttcctgagaaacgtgtgcccaattccctagaaatttactgtttcaaagagtcacaagctcctgattgcttctcatcagtcttgaagagattagataagcttcctccctcttacaaaagctttttcttcattcaaaattcctttgagaacaaaacattgaaccagaattggatttttaacaaaatattataagattgttgaaaacatttttttttctcctgaggagaccaaacaattcaaaagatatattaatgcacattctgatttagggctactagcaacatattgcaaagagtaaggtggtgccaaagaacaaagtcccttctgctaagcaggaaagatattttttaactgccttactttagaagatttcaatggactgctaagggctttcacacagataatctcagaagtcaaagctcaagaagtagggggaagaaacaactactggaggaccctaacaggtagcattgcttctaattaccgtaaaattgttatgtatactgatgccccacatcccattcccagactcagataattattctacagtaagagttggctttagaatacttgttcaagtgtgtcagtaatagaaaatgacctcttcagaaatgggggtgtttacatgcagtgctcctaaagttggcacacatggaaggtaattcagggttatgtttgcagtggcacccatcatcagcaatgtttcaacccccgtccatctctctgtcctggttttaccaagggattcacttcaaatgtattcctcactggtctttagaaaacagtgctagcaattcataagtatgtttgaattttcaaagtttttctttttctttttctttttttttttttttttgagatggagtcttgctttgttgcccaggctggagtgcaatggtgcgatctcagctcactgcaacctccgcctcctgggtttaagtgattctcctgcctcagcctcccaagtagctgggatttcaggaacctgccaccatccccagctaattttttttatattttttagtagagacagagtttcaccatgttggtcaggctggtctcgaattcctaacttcaagtgatccatacgcctcagcctcccaaagtgacgggattacaggcatgagccaccgtgcctggccccaaagttttgcattttgatagcagcaataaggctgagtaccttcataggcctttacctctgatcacactataaggctttaattaagttagtcttaagaagaaaaatgtacaccaaaccccaattattaaacattggaattattccttcttattggtctaataattacaattttttacttctcattcatttttcaaaggtttttttcagtagatctaggttattggaacgattatatgtgatatgatggggtattgggcacagacacagtaaatcaagatgatgcagaaatgaaagtctaatgctaaagatcttaccaatcttcccagatccccatttttcaaaggaggaaatgtatagaggacattacatttatttccagccattatgatataattataaagccaacctctcaacgcactctctctttttgggaagtctatgacagcaggtattacaattctactttgccagatgaggtgcgtaaaccatagaaaactaactagcatccaagagaagaacagacttggatgtgggtagaataataggaagaacacttacagtcagatatatcagagtatgaatgcaggctcaagcttttttccactaaaatgtatacagcaatgtaatctcactgagcctcagtttctgatactgtgaactaaagattatgacatcaatctacagtcaatgctgtgagaattaaatgtgaagagttttatggagagggcatctgctaaatgtaactatttttcttaccctcctaaattttttcagtcttttagacatttgggctattagagaactaatgacctctgtgaccacactagcttaggctataactaaatgcaacagatttaaaaacaccaagcaggagatagcacagagtttgaatcagtgaggtctaatagtaatacaaacctcacttactggctttgcaattttagatgctacttaatcgttctggggctcagttttttcattataaaatgggaatggttcctactttgctgggtagttgctgagtgtggtagcaaggattacagacaactctttatacagtatctggtatattaggtaaatggattgtaatatatattgttcagattttttattaattaaggtttgtacatagactcatctcctgcacttaatatttctttttctacacaagaccttgaaagggttatgataggggctttgatcacatattagctggtttggctgtggtaatttagctcctgagtattgggattacagtaccagcccctgccattgactatttaactatgacttggataggaattctaggcctgaattttgttcgtctccaaaatgaagaggttagaataaataattcctaagattccctgtcgctataacattttctggttccagggtctttttactgagctatagcagataaatcctcatatctttagagcttaagctacttctctatggtttaatttccacattccctctactctatttcttctttaattgcaaaaggggataatttccatcactttgcaaacaaaccaatatctctattctggcttagtggcataccatgttattaatgcatcatacttaaaaaaagcctggattgttcttcaatccagaaatccagtcatgttgtaggtagtaataatgagaataatgatgatttattttcaaggttttctatgcctccaggtgcccggtcattgcacatgataaaatacaccaaaattaaaaatgagattaaggtttaacagataaaaaatacattctaggaacaaaacacatttttggtatgcatctctacattacacaacagccacttaaaaataaacaaaaacaagaaatccgttaaccaacaacagaattttaataattattaactagaaagaaaataaaattaacttgaccttatcttagaaggttgtcagagatctactctgtttatgcaagtgagaaatatgttttgaattataagacctctatttcagaagtccaagctctcctcaaactcagaggtaaaccttcaggaaggatttaaaataaatgtatggattttgttagcatgtgtatattatttacctttgaattaattttgatcttgtcctattcttgagctatccttcaattggtatttttgtgtgtatctactatgtgctttcccactgcattcagaataaaattaaaattcctcactctggcatttctctgaccacacctccagccattctgctttgctcactttgctctggccactctgaagtccttttagttctttgaatacagaaagtctgattcaaagctttgcatttgaatacaggattttgtatatgcagtttctgtctggagctttctcccctcccatactccgttctctaccccaaattcttcacctggctgatattattttctgtccttcaatgttcaaatcaaaggacactctctctgagaattctgtcctgaacacccaaaggacagtataagagatttcccccactcaatgttgtcttgcatacataacactttatgtggaccacagcttgtaatgttgtaattatgtttgcacttattacatgtctaatttccttaggagactatcaatttcatgatgaaggtctaagggatcatttctatatttctactattaaatatagttgaataatgaatcaatgattctattgtggtagactcagtagggctaagaaatgttaattaaatatggactattcccttaaaattttgttttctagtaaaggaataaggcatacacataaagtgctataaaatatagaaagtaattcctgtctcaataaaagtgtagatgagtattgcattagtttcttagagctgttgtgacaagctaccacaagcttgttggcttataaataatacccaatatttattatctcacagttttggaggctacaagtccaaaatcaagttgtcagcagggtcactacaggtggtaagtaaatttgatagttaggggagagtggattgtttctgtccaggtcaaggaaagaaggattcatgaaattcataacattggaaatgaacttggtaggatgggttggatttgcatatgaaaaaattgaatgatggacattccagatgctggaacaatatgaataaaggtgagtaagagaactcggcctgagtttatagtacatacaacccggtaggtgacaattaactaagaaatgggatcagagttagattttaggatgtcatgtatattgattagggattgttatacacagaattattgaaagttttatctgaacaaaggcgacataatcttagtactcctatattaggaaagttaatggggcagcagtgtttaggataaactgatctccctgctccatctctttcaattaggagatttttgtaagcaagagaagataaaatcctgactggaacaggtatcaaagaaagagaataaatgagacttggccacttactggacatctaggatgtattaagaggaggaaagaatgatatattttgagtaaagatgtcctagagaattggagttagagaagctaggatagtcaaaagcaggatggtttttaagtagaagaataaattaagttttgatatgctgactcagagaaactagtgtgatttctagttgaagatttaaataaggatgttggaaatataggactaaagttctgaagacatatcaggactggagatataaatttctgagttatccatagtgaaataattgaagtcatgtaactctgagaagctgtgtcaagtcatgagaagagtatgaatgtggagtatgacagatgtgatcacatcctgtgtctactatttacctgttgtatatcctggggcaaattgcttaactccaccattttctcatatataaggaagaaaataattttatcccttaattaggattacatgagttaaatatttaaaagctctgtcatgtttaagctgcttttatattttggtgcataattctcataagaaatacacttattttgccatctagtatcttaaaaatatgtgatgtgctttaaaaaatatttattttcctgtgattctagtatatgtgatcttttaaactttcatgacctactaatgcgttgcaacccacactttggaaaactgatcctcccatacattatggttctcatccaattcctcctctagtcactgtccccaacaagcattctatgttgaaatcacaccaatactatcaatgttctcctgactttcatttattactccctcttcataggcttcttgctagtatcacattattccttcatggcctagaaaaaaatgataaccatttacttcctctgctattccatataatgttttgtctataagaaagatgcgattttcccagataaattatgaattccttaataacagaaaatatgtgttatttatctgtgtatcttggtaaaatattttgttataggaggcacagaacattaattcattattataaaggaaagggagaagaggtttgaagagagaactttgttgaacatctacatctaggaccctgctctggtatcaccatgtctcgattcctccttctctatatgccaaagcttccatggaatttttaaagggcagaactattgtctctttgtctttgaggcacaaagacttaaggccactaactttcagtacatggtggagagagggaagacctggatgggttaaaataaaggaagaaactagaaaatgtccagaatttagctttgggtaaaataacaggtttttaccgtagcctctttggattggtaaatgacagaatccaatgaaagcaatgtgaaacaaatgaccagagcaagtaattcattttaaaatattaaagcttatttctttttttttctgactctggaaaacttttctctgatggaaatgacccctggcaacagtgacattctgacaccatgcgtcgtacacacccttgggaagtttgaattccacaccactatggttctgttcagattactggtttcatcatgtctgtaagcccaattaaactactgaagttctaatggtcttatgtccactttgtaaatcatcataaagaatattaagtcaaccaaataaatttgcctctacaggactcgttgctcaaccaaaggcatgatactaggaacaaaattaaaaaacaaaaaaacaaaaaaaaacacacaaaaaaacctcttttgataacaaccaatgttttcaggatactcctttatatatgaatttgagattctgatgaaggggactacaattcaacaagtctcaaaaaatgagcccaaggcaatttgctcctcaggaaacattgcttagaccctgattgtagtggaaagattgaagcctcagattgtaaattcagatagactatcacgtctaggtctctaaggatgatctgcgatggtggtcaatatggtttgtgtaacctttgtgccctaccctgtgcctcaatttgcttatttaaaaatgaagtcactagactttgtttcttacatcctttcccactataatgtttggtgatgctctgcccttacatttgcctaaacttttcaatcttaaaatatataaaatgtttttataaaattcttttatgtccttaaatgttattgaacatgataacagtagaattcactaagcctaaatttcatcattttaatattgcctcagaggtcaagttttatgagagccttaatttgcatcaccagaagctcatttaataaaaatgaaagaatcccttttggaaataaattttaaaaactgatggtggggaagaggggcagataaatgtatgtaaaaaagaaaaaaaaacaacttagaaggtgtcaaatggttctgagttctaaagaatattgtggtcatattagtgttgaaaagttggtcctagctttttatgcactaaaagtacattctgctaatggttccttcccaaatccctggcctcttgacccaatacttattgtaccacttgtcccatttccctgaaacaaaatctataatatggcaagacgaactgaggtatcagagcatcatctaccctggaattgggcatatttatttgtggagttgattctagtgtgtgggatataaaacacacaacttaagtggaaaaatgctgaagaccatttcataggtgaaaaggatgtggtatgaatggtcaattctcactttggtcaggaaaaagaagtgtaaagtcaatgaggtaaggggctgggagatggatacctcgtatgatatgataagcagaaaggttgtgtttggcaaattcctttatcatcttcttcctgactgtcaaaaactgtattcaacctgtgtttacaataaatattctctgacagaatgaaccctggatttctgacttttaaaaagttttgaaattaaactaatagcagctatttcatgattacctattattgtgccaagggttagaaattacaaaaatgagtaagaaagagagagcccctgctcttagagaccttactgtctgtgggtttgaactgttgtagttatgacaacaataacaataactatcatttattcactcataccagccaggcaccatgctcagtgggcaacatacacaaagtgccaaagtctccttcatttcaccagatgcaatcacagtaaggtaaccttgctctgtccgtgcatcatcgcttaacaaaaatgaacttagcaggaattcagaccataggcagagacatataagcaactccagaactgtctactgtcaacacacaagaactacagtcaataaagagtgcaatgaactacagtgaaaatggaagcaattgtctgaatcacctttagtgtactctgttgactgggggctgtgacactctaaaaaccacgatacagtagactccacatctggcattccaacaatagaagggtaagtgttttaagactcttagcgaaagaacttgcaatacattaaactgtaaaactgaggaagacatcataagcttctggattttattaccaaaatgtacattttgatctaaaattaaaaataaaaacagattgactttccttgtagtatttcacaacctttgagtgcagcattaaaaatgcttttcttttttttcttcaccaactataagcttctgttttcttaccctgggcgtctgaatcttttatatgcttgggttctattcactgcctgttattcagacgttgaaatcccaaatgttaattgttcttccaagtacattgacaaaacagcagctaaataagggtagaccagactgtggtagactctgacatgcatttatggaacaatggggctctgagagacagccttgtagctcacgggaagacataagatgtgctattttgactgcttcgtagcagaatggggaacacacgcacacaagggaattatgcattttacttagttttgcccaaagtcctcaaggcaacagaatcttgtgatgtcatcatgaactttctttctctccatttccattgacacaaaggctaaaaatttctaatgacatcacaaaggaaaatgaaatctactttgattccaaaagaaatcttttaccttcagtgagactagtaaaaataaaataaaataaaataaaataaaataaaataaaataaaataaaaaagcaagaatctttccagacagggtgtgtgtcactgtgctcatgcacagtgggtgacaccctccctaatgaaattcaaaccagccaaaagaaaggattcacaatttaggttggataaaaaagacatactgaatattgagaccaacaactttttttttttaagaagaaaatcatttaaacatatatttcttcagggacattcaaatttttactcatgtctggttactatgttaccaatgtttttgtccttttttgggttggtcacagaaacacagaagaaggtacagaaagctttgacttacaggaatacagtgcagctcaatcttttgtttttaaggtgcagtgatttcagtctctaaatgtaacttcaggcagtctgaaaagaaacaggttaaaatctctttcagttataattggtatttcagatttaattaaaaattaaactttcataatgtttcaccatccaaagcaatgcattatcagtcaagcgtggcttttctttttttcttttttttttttttttctgttaaggaaaaaaaaaaaaaagaaaaaaccctcttcccagagtagttttttaatgaaaagaaaaggatctaaagaggagaaaaaaagcaattctgaaaaacaaaatacgcctccatgttaaggacttcataatgatatgactagaaactcaatgtttctgaattttagctatattctgattaaaaaaaaactcctaaacaatttctacagcctaaagattacagaaaatattaagttcagggaataaagaagaaaatctatgggtctgaatacacatattaaagggaaattatgacttcaaatggaattgtaagaaatgctagatctcctactttccagtgactgaattgctggtgaggtagatggtgaagaagggctaaataaacatatttaacaacacaaaatggccattgaaatgtactgtattatgggtttagcgtgccccatttcacatcatattgtacatcttgtcacatgcagccactgctgtttgaagcagcacaggaagaccaagagagtctgaacaacactccctggtttaagtaactgtaagcatgttgcttattttttaaatatgtacttataattccaaattaagtaacagtccaggcattaagagctccaagtatataataaatattaggcttaaaatattatactattttttgaatcatttctttcttcaaacaacaccatctataaataatagtattttttaaattaaaaaaatcacatcacacactagaattaaatcatccttacttttagctttgaaaaactgatacaatgggatttagaaaaatttagtttttaaaatataaaatgaggtaatataattcgctttcattcactttacagcgtggcagaatactttctatatatttataacactaaatgtcatatgtttacatccaatttcacattagtgcaaggtaatattttaatatttccccatatgagagcataatcacaaatcaccccttaaattgtactattattagaaagcatatgtagttcttacttgggattcctgttttctttttctcttgaaatgtatagaggaatattttgggtaattggtctatttgatgtacatagattttaagcgtaaacatgctcaggttcacagtaaattcactcatgaatgagattagatttaaaaaaaatcactgacattgactaactaaacttttccccctcctctcacatgcctgaattaggctaaaaatgaaccagcgtaaaggcagaaattatggaggcgtcaccagggacaactgaatgagaggaggggagtgcacattatttccttataaggcagcaaaatattcataaaagaaactgacaaaaataacttgtgctcagaaattatgagatataatataaatatattgaataacaataatctctgaaaaatgattcagaaatttaaaactgcccacctctggataaatctaattcaccaactggcattgttctactcaccaacaaaatatggttagcgaaacaaattcattctctagtttagacgtgaaaaggtgatagaaactaggctgaatatttacatataaacatataactaacaactagtaattcaattcattcagtcaggtttccttctcctcaatttgccagatgttgaatgaattgaactatcagctcaaaataattaaatcaattatatgaatagatggtcagtgtaccaattttcattccccccccatgccatttctccttctcctctttgatctttttcttctatttctgcttgtttcttctccactttcactttctttcttattcctttttccttcttttttttttttctcttggtgagggtaatgaggctcaaaaataacatcttgtatcctgttgagggaaacttggtcacaactatccttccagatgacaaactcattcttaaatgtctgtttcccaatccaaagaaaacagagcaattgaaaaaatagagactcaacatcacttacaactaccaacaccagccctcttaattcccatgctgtactactcatcacgaggagaactgaaatttatttacattatacctaacctcaaataggaccacaaataagactaataacaggaccattttgtggcactcaggcaaacggctgggcaaaacagatggatcttactttgcgccaggactcaaaaaatatagtcgccaactcactgttggcgactacatatcttggcccaaagatggacctggaagtaggaccagttgtctttgatatgaatagtgctcctcttcttatctcctcatggaacaaatcagtaactctgtcactatatagtggggttatcaggtagaattgcttaaaagactggtcatcaaggatgtaaaatattctgagggaatgtcaggtgagatgaaggaacagaaagtcaggacaaataccttatttttggcacttttgtctattttcaactttctgtttttttttttttttttaattcaaattcactactgtacactgaacccacctttaaaatagatttcagagtatgtgtcatcaataagaaaacttgtttctcacatttcaggttccaaaatctgttaaaattttaagtcacatagatcaatctcagtcattattaaaattgaccaccagtgtcagacttctttaattggaagaaaactatgtaaggctttatagattacagtcaacatccaatgatgcactgagcaacagctccgtaatcaatgcaatatacaaaatccggaagaatgcttctctggcagagaccctttagcaaaagagttgtacattctgcactccttaaagattctgaatggctttccagagaagtagcaaatgcattatattgcagtaacctatcttgtaagtcacaaggccacaaacaaagcctctagtcaataaaaaaacaaaacaaaacaaaacctgaaggggggtgagaactacagatcttaccattgactacgaacaaagggctgcttctgaccacattctactttctaaaatcctcacacagaaggagttttagatatcaccaggtcacagaacttcaaggaaagaacaacaaagcattccagcttaggaggtctatgttaattcaggcacttctcttattgctcttccaactattcagtactgactgtatcttgctcagattgcttttgagagttcactcatctctctataatttatttattcagacattgtgcagatttgatttttaagagacagccctgtttgtggtcagcatagaaggctaattataatactttaattatttattttagtatttttttctttccactatttaaaaactttttattataaaatatttcaaatatatgagagagggcagaatacagaaaaatgaactctccagtacccatcacccatagtcaattgtttttccaattatactttcacctactttttcttccaccagagcatctgaaagacaatcccagatagcttattattttatgcatgaatactttactatgtgttactgaaagatgacaatcataactaatatcattccacatcaaaaataatagtaattctttaatgtcattaaatatcctgtccatgttaaatgattgacttttaaatggtcttttctttttataactggttagtttgaatcaggatctaaataagatgtacacattatattcaaacgataattatcctttaatctataaattctccatttgctttttaaaattttaactttgtattttggaacaattttagaattatggaaaagttgcaatgatagtacagagagtacccatatttccttcactagtttttcctaatgttactatcttacataaccatggtaaatttgacaaaattaagaaattaatattgacacaatactattaactaaactacagactttattcagatgtcaccaatttttccattaatatgttttttctgttccaaaaatccaatccaggataccatactgcattttaattgccatgtctcctcagtctcttctgatctgtgataacttcttggtcattccatgtttttcatgactgataattgtgaagactagtggtcagatattttgtgaaaccttttacaactttgatttgtccaatcccgtaactagattcggattataggttttagagaagaatacaaaagaggtgatgtgcccttcttataacatcaaaggtatatgatatctcggggtatgttaaccttggtcgcttgcttaggagaatgtctgccaggtttctctatacttagttttaataaacataacagtttattgagatataacttatataacatacaatccactcttgttatgtgtataactcaatgacattaagtaaatttagagttgtataaccatcacctcaattcatttttagaatatttttgtcaccctacaaagatccttcatacccttagggagtcaatccctagacccagacaacaaatattttctctctctataaatttgccctttttggatatttttattaatgcaatcaaataatatgtgatctctttcatgtagctttttcacttatcataattcatttttaagattcttttatgttgtggcatgtagcagtagtctattcccttttactgatgaatactattccactgcatggatataacaccacattttatttatccatgcatcagccaatggacatctgaattgtttccagttttttactgttacgaataatgctgccatgaacattcacataaaatacgtctctgtgtggacatattttttttcctcttagatacctcaaagtggtattgctggatcataagggtaagtttattttaacttttaagaaacttccaaaccactttccaaagtgactatactcttacatctcccctggtaatataggaggcttctaatttgtctttatcttccaacacttgttactatctgtctttattacagccattctagcgggtgtgaagtagtcttttacggttttaatttacttttccctggaaataataatgttgaccatgttttcaagtgcttattaggcatgacttcatcttctttggtgaataacttcggtgaattgtcaaatattttgcccagtttttagctgggttgcttgtctttttattattgaagaattctttatatattatgcgtaaaaattcttatcagattatgatttgcaaatcgcaatcttgcaaatattttcgcctgtctttggtttgtcatttcatttctttaatgggtcttttgaagtgcaaaagttttaaattttgttgacatcctaattaccaaggattttattgaatcaagcttttggtgtgatagctaagaactttttctaacccaaagtcatgaagattttctcctgttttcttctagaaattttataattttagctctcacatttaggcccatgattaaatttttgtgcaggatatgaaataagaactaaaatatgttttttacagtcctaggttcgtgaatattcatttatatcgcatataatcctagcatcaattacagagcactgcttattgaaaagactatcccttcccatgacaaattgccttggcacctttgtcaaatttaattgatcaaaaatatgatgaattttctgaactttcaattccattccattgatctgtatgccaatatcatactctataaagtaagttttaaaaccagaaattgtacgttatctaattttgttttcctttttcaaaagtattttcactattttggatcttttgcatattcgtgtaaattttaggattagcttgtcaatttctgtaaaaacgcctttattctttttgacaggattgtgaattgaactgttttcttaatttcattgtttgttgctagtatacagaaatataattgatttctgtacaatatctcttcttatattcagttaacttgttgaattcctttattagttcgtgtgtgtggtgggggaggtgtatgtacattgcttagaattttctatgtacaagattatattgccggcaaataaatagttttactttttaatttccaatctgtatgccactgattgtttctttctgctggtctgtctaacccttctctttcccttcccctccccctcccctgcagctgctgctgcttcttttttttttcctctaatttgcttctctctctctttcttacatgtatttatcattctgcactggattgaatctcctgtacaatgttgaacagaagacataagaactgacaaccttgcctcttttccgatcctaggagtgtatcggtcaggttttcatcattacatacattataagttcttcatagatgccctttgtcaggttacagaagttctcttctattccttttgttgaaagattatatcacaaatggatactggattttctcaaatgtttctgtacatctattgaaatggtcatgtgttttctcttttattctattaatatgctatattgcattaattaattattggatgttaagtgaaactcacattcctgggataaatcctctgtggtcagcactgtataatgcttttctactttgccacatttggtttgtgaatattttgttgagttttggtgtctatattcatgagggaatctggtctgcagttttctttcattgtgatgtctttgtctggctttgctctcagtgtaatattgtacaaataattgaaagatgacctttcttgctctatttctagaaaagtttgtgaaatactggtattggatagaattcaccagtggagtcatctacatctaggattttctcctaactataaattgtataaattgtatgtctttttattacgagtctgttcatattttctatttcctcttgagtcagttttggtaatttgcgcatttctaagatagtccattttatccagctaattgctaacaattgtccagttgctaacaattgtctaattgttaagcaatgacaattgaggtcaaccaatgatcagtcacaggttgtatttctaactatcaagcaatgaaaaggattatgaggttataatatttgttcatagtatagtatgagatcaggaatgagagagaaggtatcaccaccaaccccatagaaatgagaatgattatgaggttatactatttgtttataatatagtattaactataactatacctcataatccttttcatttctgtggggttggtggtgataccttctctctgattcctcattttggtaatctgtcatcttctctcctttttccttgatcagtctagcaaaagaaaaactaagttttggttgatcttttcaaaaaactaagttttggtttcattaattttctctattattttcattatctatttcattgatttctgttcttatctttgttatatccttccttctgttcaaacagaatttagttttatgtttatatcatgtctatacttacctaaataatgacgtgatgaggtccttttgtttaggtgaattttagatacatttttatcatttcatttccacttaaaggatttccttcagtatttctggtaaggcaggtctactagcaacaaattgtctcagtctttgtttatttgggatatctttattttatatttatttttgaagaacaattttgctaaatataaaattcctaaatgacattttccctttttttccttcagcacactgaatacgtcatccctctacctcctggctttgtttctaatgagaagtaagctgttaatcgtagtgttgttttcctgtatgtaacagtcttttttttcttgttactgtcaaaattttctctttttcattcaaaagtttgactataatgtgtctatgtacagattttttttgtgtttatccaacatggagtttttgtgcttctcaaatgtgtagattaatgttattcatcacatttgggaagtttttggctattatttcttcaaatatttttgagccctttctttctttcctcctcttctctaccattacacatatgttagtatgcttgatggtctctcacaggtctccgaagctctgctcattttttcattgttcttttctcttcaaattagaccatttctattaattgatcttcaatctcattgtgtctttattctgccatcttaaatattctgttgagattctcttgcaattttttaatttccattataatattttttaactccagaatttttgttccttttaaaataacacttatgtttatattgatactctctatttaaagggtaattatagtaatactttaattatttaacatgatttcctattattttgaacatatttataatagtgctttcaactctttgtttgctaagtttaacatctgctatctccacttcaacccaaatataatttctttttttttcttcagacactttcttttaaccacttcttaaattgggtatgagtcacactcctgtttattacatgtctcatttttttcttgaaaattgacattttatatagcatattacagcaactctggcttctgacttttccctgttgagggttgttgctgttattgctgtgtttgtttatttaggacttgcctaacataactctgtgcagcctctcttccccatgctgtgccgctgctgatgtttctgctcagtttgtgtaatttccattttcgtttttgagctgggactttcccctgtgttaacacagtttagtggtcagccaacgatcagtcacaggttgtacttaaacacctagggccactatgctaacgcctctaattgatatatacgtgtgtgtgggttgtagaatgcactcaaagttcaggcagtttacaagtgtttttttgatttttactttccatttgttctctcttatcttctctctgtgtgtccaaagccttaggtcttccccagagtatgtgtgcagcctttcagacctctaggaatatgtggtagcttaccaaagttcactatgatagtatccttttccaattctccctgctaaatttctggccaatctgccagttcttttctactctgaattgtaacttcaggctacatatgatgtttattctccctgcttgtttgcccctgagattgtcactgttttgaccacacctaagggcatggggtttttctatgttctgctccatcaaattatcgaatcaccccctttcagcagtgaagttgtgggttttcatgacttgtcctgccctggcagaactactgatacaatggaactgtggggacggataataggaggaagcactcccggctaaaacactgtgggctcctaactgtgctagttgtcccaacataacttttaatttggccactttcactcccaaaagtatccagcttctgtgatatgatttatgaccttttaatctatagtgggcataaacgacttatgccatatgccatttcttcagcgaatgaccactgcctaattcttttcttagtaatgcaggaatcaggggcctagctgcaggtatccatgcatgtggggtggcgggggggaagtctaactgccattgaatgaacgttttcataatggttacatgtgtatagaaaatcttcaactgcccctcctactacatctctagaaagtttaaaggtttgggggggattaagaatttctagggaagtgtatgggatatagggataaggttaccaaaattctcccatgggagataaatagttttgcctcactctatagagtttggagaaaccactcagcgagaaggactagaattactttggttaataatgagttgctatgaactttggagctggactaacctattctaagcaattgtaaagaatatgtcatttagacttaatcttatacaaaacaataatagctcagagatctaagcaggtccaaatacttacttggatcaggttagtatttgccagcttattttctcacagattcctgggctcactcaggttatacttccttgggaacacacaaagggaataagctccttttggaactcaaataacttgtaaatcagaaagttcccatatggatatagagaataatatttactatataataatttttcctttacatgatgatccacaataaagttcccttgagaatacacttccctagagcatttaaattatgaacggatttacaaaataactcctatcacatgaaaagagataaacatatagtatctgcttctaggaattatctaaactcattttccttcagagacttaaatagatgaaaaaaatcagcaaactttgtttaggaaaaattcagaatgtataaagcattaattgtgaatatcttactgatatctttggatcaacataatacttcacttttacaacatgttgaggaaatcaaagtattcaccaaacttcatctcattaaagtgtcataacctttaatctaggaacccgtaatagtaaagattactgtttctgtctggaaaacaagaaatctaatccatgaaacaaaatcctgaaacatcacatacattgcttaaagatgtaagtctgaggatggagaatgtgatggaactccgtcaccttgttgtataagtgtgtccggaattggtgggttcttggtctcactgacttcaagaatgaagccgcggaccctcccggtgagtgttacagttcttaaaggcggcgtctccgcagtttgttccttctgatgttcggatgtgttcggagtttctgccttctggtgggtttgtggtctcgctggctcaggagtgaagctgcagacctttgcggtgagtgttacagctcataaaggcagtgtggacccaaagagtgagcagtagcaagatttattgcaaagagtgaaagaacaaagcttccacagtgtggaagtggaccccagccggttgccactgctggctccggcagcctgctttcattctcttatctggcgccacccacatcctgctgattggtagagctgagtggtctgttttgacagggtgctgattggtgcgtttacaatccctgagctagacacaaaggttctccacatccccaccagattagctggatacagagtgtccacacaaaggttctccaagtccccaccagagtagctagatacagagtgtcgactggtgcattcacaaaccctgagctagacacagggtgctgattggtgtgtttacaaaccttgagctagatacagagtgccgattggtgtatttacaatccctgagctagacatagtttctccaagtccccaccagagtagccagatatagagtgtcgattggtgtacttacaatcccttagctagacataaaggctctccacgtccccaccagacttaggagcccagctggcttcacccagtggatcccgcacccgggctgcaggtggagctgcctgccagtccgtcgccgtgggcccgcactcctcagcccttgggtggtcgatgggactgggcgccgtggagcagagggcggtgctcctaggggaggctcgggccgcacaggagcccacgtaggtcgggggaggctcaggcatggcgggctgcaggtcccgagccctgccccgcgggaaggcagctaaggcccggcgagaaattgagcacagcagctgctggcccaggtgctaagcccctcactgcccggggccggtggggcaggccggccgctccgagtgcggggtccgtctagcccacgcccacccgggactcgcgcttgcccgcaagcaccgcgcgcagccccggttcccgcccgcacctctccctccacacctcctcgcaagctgagggagccggctccggccttggccagcccagaaaggggctctcacagtgcagcggcgggccgaagggctcctaaagtgccgccaaagtgggagcccaggcagaggaggcgcccagagcagccaggactgtgaggactgccagcacgctgtcacctcttataaggttatcaatagggcaatatccaggctacaatgaaaaagaaacttgaagtctcgaacacctattgtgtatacattagagtggattcaaaataaatatttaaacagatttctgttcctgtggaatggtatttttccagcaaacctctccagcgattgtttttattaggctttgcaatttctataaaaggatatcaaccctgtcccaacttcattactatttctgctattaattaacaataaaaaaaataggctaggcatggtggctcacatctgtaatcctagcattttgcaaggctgagatgggtagatcacttgagtccaggagtttgagaccagcctgggcaacacagaaaaatcctgtctgtacagaaaatgcaaaaattagctgcgcatggtggcgcatacctgtagtcccagctacttgggaggctgaggcaggaggatagcttgagcctgggaggcggaggttgcagtgagtcaagatggcaccactgcactccagcctgggtgacagagtgaaaccccatctcaaataataacaataacaaaaaatagttgtatttcaagtaatataatctagataatctaatataatataatctagataatctagaattcactgtcattcaatgaattatatctgtgtgaagtgttctctatttggtccaaatcttttaaaaatgggaatactaaagttcacagtaataagatgttgtcagtctacattgaggactacaaagaagcatttctataaaatatcctttgttgctaatgaaagttaatatttatcttgatatttacattataatacagtgatccctatacatactgaagagcatcctagaaaattgatttttcttagtataagcattgtatttctttaaaatatataatcagagcccaatctgtaaatgtaggtaagatcctttataggatgctttttaaatgtaggtcaaattcttgcctccttctcatgtttttccactgtttacccattttattttttatttacttaatttatattatatatttcacttactgtcatttatatttatataaatatatttatacataaatatatttatattgtacatgtatgtatcatttaagctatctcaatttctttttgtaacaaagagatatctatctgtctctactgtatatttgtctatctacccttccatgtaacaattcatctaaatttactatatgataccccaacatttcagatgcaatctgaaaatagcaaccttagatcctctataaactcatctatgtttttgtggtgactttagttttcttctaccttcgaagctattcaaatcagaatagcctcaaatctgccttaaacttgtctgagacaaagtaacatatttgtatcatcagagctcagtattaacttaaagcttaactaaccacctctttgctaagtcacctgaagatgattcttgcctttctgtgcacgaataaaataatttgggacctatggaacaacaccaaccattttcaaataactaataaggcatataacatagagcagacacaactgattatatagtttgtaccctgtccaaggcacctagtccaggagtgtgtttcactcaataacccacgttccctagcccaagctgcatctgcttgagcaaagggtttcttttaataatttgcacaaaggtgtccgaacaggcagcttttttctaagttgtattgaaactccatatgagataagaaaggccctctataacatgtttctatagtacttctaacagaatataattaattgtattaatattagctggctctctagctgttacatgtaacataaatattcaggtaacttcctagtaatgactaacctcatgagcttaggtctccatgacttgcactaaagaatgctttaaaaatagaatgttaacaagttcggagacatggattatttgtacaataaaatacttttcttttaaatttagcttctggctcccattccttcaggcagattttatatattagtagttaagtcttaatgaattatctacaggtaggctatacataacacatttttacattaacttttcgtgactatgacatgaatacatgcccattgcaaaaacaaaataaaacagtacactgaaaatatagaaaatatgaggaaagattacgagcatcaatagtctgatgacacagagacaataaaccactactggaccttcaggatttcattccaacgtgacacattttaatcccaatttggcttacccattttcccctgcacacaacgagtagcctcctatttttactatttggtattgtgcttaagcaacggaaatatttcaagtatttctatagcaattgttttctataaaattaatttagtaattgatcaagtactatcatatttaatagccctgcaattgatcattattcatgatactactcattgttattgcttattacttcatgaatttggttttattcaatcatgtcatatggagattttatacacacacacaaaacacgcacacgcacacacgaccggctactacataaatattaaaccatttctccgaaataatatggaggttagaagtagcttctagatgaacaaaatgaaatggcaaatttgatgcttaaaagtcaaaaatttcatatcaatgccaaagatacattattttagataacactctttttctttatttttatttttactatctttgctacaacactacaacattaatatgaagaactgagagtcagctacgcctataaaggtaaagtgccataaaagccccaatgcatctctctcaagagtctaatcttattctatctgaggagctatcctctttctgtgaactctgtcatgtagaattacatcatctcccatggctcagattatctccaatttataaaatgctttaacaaaaactgttacaaagtgggctctgttatatattcatataacttcctcttcactttggttaatacggaaatacacaatacatcaatatgtttcattaaaacgattgttttgatatagtaataagctgggcaaatagaggaagtatgctgggtgcaatttatttacattttaataagacctcaaacaaatgataccacacaggaagctcagaattaggttaaggagaaatggtggctaaaaaatgccttgaagtttggaagctgtaagtattatctaatcaatagtattacttttgaattaagatagaataaccattccacagggacaggtattgtggtctgtgacaaacattattcaatgcagacattaaaaatttaggggagatagaaattttcaaaatttgataaaattttaagactaaaccttagaatatatgccaaatgctaaagtttaaaatgaatgggcctatgaaataaaaatctcatgaaagcccaaagtatgggagttttcttccttaatataccaaagcttactgctaaaatccccatttaatagagatgataacttcgccattcacattttgggtttctcctactatgcatgttaactctttgtgaatagttctaaaaatcaagacaagtatgtactttaatcaaataggagattcagaaagcaatgatttcagtctacaattatagtagcctgcactattcctatttccaaactctgagcaggttcacctttgtttgagacaaattatcactgataatatcttacagattaatgtgcatgacatttgtctatccagtgtagtttccaagacaataaaaaaaattgcagaagtaaatatattatttaagctgcaagtgaagaaacaattataaaagtacaataatgataggaaaagcatgaagaggacagggtgaggtaaatatacaaaaggaatcttgtaagaactgacacatttgctaaaagaacaagaatatgactccgtgtgtgtgtgtataaatctctctctatattaagtctatatgaaatatatttatacaacttatacacacacacacacacacacacacacacacacacacacataataaattgggcgtggtggcttacgcctgtaatcccagcactttgggaggctgaggtgggtggatcacctgaggtcaggagtttaagaccagcctgaccaacatggagaaaccccgtctctactaaaaatacaaaattagccaggcatggtggcacatgcctgtaatccgagctactcaggaagctgaggcaggagaatcacttgaacctgggaggcggaggttgcggtgagctgagatcacactattgcactatagcctgggcaaaaagagagaaactctgtctcaaaaataaataaataaataaataaataaataaataaataaataaatatctctctatatatacacacatgcagaggcatacatatatgcctctataaaaataaatatttcattaggagttttgcaatttccttatttgtatctatccatgaactagaaagtaagttccttgaaagtatgacttatgttttctgtgttgtaattcataataactagcatgatactgagcagaaaattggttctcaataaatatttgtgtgaaatacaaaaaatctaatttcattcatgcacactatgtaaaagaacaaaattaaagaattcccaaaaataagacaaatgataccattacatggggaaagcaagttagattatgctacactacactaagccaataaaattaataccaaaaaaacccttcaagtgaaaataaatctatgtaaatacatgctgaaatcctcagatgattcagactccagagaaatgaaaccccaatgacagcatcatgaaaatgagttgccccaatatcacatatcgtttttgtcatactctacaagaagtggtcaggtgtgattagaaattccaatttcctaatcttacagaatataaacaatctatattacataagtctatgaattttctgaggcattataaacttttatggacattttttattagaatctgaacacaatggtgtttcaatataaaaactcataatttcaattgtgaatcaccattttacatttaaacaattttaaaaattcacattgtgacatgttataccattaggttattaaaaaaactctgaaagttttcttaataagatcataaagttttttctagttatgcaagagcaatttgatagtggaaaatcaattatgctaagtcctttgctgaactgtcacatttcaaattatcctataatgttttaaagggaaagggctatgcatcttaatcccaatgtctagtgaacaatttctggcatatagtaagtgctaaataaaatgtatgatgaattaatttgagttgaaaaatacatctcaagaaaagtctatgtccatgagttacaattggacaatatttaccagaaaaaaaagattaataaaagtcaacgtccattcctaataatcaaataaggattcagaaaatagtatgttaatccactttaccaatatatcaaataatatctgtcttaaatcaacaaccaatatctgccttaaatatgaaaaaaaactagagataataccacataataaaaaacaagaaatatgccctctaccacaacgattacttaactgttttggaaattatagtcaatgaaataggatattaaacaggaataagaaaggaaatagacagtcatctttgttaggagataatttaataactttgaaaccccaaaagaacttaaaagaaattattaaaactattaagagagttgaataaaataactagataataaatacagatagtccccaacttacagtggttcagcttaagattttccagttttacagtgggtttatcagaatggaaccccacataagttgaggatcatgtggattataaataggaagtggcttttctaccaaagaattataaatgaaatataggcaattaaggacactaacaagaacatagcatgcctatacctaaatatatgaaggaatttggggatctatatgaataaaaagatacaatctatttatgtatgaaaacatactatgcttctgaatgggaagactgaatattgcaaagatactaatactgatttataggtttaatacaattccaacaaatattccaatgaaacatttttatgaactcaacaaactaaacaaatcctgactagtaagtaggtgacaaaagccaaagcatttttgaaaaaagaaagataaggaaggattttacctaaaagatacacaaacttattttgaagctctaatggaagcaatatagaaccggtgaaagaactgaaaaagcagatagtccagaaatagatcctaatgttgataaaaattagtaggcaatcaagatgatgtcaaaatcagtggggaaatgattctggaacaattgattaaccattaagaacaaaagtaagtaagatgtttacatcataacatgctaaaataaattctgggagaaacacaattaaaaatataaaacagaaccatgatcatactagaaaaaatggtgaatatttactaaatttcaagctatttaaaaaagaagataaaagtaatgaacatagtcacagagaaaaaaatacacaagaaattgaccatacaaatatttaacattttctcacataaaatcttacaaatcagtaaaactacatgagtaaagaccacaagcaaacaatttataaaaataagaaaacaatgacaaacatgtaaaaaacattctagttccttattaaatcactgcaaattaaaactatgtaaactagttattttgcctgcaatttgtcatatatttatataatgctgctattcaaaacagttaagaatgtagttagaaaagcacttttacatacaattggagaagaattctcaaaggaaccttgagaattttacatcctctagcccagaaatcaactttctaaggatgtatgctaaaaacataatccaagatgcagataaaaatttatatataaaaatgatcctcagagtaggagaaataatagtggaaaatgacctaaatgtcaaacatgaaggagttaattaaaattttttggtacataattaagatataatattacacagctaatgaaaatgagtattttatgactcagaattaataaaattaatgctaagtgaagagatcactatacagactatacaatccaaaatgttgtttagaaatatgcaaacaaacacatatatataaacacctgtacactttagaaacacccatacacttggaaagaggcagagcaaatacttagaattgtttatccatgattggtggtgtcaagtgatttaaatttattcgttatatatattttctattttgacacatcctttcaacaagtgtacattaccttttaatctggaaaaaaaagttattttaagcctaaaatgaatttatgtgggttagaaattcacttaagggaaaaaaatcagataccgataaaaatcactttcatatacatgtagaattactgtgctctttaatctgtgaatctccatacttttgtgcataaagaacatctattgagatattgagatacttgacttttttttagtgctgaagaacacaataattttcctgaattaaaacccaaagaaaataaagtcactcataaataccatatttgactacagcattcacccaatgctctgatggcctttcccgttgttgacttattgataaaatttacctacattgctaatattaataattgttttggtaccaatttcaggaataatcaatctgagaatgtttacttggcccatttagacaataccaaggaaaacacccccaagtaactgtaaccagcatagtgaacagtgtatttgcgttttcacatttcttttccatggaataccaaccttgcctagtattttgcgaataacaatggatggaacttggattttcaacagtgcttaaaaaatagctgccaaagtcaagacatgtaataaccttctaagtaagtttgctggctccatattgtgtttgaaggcacaccccctccaaacgtctgcagtcaccatctgctactcaactgcagaataatgcactgaagtctggtgttgtttggcatgggcaaagacagccaatgtccaactccattcagacatgtgcaccatatcaggaaccttatgacacagtcctcaacatcaatgcagcactttcaagccctgctgcacatcaatcaagtatgtatgacagtcaagctgatagataaaatctaagccaactctaaatacctactgtgcatggatctctctagtttgcctgcagctcaccttctattaagatgatagctttggcctagtcttccatgccaaaataagtgcatggagtcactctggcaagaagaagcgtctacatcaatgtcaacaaacaagttccttgcgcccgaccctaccatctgtcctcctgcttcccacctaccgtactttatgtggaccttgatgaatgagattctaatagtccaagactctagtttagccagcctttgcagatggggtcaacatgactgccctctggccaaatacccagggtgacatagctgatgggttacctggaaagtgcctttttgcaaatttaatgtcagaaataaagcaaatgaaggcgttcctacaggttctgagtttcgggtttatggaaaaaagtgatgcattcaatgcttaaagtgaagataatttttcttttaaattatttgaaaatcttataatgctaaagcattgataaattccatttcaacactacgggtaagggaaataaaatgaatgaataaaagtaaaactggggctattctaatgtatttacaaagtaggtttgagagaaagacttgaaaaaaatctcagaaatatgtagaaataagacttgatagtgtaacattaatatagaagcagattatttcattctgcgttagatgcaacaatattagagcatattgcacatgctaaatggggaataatagatttcatacctattctacagaagttgtatggcacttgcagatttcaaggtagagcagtaaaatttaatataatcttaagtatgagatataaatagtttctggaaaaatctaattgtttttgccttaaaaagatattacatgaaatatgataaatcagtattgtcataaaagtagtaaataaaattattttgttttttgaacatgttgacaaaccatttcaattaggtcattaaaaaaacacttaaaatggagcctgagggcatatgaaacaaacagaaatttcaggaaatgccgctagttccaatccaactcaatttaataggatgatacaatgataagaccttatttttccttcaaggaaagctaaatgtatttctagaatggtctctggacacatcaaaaatagaacaagcaaaaacaaaacaaacattctacctaggaaacaacatcatctgaaactctagacaatttaagtaataataagaaagtgaatcttcaccaaatgagaaaatgaatgtgaaaatatgttacatactataaagcaccatacacagaattattcagagcatctattaaagtgctttgtacatagtaagcatttactaaatgtttgtagaattgactagaatttaattgaaaagagaagtataatgagacttctacaagtagaatcagatccttttaataccatgggaaaaagtttcagtcaaattatatgactaggtacatccgttgtctttgatgttatgaatcaagatgagatcctattatatcaaaagaaaaaatattgttgaatttctctttggagaaatcacagtaaaatgaaaaggatgattatttttaatttctaaatatctccaaattttatagcattcttcggtcaactaagataatgctatagaaatcctacataaaacttgaacttacaatgtcctggcctaatcatctggctaatctctttgagttttcctgaaatatgttcacatcccattttctatgggaattctcccactgattaacacagagaatgagaatttggcctgtgctctataggcaccattgaaatgtggccacctgaggcatgtagggagggcatccagctggcacaccacatgttgccctggagtagtgtacaatgagagggatattttggctaagaatacctggatgatctctataaaggtcctgattatgaaaaggacttcagcattatcattgtctcatgggcataatatgagccagggaaacttctgtttctaagttcatatattttccaaagaaaggacttataagaatataagaaaaaatcaaagaactctatgaaagagaaacactgggccattgatactagattttatgtactatccatatcactagaagaaacttttttgagagctccatgcattttaaaacttatgctaaagcacactatagacttgaccatcaaataaaacataatgaaatctgtaaaataaaggatgcaaaaacatagcgtgaaaatttatgcctgcagtgcagttgttgtactatattttataaaaatcaattaagttcacatactactcacttaagaaatatctgctgattttatttttattttacgcaacttgtgaggaagaaaatccatgcatttgaactgtagtgccaataaaacaattttgtcaattttgagtctatttttttcaaaacaccatacgtgattaaaacacataatgcactagtatttttgccaaattttgtttttaaaccaaagctgtttttgaattacataagcacaaaatcagaatttcaaaaccagcaaacatatttaggggtgaattttaaaataagcccacttgattcattgttagacaaactttgagtgccagggacatttttgtgaaattccactggggtaaatagggtagctaggaaacgctcctcaaagtgaaaaataagtatatgcattattttcaataagttttgtttagcattttcaccctcatactaagtggttctggtgatatttacaatacaacatgagcataaatcttaaggaatttatgatgtcatcaaatgctaagagacaattacagctgggttttacatttgtgtttatatgttattttgcatatagatcccaaaaaccaatgaagagaaactttgatacaaaacatatcctgaaactaaaagacagcttctatctatcaatataaccagttgatagtatttctaagacagagtttgacagtaagtgaaacaaacaaacataatgttttaaatatgccacttcagccactccagctgtcactcaagaggctttttttaatatcattaattcaatgccacacaaacaggaattcggtctttccaataaattttggtgacaacttgttggcagaaaggaaactaatatatatgtggaaacttttattttgtcatcatgtatgtttgtttgaacttgcttaaaatattgtaattgtgggcctaatttacaccttttttcctaaaagctcaaacaaatcacaatgatcacagtgtccctaagactaatgagtcccaatttataccacagaaaatagaagctcagagagctaaagagtactggcagaatattatactgcaagaatagcaatatagcaagtatactcacttgaaatcctaataaaaccataaaaactaccactttgtatttttcattagcttatatttttacttaatgcaaaatattttgcagaaaagttttctagctagctttattgctagtaagagaataacttttattaattgaattaatttttgtaatttgtgaccaatgaggtttgactcacatcgcacattttctttaggaactcagatacttcatagatcttaataccctgatgaaaatttaagtcctaaaaggccaggaaatactgagattcaagttggctcctctaccatctttactgacagaaattcagagtgccaaaagtcagcactgctggttgctgatcatcatatctaaacattgattcttctaattgtgtattttgagacttgcttgattttagaattacaggtggaaagtcacttctctttgatataaattgcatgcaataaagaaggaggcagtcctacacaataaatatgtaaggaatggttttccacctctgcatgctgcagaaaatcccactgagttaagtagggttctaccaaggccacttaaacatattagcctattatgctccacatttctttattgttctcaaaaagctaatgaaatgttccagtgtaatgttaatgctggagtacttttaaaggcattttagaagtgatgtttctctcataactccagaagggggttccacttcctaaaaacatttaggaggccatggggagaccatgcagcctctttactcagactgtttagactcatagctggagaagaaaatccttaaagataatcacttaagagtttcggtgtgagctatagcatcatcgcaaagcgacaggaattaaaaggcagtgtaccgtactactgaatagataggtttaaaatactgtgtactgtctattcacagataacattgatttacgttggtaaatctattggttcagcacatcagtgcagtattaaggaatcaattgtttctccagagtcaattatttttagaaaaataaggaaatgtgacctatcactgaaagtcagtatgtagaattaaacttggccagttttcttcctcgctggggtcttaattttttcaactgtaagataaatgaatcagacttgtcagtatctatgatcacttctagcattaaagttttctagttttaagattctaaataccaacactgtatgttgaggaatagcaaagtaggaaaagaactgggaataaaactatcactgaattattaactttccaacaatcaaaattctgtaattttgcctttagttgccataaacaaccacctcaccttctgaatatcaacaataatatgaatgaaggaaaggttgtatactaaggtcacaggtggtatggttgagattaaagccaagactgagagtatagtaatgaattgagaaatgaatcatacacttttgacctaatatgtaatatgtcttcccaaatcgtcatttttatacattcattttcaatggaaaacaacaacttgaatatcttagaggttttttcccccaagaaagacatcaggctgtaatctccccccacaaaatttaatacagttcatagctcatacccctaccggataatccccaaaatgtcttgttcctttttcaaattagacatcagcattcagtataacaattaatcaatgccaacaatgttccatatgctttattagcattcattcaccgaatccttccatgaacactaggaagtaggtactaataaaaacagaaacaattttgaagtacagaatctcagaggtggttatcagtaattctagaatatcagtctgacatatgggtccctccactttttttcagtgcacaacgtgaacactgtgtggcacagtgtttcaagaattaatgtttgatttatatcaaagcattatgttttttacttcatcttaatagtaatcacaagagtgacttaagcctcctacatgaaagcagagatagaaaaaagatgaccttggaagttacatattttcttttcctgtaagtatgaagacatgtctataagttattagaaccataaaaaaccaaaaaactaataagaataaaattgtgaaagaatattgaaacctccttaataagcaggttcttgtaggatattgaacaaggtatgtatgttgtagccctgatgctatatttgtgtcatgctgagcaagctacttaacatttaggtgcgtaagggtttttttccctaaagtgggaggatttagatctctaaattccttaccaatcataattttagagcaaattatctataaagtcaattaataatttgccttgcttcatgtattacataatagttgctaatcaaaatgaatagtattatactcacagctttaactaacttatagctaagatcaggcttgctttgtaaacatctctctaaaaactcagaagtccatgaatactaagactttttactcctcctgtaatttttgacctctactggaaatctcacctgctacccctgacctcgaatattgcaagtattaatacagtttctgtatatagtgtacttaagccaaaagtcagaggcatgagaaaggtaaaggccgggacaaaggtactacaattcagctacacacttgtaatgcttcccattagttcgttagttatattagttccagaaactattttaacacggtaggctgatactgcaagcaaaaacaaaaatcatgagaacaatgaaatagtaggtcttagcgcttaagcatatctactagtagtaatacttgacaagcagcccaccttctttgtgatctggaaatgatttgatgataaagccaaattctagaaatataactgctatcttttgggagatcaaaggtcatgtgagggggagagctaaggtcaagagcaagccccttaagcctactccagaaatttcactagagggtgctcttgggctttcatgacttctcagttcttcaataagaaccaagtattgcttagataatatattctgcctagtataacttggactccatcatggatcccatatccaatacttcaatatagaattaaaagatatctccagcagaccctgggcctggttttttattttcctgtgtaatttccttgtttctactgatagtacacttgtgagtttcacaaatttaagacaggtaagagatcttaagaggtctccaaaagtctacattctattaaacaaccacagaaacttcctaatacatcaaagtaagattaaatggggattaactgataaatctatttttgcaaatatatgttttacaaacatattttaatcttataataggttcataatttatatacctattggaagaattattattccataagatctgtagagaaagtctgattgtcaaatagaataaatttcaattatttatatatgtattattcatatgtctcatgacatcaaatattgagcaccaagtaagtactgaataaatatttcttgaccctttattgcacatacatatttttataacacgttccaacaggatgacatataattaaattttaatctctacaccatatgtttgaaattttttctataaatgcagtttcacctttctggaattcacgtttaatgacttattctgtttatttctaatgataatcgctttttatatactttccatttttgctacgtttttaagagaaaatgaaacatggaaattgttttgttatgtgattaactttttaatgtttctatttgtttattagaagattaagaaggttatttatttctacattaaaatattggcaatggcatatatcaatgcatagtgattttcttaagaattgcaatgagtgactcagtaaaattcttcttcactttcaggatgtaaagaattatggctactagccattatgcagggtgatgttcttatcacacataattgaaaactcaatagttttagcatctttagggttgacagtaaaattctgaggttgactatggaatgctaagtctttgaaggcacttccaatttggctaaacttacagtttcattattccttaattgaattaagtttaagtttctcttaaaatcagcttgaggcttttgacaaattagaaatttgggtcctgaatagtagccctttacaatatatgaatctgcataaagatgtgttttaaatgcctatttgataaaaagataagcctggtcacttatggattctagctcctttcaacatcctgcatggattgcaaccagtgtgaaaaattggggatctttaaagtggtctcagatctcttataaagcagtcacctgggctcttaaactgtatggtgcttctcaaaaagggctccttaagtatcctatctgatgtatgttattccccaattcaacttgcaaaggacagagtcaccagcatatattcaaactgtatttcatccaagtgggttgtcaataagcttaaatcactctatgaagaactggcaaaattcccatggatactgtgaaaataaagggaatcaatgaagagatataattattttagtctcagatttaattaatttgtgggagaggtcattttctctcaaatatattcaagtttcttcaaacacaggtcaatgtttgccagctgataggaaaaaagaaaacatttagtctgagtttcccacgtttatattaatctctgtatcacagctaaataaaatgtttcataaatcttcatataggcaaaagagagttcaagctaaggcagagtaacaagtattgccaatagaaaataacctcttaagtactgtttctactatttcctgttctaatttttctattggagagaatgaaacaaagtaatttcacacctggttttatgaatcagctcactaaagattctaggtagaagttacacgggagatgcaagtataacttcattattttacaattagaacactaagacaaagaaagaataaaagtggcgtgctatcccatgccatgcagttagcatatggcaggtcttactcagagtccccagttcctaatctagtgttctttctactgcaaaggtttccagtgctgcttggtttttcataaaggatctgtatatcatgtcaaaatttcatgttgactttccttgaaatttcagagaaaaagaaggcagtataagaaaaattactcttcattgtctaactcttcaagtcagacagcattcctatgtgcaatgatcctcgatacagtctaggtcaactgatctctatgagttttcatactcattaaaatgtatgcatcacaaagtacaattaatgttctcactgactttagggaccttgcatgtttcatccgttccctaacctatgccatcctgaatccaagaggcaccctgtatttctctgaaagtcagcccagcatgaaaatactgaaataagagtgcaggtgtactctttgctttaagaagacacaataagccaaattctgaacttaccaaacagacaaattatggggtgattattcacattttaaaaggattcaccacaggatgcttttaaatcataagctgctctattgcattttaaataagttgatttataaagcttcctttacaaggacttttcactatccagggttcatggttccttatccaaaggcaatgagagcttggtgagcataaagtcctattacctgctaagccaagcttcctttcccaaataagagaataattaggactgtagttcatttttgaaaaattaatgagtctctcactcctgaaaaatttaatataccctgagcacttattatgtgcctggcacagtgctaggcattttagataatgatcttatttactcctcctcaccacaactctaggagattagtacaattatcccaatcatggatgaggaaactgggactcagagaagttagagttaagtaacttgactaaattcttgcagcaaataagtgatcgtgccaggattcaaagtcagatctgtctggagctcttgcccttacatattttacaatataatttcagatgaaatttaatgacgtctcttacctctgacctaactgagcataattgcgctccaaatgtactattccagtgcagcaatcctgtctgtagcaatagggaccagtcacacagcctgaatacaaaaagatagggggctcactaacaaggttgcctattctggtcactgcactgccatattaagcccggatttatctcctgcaattcctacctattggatctaactttgctctacagtcattgagaacaattaaaatcccttccccccatacctatcatatttctcttatggtttctttcttctttttttttttttttttttttttttttagtatccagtgcctccaacctttttaaaatataatgggtttatccgctatttacatatattttattctttcttgaaactggttcttctggagcacagagaacttataaatgctatttctaagcgtttatgcaactaaaaattattggaacaatacacagtatagtggataagggcgcaagctcagaaacccagactgcctgggttcaaatccaggctttaccaattaatggctcgatttccttggtgaatatatttaaagtctctgtgcttcagtttcctccttcaactatgaaatgaggacaacagtacctagttaatgtggctcttgtgaagatttaaaagaggggcaatattaagcaaaaggcaatataaggaaaattactctacagtgtctaactcttcacgtcaggcaacattcatacagcaatattcatatagcgcttacagcctgctaggcagcaattagggtactgcctaggttgtaagctttatataaatgtttgtcattattattgatggtataggagtgaatgaatacttaactgccttggaaaaatatgacctatatcattgtatgagattgattttattatccagatataaagaagtcaagctcaactagaaaaggcacttgactggagaccagagatgtgcttctagtcccaactctttcaaacactccagatgaaagatcttggactttatctacctcatctttttaaacagaggaatgggactgtacctctgcctctaaaatgatatgtttttattctaggattctaggatcctattccacctggaccctgcttaaatttcattactcattatgtttgaaaactaccattacatactaacattttatctgcatgtttatatctgttgacatttcaatcagcttatctgcattgttttcacgaaacagaataagcctctgagagtctatagacaggtctgaaaaaacaaaaggtgttgtgatagcacagagaggaatttaatgtcactttggaggaaataacctaaagtcctactctgccaagccagtaaaatcctgtcctctgcctgcaacacctggcccagtccatgctatcttgctgaatttcagtgcagctctttggataaactcaaattcaggtttggatggaataccaggttgatacaacagtcattttttttcaacagaagtgcaggttggactaccttttacctaccaaaatcacctcattctttgatatatagaacatttagctaattttattatgacttagtatgccagtactcctcatatactttattgtccatccccagatctagtgaaggcatggtgactggtatcagtatcaaggcaattgtcttcaaagaatgtggcaatctattctaacaaagtaaattccacaagggaacaaggggacagccactctaaattcactaatgacaaaaactttgatattttgtaattaagcacaatgcattattctataaataaaaatgatgtccttgtaaatctaaaagctatgaaacgttatattttctatttctaaaattctctaggctcaaagtcaatatgtaagtctaatttttttaaatgcacaaaaagctatgatatttcaaatcttagatactaaatttgtgaattgagtgaacctggcttctcccgcttagacgtgaacattcctgttagtacataaatattaacgaatattttaggccaaaattttgtgtttggtgattgacttatggaatcagtctaagtaggtgtgaaggtgactagacttattttggaacatgtacaatttcataacagtaacacggccgttaaataattctctttaaatgatatttaactctcattttaactgttagcccttgcattatgaagcagcttgatgctgaagtaaagctaagatttcagtaaaaagaataagagctttatattctagaaggtagaaatcctagaaaaatcaaagaaattaaaattttggaagtttttgattcatttcttatattttaaataggattctaaaataacatatctcttctatacataagaaaatagtctggttcacatattttgatttattgaaaagttattacagtacaactcaggttgccgaatactaacattgctataccagcgttgttttggtaaatgtttgcattataactctggttgtattacagcaaaacactcagaagaaagagagtaacttttacacatattacatagcatctgtacagtcatcccttaaaatgcaacaatacaactgcaacactttaaatactttaaaatacaaatgcctttgaagaacataacttatatactatttattaataggattaaatcaacatttttatggctctctaagcttatcccagaaactcttccattatttcagtgagtaacaagagaattttttttattgtttatttttttttagatatggtttcactctatcacctaggctggagtgcaatggtgtgatcttggtacactacagtctctacctcctggactcaagtaatcctcctgccccagccttctgagtagctgggaccacagatgcataccactacacctagctaatttttttttttttttttttttgagatacaggttctcactatgttgtcagactggtcttaaacttctgagctcaagcaatcctctccttggtctcccaagtactgtgattacaggcataagccactgcacctggccgagggtcttatagataggtaatattaacaccattttgcaaaattttaaaaataaggcaaggaaaggttaaaataagttgtacaagttcaacaagtagtaagtgaaattcagccagactttgaacatagacatcctgttttagaatctcaatgttctttctatttttcccaaagcaatctcactaactaatgtacgtattagattgcactgatatagtaaggacaaagaaaacccattttctgtgtatattgctattgccttagaaaatacaaatagctactgaaaagaccaatgctatgaagcagtttggtaatacctattaaaaattttaaatctctgctacactgtattaatattttatatcttaaaaagttaaagaataatagagcctaacttagatccttccaaatttgtaactcttcaaaatctaaaatgaatttctaattcatggcttataactgctcaagtaggaaacttatgacaaaaccagagacaagcccttccaacagtgcctatgacatcacagatatacaaatctgccccattttacagtacccaaagaagaccggaattcagctgttatcagacaataataaacttcttctggtaagttcgtctcttagtcttagatttacattcccactgtcagcaagaatttttaagttaaacatttttgaaaagtaaaaattcaataaatagcatttacattatccacagaatgtattttcattgctttggtgctaaaatattttattttaggctgttcttttttctcttttccatccacctcttagctcctttgctccaatccttgcacctttccacccttgttctctctctccctgaagcctcagggaagagggctgcaaactgtctggatgcctggaccctcacgctcctgagattaaacccagacccgcccatggcaagagtcccgttctttgtctgaagcaagtgtctgattgagttagatatggagtcgttatcacattgaaaagaaagcctggattttttttatctttggtattaaaatatgttatatttgtattaaaatattcatctaataaactctcccaaagaaaacagtttcattatattttcaccgtattttctcattccattcttaaagccacagtgaaaggaaagttgttgtggtcaccccaaaatactctttcccacttctaatcaaggtctggttaggacaaagctaaacaataatttctactttgtatttaaggacaccagctactgtttacccactgatgttatttatactaatagggggtctctgaagtgacacctaaagcttgctaaaggtttcaggagggcttttgtaaagtcaattttctcccagtatcgctttatccccacagagtaagcagatgggagagttctttttccctcaaaataaggcttatagcattgactagggaatttaaatgtatctttacaattctcaacttgatctcccaggaagagcttttatagatttggatttttttttgtcataaagtattctatttatttcccagcagctggtgtcaaaaaagttgtttttttaatattccttttaaataaataaaatctgttttcatattgtgtaaaattagttttgcctgctgtgagtttgtggcattatgaagtgatcatttcttcccatgaattatttaaagtgaggatatcaaaatctgatggaacaatacaatgaactatacaatacaatttaattttataatacgccagttcataatagtatctcaaaatgcacagtagttgcaatacattggttcagaattagcagatcaagtataagcccctcagtttcatattttagtatttgagaatcagttctaaattttctagtggactagagaatcatgcatatttggtagtccatagatacctaaagacctttttgctaattcctcatgccaggcactgatgtttgcccagcctagatgacattttttttctttttttgtaaatctttaagacattgagtttgacagctgttaaccctttcattacaaaacaatattggtattaatagcatttcccctggagttctctgatcactttgtcttagggaacaaatgcacctatgtagccacaattattcttactacttattctcactgcagagtttctagaagaagggaaacaacgatccattcaaatgccccactgcacttataagacttacagcaaagctgctaaaacttaaattttaaggtgagtgaggtggcataagggaaatgaatgagctgctaatgaatagggcaagacatgattagaagctataacaaagtctgactcaaggaaaggccaaaggttatcttgtatttgatatgtgtgttttaataaattataatcaaaatactacactgactttttcctcagtggattttctagcattctataagagatattttgtctgattaacttgctatattgaaaagtgggagtcagtatatattacttacaaattctcaaatagcctctgaaaaaattccaccacaaagattttaaaaaatggaagtatatggaaacaagatgctacaagatgttggaaatggttttccaaagcaagaactggcttaaaacatagaatagcaataatgagcacttttcttgttagttctacatactgtaaactaatttatgccccaaacagaactctggtttccctattatccatgttgccacttcctcctctaatctaactgtacttctctcgtctcagtgaaaggtgccaccatctgccctgacagttgatcaggccaaacatcagcaactctttttgcctcacccaccacatctaatccatcaataagccgcattaacccaaacacaaaagtacatcccaaacccgaccattcctcactatctctgctatcacgaacaaaaatcacaattatctcttatctggtctcctaactgatttctctgcttccactgttgcaccttataatccattatctaaacagaagctagaattcttgaaatgcaggaaagatgatatcattcctttggtaaaattctacaagttatatatagtgcaataagaagaaattaaaattcaaaaccatgaccagtaagtctctccattatctgttcatgaccatctttctgttctcatcttctaacatttttcctttgttcaccgtgcttctttgcctattctgtctctaaaacaagccaatcttattcctattagccctggtctagctatattgcctctgcccagactgctctgttcctacatctctgcatgactgatttcttcactcgtagctcaaatattatctccacagaaaggtctttccttgtgtggccaagatagccaaagcatccccaattcattctaccctgctttacttttctcttagaactaattactagtatcttccttatttacatcctgtatgtatgtgagtatgcacatgtacctgtatgttcataatctctattacagtataaattccatgaggatgaggttcttggatgtgttagttatctattacagcataacaacttacccccaaacttagtaacttaaaaaagcaaacaccattccacagtttctgtgggtcaggaatctgggctcagtataggtaggtgcctatgggtcaaagtttctcatgaggttgtgatcaaactgtcagctagagctgtggtttcatctgaattctcgactgaagaggaggagacttgccatgtgggggtcttcacatgtgaaggtcttcacacaggggtcttcacacagggctacttcatgacttggactttgctttttctcagggagagcaatccgggagagagtgatagagggactcaagagaaaaaccacaagctttttaaaaacttaaccttggaagtgacatcctatcacttctgtcctttattaaaaatgagtcactaagtccagccaatactaaaggagaggaaattagacaagcaggtgaaaatagaggatgtggagatcaggtggggccatcttagaagctgcctattataattgcttaccagtacattcttagtgttcagaaaaatttcggactttcagtaaacaaattaatttaaaaaatgactctctcatgaattagttccattggacattttgccaatgatcaagaaaaagtagtgaataaaatctcactcaagtagtgacattcaaaccaaaagagatcaccccagtaggaaggtttcattaggatgtgtaagcagaaagtagcagtacagcctcagtttcttcatctgtaaaatataaagagtagttgtaccatactgtcggagacctaatgaggcaattcgtgagggcctcatgaatcaaaggcagtggatagatgttagctattatctattcttaataagtataaatgcaagggaagcatttttagggaaaataacacaaatcatgtttttataatgatggtatttgatacatcaggtttaactcaaaaaagaatttaagaaccactttcaattgtttcctaattatattagcttaaatatgagactgtaaccaaaaagactaataaaattttggaactcatcaagtgtactgaaaataggctagaaagctttccatatatttatgtaaagttttgacatcttcgaatggacataatgatgcatttgcaatctccacaatcatgagggcctaaagggagagagatgtgtagagccctggaattgaagatccatggtgtgactggggggggaaagtctctgaaaagttaaaagaagacagggcactgaaccctgatctaatatgtaatggggttatgaaatttaggcagagggtagtcatagaattattcatgaaatcctagaatagtaatactagaggtcaaacttcatattcagaaaagtacaaatagggtcaggtaataaagcactattccatatttttttttaatgcctgccttggaaggtagcaaaacttaagtaagaagttggagaaattcatagaagatataccaaaatagactgtagtggatgtatggattggagtttgccatcagagaggcaaacaaggatgtctttaaacttatttactgatgtttccatttacaaccaaatggggtagatgcatcccacatttaaagaagccattccaaaagcaggaacagcacccctataagatgttatcattcctgttctattaattacagtgtcactcactcttttactgatagccctgatggagaatcagcatgaaccagccattttcctccctgtatatacattagcaaaactttgaccattaaatagttcaaagataggcttgcctcgctgtctcatgcctataatcccagcactttgggaggccaaagtgggcagattgtttgagctcaagagttcaagaccagctttggcaatgtgccaaaaccccatttcgacaaaaaatacaaaactgtgcttggtgtgttggtgtgcgcctatggtcccagctacttgggaggctgaagtgggaggatcacttgcgtgcaggaggtcaaggctgcagcaagctgagatcacaccactgcactccaccctgcagcctgggtgacagagtgagagcctgtctgaaagaaagaaagaaagaaagaaagaaagaaagaaagaaagaaagaaagaaagaaagaaagagagagagaaagaaagagaaagaaagggagagagaaagaaaggaaatctcagatatatctataatagaggaatctctcaaaacaatttctgcaatatccagtgtggtggatctaatggtgaccttccaaaagaaacgcccacattctaacccctgaaacctgagaatgtgaccttatttggaaaaaggatctgtgcagatgtaatgaggttaaggatttctagatgaggtaatcctggattgcccagggaagccgtaaatccaataacattttcttataagagaaaaaagagaagacagagagagcagaaggccatgtgaagacagaggcacaaactggagttacatagccacaagccaaggaacctctggagccaccagaagctggaaaagcaaggaatgattccccctcacttagagtcttctgagaaagtgtagccctgccaacaccttgatttcagacttctggcttccaattctgggaaagactaaatttaagctgttttaggccatcaagtttgtgctaatttctaatggcaaccctagtaaattaatacacccagaacaagtaattatgttttccagagaggtaatgcaatgtagtaaaaaaaaacattttgagtgagacagatttaggtttagacctggggtttctctatactaattgtgtgtctttgaacaagttactttatatctctatcttcaggttcttctttagtaaaatgatggtaagtttcccttgcagggtcgctgtgtgatatgttatttctgctcaattcagtactcaattaacctgttaatgataaattcacgcatgtgcaacatgtctacagacgttaaaaactgttgttttccttgaaaatcaacatacattttagcaaggtattaattagaacatatgggattgattaatgtggaaactagttgtacaataccaaatgttttaacaaacctttattacaacctgactattcatgtcatttcaaataactttcctggttgtcagtggaaccatattcagtctgttcttttactgtctcatctgtaatatcttccatagtttctaatagagaaataatgaaaaagccagagtattagtagaaaatgtttgcgtctagcttgagcttaagtcagatatagagtcaaaattgtgatcacagaattctcctaaatgttagtctcagaaaattgacaagggcataataatttctaggacagagtagtcaaattcatacccaccattgataccttcctatccctgacattaaaacagacaaaaaaaagtagttctcacaataattttatagaggaagaatataggaatcatgcagtttaggtatctcttattctggaataactccttaatactaaattgaggctctagtgagagctattcaaaatgcataaatgaaagtaaaataaattttcaagaaccgatctttcttacttttctagcaacaaacttttgaaaaaaattaaaaattttaaaaagtaaaatatgtaataaattagctataatatcatttgtagctattgtaatttattttttattcattcactcaacaagcattattaaatgcctagtaaatgtcaggcattgtgttaggcactaaagacgcagccttgaataagacatactactccctaccttaaggataatttaggcaaaacaatcaatgataataaagtgcacattacaggaatgcaatgtaaggcaattataattagggaatcggggaaggcattccatagaaaataagctttaaattgagacttgcaagattggttttatgtcagtggaggtgagcacatgggggaagaaaagagtaatgaagagtattcaaaacaaagagtagaacatatgcaaagaccagaaatgagagtgagcatggtgcaccgaaggcatgaaaacacgtttagtatgactagagcatagaatgctagggggaaaggggcatgaatcagtctagaaaatgagacaggagccaggctggaagattaatattaaggaagtcagaatactgttgcaataacttaggtgagataagatggtaccctggatgagagtagtagttctgatatgaagaagattgaacagattaaggacattcttaggaggaagatcaaaagtaccaggtgattgactgcatgtggaacagtacaggatatggaaaaggtaatgtcaagtttctaatgtcggcaattatgtagcaatactggaggtgagagcatgtttggggcaaagaggtgagtttagaacatgttgagtatgaggtgtctgtgagtcatccaagagaagaggtctagaaggcagtgctcagagagaagcctgagctggagaaatatgtggtggtcattcagatgcagatgctaatgaaacctatgggagaaaatgagattgcctgggaggactgcccaatgtgaggagagagcctaagagagagttcagagaacatcaactttagtactgcaaaggttaagtaagactagcaaggctgcctctaatgagactttatacaacccccttcatagtaagttctcactttctacagcaattcagggctcacacttctcttctctcttttgactctcaaacaaaattataagataagcagggtgggcaacaggacttcttgaagataaaaataatctaggtttcaagaggttaggcttgaggtcatggatctctttatttccagattagttttctttccatgccattactctactcccaaggattagctccttatagcttcttctttgttgttagcctggactgttgcctaggtgtcattttagaggggtgaagtttttttgcattatattatattaaaaattttctccatctggaactgatgaaaggacagaagggctaacctgaggcaaaactcgagagtggcagaactgtttcttagagcttccaacctccctcatctctaccttaccccttctttaaaaacttttgttcatttactcaataattagttattaagataatttgtggatatggaaattaacaagccacaccaagtctctaccttcacggagcttacacagtagtaaaatggcagacataagaaccaatgcactaaaagttaagaaagaggagtgtagaaccaggagacaccaagggcatacctaacctacactgaagaggttaaggaacacttcttagaataagtaatatttcaactaagatctaaaaaatggttgaagttgactgtcttggccactgttgcaaggaggaaaactgattcaaccaacgaatttagaaaattgtaatggaaacgtataggttagtgtgccatcctcttgtatttttcaaaaaagaaatcccagaatttgcaacatttgatccaaaaagaatgaatctcctcaaactgtggaattcctgcactagtactgatatggtttggctctgtgtccccaaccaaatcttaccttgaattgtaatcccagggacctggtggaaggtgattggagcaaggggggcgattttccccatgctcttctgtgatagtaagtgaggtctcataagatttgatgcttttaaagttatttggcagtctctctcttctctctctttttctgtccttctgccgccatgtaagacgtgccttgcttccccttcaccttctgccatgattataagtttcctgaggcctccccagctgtgcagaactgtgagtcaattaagcctcttttctttataaattgcccagtctcaggtagttctttatagcagtgtcaaaatagactaatacaagtactatccaagtataagagaaaacattactctcacctatctcaactcataccatgtaggcaggcccttaatctatctccccctgagtccagatttgaaggcaaggaaagaactataagtaccttgtcttatttatttttcaggactctaagttatattatctccattatacagtagagaaaaatcatctgaaaaattacgcaaatctgcccaagatttcaagccagtaaatggggagctaggtcttcattctggtcagttggctccaaagcatctatttattctaccttgaatatatatacacgtatacatatattttacagatggtgtttcactatgttgcccaggttggcctcaaattcctggcctcaagtgatcctcccacctcagcctcctaaagctctgggattacaggcataagcccccatggccagccaagcatatatatatatatttttttttgagacggagtctcactctgtcgcccaggctggagtgtagtggcacaatcttggctcactgcaacctctgcctcccaggttcaagtgattctcctgcctcagcctcctgagtatctgggactacaggtgcctgccatcacacccggctaatttttttttttttttgtattttgagtagagacaaggtttcaccgtgttagccaggctggtcttgaactcctaacctcaggtgatccaccccccttggcctcccaaagtgctgggattacaggcgtgagccaccgcacatggccatatttttataaagacttgtgcacagatgctcattgctactttatttgtattgctaaaaattgtaaacagtctaaatgcccatccttaagtgaatggataaacaaattatagtatgtctatacagtggaatactatgcagcgaaaaaaatggtgaattattgatacatgctatgacataaatggatctcaaagtcaatatactgagtgaaagaaggacaaaacaagtacagaagattctatttttataatagaattcaaatttttataaaattctaggaaatgtaagctactgtgtagtgatggaaaatagatctatggttgcataagaaaattactggagtaaatatatatatatatatatatatatatatatatatatatatattagctgagagtggtggtgcatacctacagtcccagctactgggaaggctgaggcaggaggatcacttgagcccaggagtttgaggttacagtgagctatgatcatgccactgcactccaggctggttgacagagcaagtccctgtctcaaaaaaaaaaaaaaaaaaaaaaaaaaaaaaaactttcatttctcttgtgtaaacatgtaggcatgaaatggctggataacatggtaaacatacatttaactttttaaaaactgtcagactgtctctaaagtggctgtaccattttactttactgccagcaacttatgaggcttccagtttctccatatcctcaaaaatcttgctatgctcagtcttttaaatgtcagtcattctaaaggatgtgtaatagtgtctcatgattttaatttgccttcttctaacaatgattgatattgagcatcatttcatgtgctcatcatataccatctttttctttttcttttttttttttttttggtgaagtgcctgatcaaatctttgcccatttaaataatatgttgtatattattgagttttcgaagttctttgtattttctggatataagttctttatcagatatattctttgcaaatattttcttacagtctgtggcttaccttttcattttcttaataatgttttcaaagtgcagaattttttaattttcatgaaatctaatttatcaacttattcttttatgggtcattcataaatgaattgtgcactaatcatctcctaacatactacatgagttacttatcttttcactgatggatcccaagtggctagtaaagtactgaatacacattaggtatcaataaacatctgatggataaattaaaatttcaaatagtgaaagcaaaattatagaaacttagttcattggcagcacagaaaataaaatagcctctagtgcaaagccatattcaattttttgttatctgatctagtatgaagtttgatcgatacaaggacccaaatttattaaatcttgttaaagaacctgatgctctctctctagagacaatcctttcttccccaaaatagaaatgtgaaattccatagaacttaaatgtaaagcagtaagtcccctacccacctctgtgcctcacctcgcccgtgactcaagtgctatatgaacccctgcaaataaatcaaggctgctgaattctcaaaagctctaattgtgccaattgtaaataagcctcaggatgaatttcaaccagcagtgtccccaaaaccattatctgcaactataatccattacttttctttcataattaatttttctaataggtcagtactatttgttttgtttaagcgctattccagcaatcccattttaccaacaaccaatgtcaattgtaattatatacatattttctattatatacaacaaatacattcttatattatgcgaaacactaaattgggcagtgattttttaatgagtaataaggtaatatgctacattggtgctcaactgcacttgtcttgaccatatgaattaagagtctagtggaaatttataagcaccttgaggacttccaggtatgtgggtgcttaaataggtactcaaaagatgctgcttattttcatagattttaatgtctaaatcactgggaacaatgacaattaccagagatatagataggtggttagataaacacacaagagatatgtatgttagagacatacacattatagagagtataatagggttgtatacacacctacatatacctatataatgtgtgtgtctgtgtgtttgtatgcatgtgtatgaaatcaaaatgcaattcactggaacactgaagacaaagcggtcaagcagctgagagaattcaccatactgatgagctttcctcctcagagagcttgctcctcaggccctcactcaaaggctctttattctttttagatacaattctaaagagtttgatatctacttttccatccacaacagactaaatgctgaaaactcgagagcataggtgagcttgtgtttgatgctagctgcaagcagcctgacacagggagaaatgagagctctcctagagccaatctggggagtgtcctggtgagggcactgagacctgctagttaggaggaggcctagtgcaaacaggcaaaattgcttggatgaagggtaatcaatctgagcctagttcttttggatgaaacctttgagaactcaatgacaagaggatatggatccaacaggagactagtagagaatacaaattcattattttgctatacaatgctagttgcattttaaacaattgtttctctatgaattttactaccaggcttttctgaaccattctgtgtgaattcaatactgcctggatttttaaaaccacttctgacactataaaccagagaaatctttcttaaaagataataagaagatggggccttgcatttctcataaaaggaaaatgactccaccataagtgtattcattacacactgttgaggcatgaattcagggaaaattagactgaatatgagattaccatcctaactttctgaaacactcccagcgctgtcaccagagttcttacttcaaatatttactcttgatctaaaaatatcttagtccaagaaacggaatgattactccacagttaaagtatatttagtgatctgagagaggagaagtttcatttcactcaagcaaatggttttagtaccacaaccaattaatagcttcatcatgtgtgagccatgattataaaggaatcggactaattttttaaacaaatctataggcttctcacaagggctatttttcacaatggtcaccttggaagaaagtcactccagggataccgtcattacttcagatttgggaccttacctttagaattggttcatgagaaaaaaaaaaaaagaaacactacatgcttcatagttaccctccccacctaacactacatatccctgatcaccaactttgaatatgcctcatttacactgatcaaccaaaagcctcctggaaatggtaacacggcctatttatcctgggctttactgggagggtgggggatgaagagggtttataggaattaagagagtctatttttaattatttcatctgtgaaacatatgaaattcctttggccaaaaatgcaatataaaactcagattatcaagggccttttcgtgggaccagtgaaatggagaaaaaagtctccatgacaaaatagaggacttttgggaatccttttttttctgaggtttgcatgtgtgtgtttctagcttggctctcacctgaactgctctttcataatctactgtagtcattgggtacctggaatctgggaaaactccaaccttactccagcacttgtgcaataacacagtaaggcacatggagtcaagtttaagcacttagtccagggttctttgcaccctgtgggccttcagtaagcacttgttgattgactgaatgcgtggctcactatcaatgtgaattaactatatacatactgcattaaaatccaacaacccaaatactttctagctttcaggaagtaatgcatctaattgacagaaccactcttatgcctcctaatccccacttcctacaaaccagctcaaaggaagagagagaatttgaagaaacaaaaatgaacataagaaaaacaattagctgatgcactctgcaaagcctgtaatattatctagaatgacagcatagccattgttcgtgctgccagagccccgcgtgtttgctagctcacccgaggtcctgagagaataataaactaagcagattagatgtagactgatgcctccatgccaccaccaactcacacaacacacacactgttctgagtgtctgaacacatgcgggcaggtaaacccagaaaatgggcactccatgttggcaggaggggaagaggctgccaacaaacagggcctgtttattatttaacagttggtactgctagaggcctggcaccgctatagagcactctctgtttcagtgcaagtcagcctgattatgagagcgtgtgagccaaatcatgtttaccatagtctgtgagaacctctgtgcccccaacagacatggaaattcttacaatagctctcgtccaaacagagaaaaatcactcctgagatggaggtaaagggccccacgtgcttaaattttgtctgatcagctggctcagtgtctctacatgtagttgttttttccctgctcaagacaagtcattcctctctaatgatacagtttctaatcctctgcctttggttactttactttgggacctaaatcaaccaaatactatgtcaatcacccatctactaatattgcttatgctgtcctgcacgctttggcttttcagcaaaagaatctgctgcccagggcggctacctcctgcttctccttcgccagggctgcctctgcagtaagtctcctctctgccaatgtgggccacaggtggatgccttcctacaaatccaatcagcaggataatgtgctactatcacaagagtggaccttaatgacaaagagccctgcttagatggtcaccccattaactttgatttgattattctgccccagcagaacacttggcttcacaaccacagatggcaacagtccaacataaaacctgtagacagagtagtcatgttgggttcatacattttcaaaatattaaatttcatgtaaaaatataaacatggtaagtattgagagagtccctggttccctaggaaagcactgttttcttttcttttttcttttttttaacaaaccaaggtcagagcactgagacaattgtgctaactaggcaacagggataatctaatcatttcttttgaaattcaacataaatcaacatttcttttaagtgtaagaacctggcttttatcttccatatacaaccaaggcaatctttgatactttatgtgactctattctatacaactgtttttaaattcaagataaaattggctctatataagctagttcaatattttgaaatttaattgtaacttggatacacttcctctgtgaccatgagtaaatcattaaaatgctttctaccaatgagaataaaggcatagcaaactataagtcttacctgaaactgtatgcagtgattgttttgtgttttgttttctaattgacagttgatatttatacactaaattatcaaactactatttgtttttaattaattcctcaactttgccactcaaggaaaatgatatatgctttgtattgttaagtaaatacataattttatacttatcatgttattatggttttcaaagaaagtagttgtccctaggtcacagattatatacacatgcatagcaaaaagactttacaaaaacaaggaaaatatgaaaaaataattgcctagcttggatcaagttaacccctggtttaatttaatcatctcctctactgaggatctgataagagattcttaataacagccccaaattaaggcaatagaatcaggaaatctttttttttttttttttttgagatggagtcttgctctgctgcccaggttggagtgcaatggcgcaatctcggctcactgcaacctccacctcctggattcaagctgttttcctgcctcagcctcctgagtagctgggactacaggtgcccgccaccacgcctggctaatttttgtatttttagtagagacgaggtttcaccatgttggccaggctggtgttgaattcctgacctcgagtgatccgcctgcctcagcctcccaaagtgctgggattacaggtgtgagccactgcgcccggccaaaatcaggaaatctttcccaaaacatcctgtatatagcaacactcataactactactttatggcagaataatggacccgattacaggttcacatggaaaaagttgatatttcagccacgaccaaaatataaacaggatttttcatagggagtagatggtgtgttcatagcgagataggtggtgtgttcatctctgtgctgagatacttcatcttaactagtaagaaacatagtaatccctcacattcattaagaggtatgctgtaagagcttaatatgtatacacccatttaaccttcataacaacctttattttttagtgactactatttacagtgattactattattttctccattttacagacgaggaaactaaagcacagagtggttaagtaacttacccaaggccctgcattatgtaaataaaggggctaaaatttgaactaaggtggtctggctccagagtcaaagtgtaatcactgtgttctgcttctcataataacgatcactctttctgaagcttgtgttcaatttaaaactgtatattccctgaggctgtagaatgttagagctgaagtaatttaaaatgatctaacccatggcctaaagctccaggtggagagaggatgtttgggaagactgtgtagcctcaaaattttgtggataggcacacttttctgggaaaagaaatgagccactcatctagtctaaatgtctcagttgagggattaaaaaaaataaagccacaaagcaatggctgtaaatgctgcatattttaaggaagcaatataaaaagaaccaagcccagaaaccagggctgttttcattatcctgtctacccaaactctcttaggtggctcccttaaagccagaagaaatctgtgtgagggatgccgagtcagcctgtttctctacttggctccacatgactcagtaaagcaaatcaatgagacaagatatctactcatgcaagaaaaaacagaaatctagtgtgatgttttcttgactattcaatgctaatggaaaaaagttggtaacacatttaagaggtaagaagaaataaaattgtctctttacaaagttgactgatttattcatttagtagatacacacacaggtatacacacatacacacaatttatttattttagtggtagcccagaaactttctgaatttcttttgtatttctcttgagtcttttcctgtaatttatatttacttaaaatttatcccttatgttcaaatttttcacatatatatataaagtattcattataatcattttaatttcctccatttctctggttatttccccattgtatttccaattttgtgcatttgtgggatttctcatttagtaattaaatcatgtgatattggtttgtttattgttctgttattctctttgaaaaaaccaactctttgatttattagtgtgtctcttttttattttctaattccttaacttctgactttatttttttaatcaattccttgtttctactttgcagatttgttttttgttcttttaaccaacttcatgagatgaatggtaatacgtttataattattttctttcctgtaatagtcatgtttaaagatatggatattcctccgaacactgttttatctatatctatacatacttattttctgtaaattctgtaatgcctcttaagcaaaaaattaattttaaaaagttattggtcttttttcttatcaattcgcaggagctcttattttttggagatactatttttgtctgagatacgagttgccaatcaaaatgatcactttttcatatcatgtaaaaactgttttttaaatttttatttgcttgatttttcttattcacaattgtggtaatatcagtagaagttcttctccttcctctcccagctttttgcttcctatatggtttttggtcccattagagttttattttcttcttctacttccttcttgttctctcacagacaattttatttctccttatttgtcttatcacttattcaatcctgtttatctagtttttgaactttcattttattttattttattttatttattttattttttgagacagagtcttgctctgttgccctagctggagtgcagtggtacaatctcggctcactgcaacctccacctcccagcttcaagtgattctcctgcctcagtctaccgagtggctgggattacaggcgcccaccaccatgcccggctaatttttgtatttttagtagagagggggtttcaccatgctggccaggctggtctcaaactcccgacctcagctgatccacccgccgcagcctcccaaactgctgagattacaggtgtgagccacaccgtacctggccttgaccttttattttaaggaggccacaatgtcttctatttatttgctagtatggaaaatagatattattttcttgtataattcttcttgtggtatatgttttgatctggtttctttgtattgcttttgtttttgtttaaagctattagctttgcttagctgatagctaaatctgggtccaatgcaggttcctttctgattagttttcatttttcactgagttaattctatcagctgtttgctgcaggaaagaggctggcacagtaaactgaggacttcagggagtttctttttggtaccatatttcctgttatgttttacctttctcaccaactcgaccgtgcacattgttcaagagatatggatctgcttagtgttctcagtgtcttgtcttccccatttagattagcgggagttccaaagggcttgcacaaagtcctgcctgatacattttccaagtcatgatctaatatttccttatttctcttctcctgaaggtgatcaacagtggcaaaggctggtgtggtttatcttctccaccttgccacccatgcatcctgcttttggcacatgtggcaggctggtgtcattcctcattcactgccacctcctctgttatcatctgttgtagaacaagccttagcaacccttctgcagaccacctatagcctcacactttcctgttgcatgtaagtaactggagcatgtgtccatcaacttttggatgttctacctgctgcctatatttaaaatactctcgacattgtccctgttctaaatttcgaaatatcccatggtttctgatttgagagtgtacctgccttctgtaagaaaaggcttttttatatgcatctcattttctatttaattgtttgttgcacagcaacatatgcgacagtgttgcatttagtttttcatctgtggcctcctaaatggcaaaaacaaaacttcacttattagctcctctccaatccttctctcaatcaagtgcttgcccgtccttgtccttaaacccctggactaatcccttgtaaggtgtcctgttgtaaggtgtcaactacagcattcacattcattgaccatttatatttcccctcataagcatatttgcatttaaataggagattttaaaaatctaaactaaactttagactaccagatgaagttataaattaaaactttgattgtagaatgacaaataacatggtatatgtggaaaagaagttagaggaccccaattagtatctgtaaaatgacctcatgtgagtagcaaagttatgtgtgagttgctttaatctttaaaattagcttctgcaatgcttcattgttttctataatagaagagtaataggaaaatgaggcatttgttgtaagtaaattttctagttacctgtttaagcagttttcttttaaactttaagatgaaaatctttacaatgagttcctattttctgaaacaaataagtgacttgatatggtagaaatgtactggagtgagtagttccagattcttaagttctttctgttacttattattaataaagttttgacacatcatttagcccacccaagcctcagttctcccatctgtaaaacaggaatagcaatacttcctttcttgcaatataagttttctgtgagtggaaaatgacataatatgtgtcaaaatactttgtatactaacaactagaaaatgataagagccttaataataaaagataatccaaataaaatattacactactatcaaagataatagaggctaacagggaagttatataaatactttcatgattcttttgtgtgttttttcctagttgtttagccaaggtactcacttctatttcagttctcattgccatcagtgagtctgcctctagaaaaaacactttctgttttcccgcctcctcttctccagtacatttgtatagtttttgtctttgtttctttggtatgttttctgtggctttaaattggctgcaaaagattgcatagggtaatgaaaagagaaagcagctttggagtcagacagacctggtttgaatcctgactgtgtttttgtgctcatcacttaacgtccctgaatctgtttccttatccataaaatgaatttaatcactgataccctgcagggctatctaatatgtgaagttcttggatttcatcaaatctcatttgccttcttaaaagtatattttgcttatttctgtgtttttaattgaagctttatgacatttgacaatggatacattgctgcactctgatcagtaattattttattcaatgaatcatttcactttttttctaaatgtcaccaaagactctagcttccttaaaatctactttttgttaatttccttgactaatcttatagttccaatagtttctctgcttcaatcagctttcttttgtctaaacttcttctgttttctcttgtaaaataatttatcctaatcttaaatctttacgacagagaccatatcttctttggccataatgcatcgaatattctgtaaaaaccacatcactatcaatcaataattatgtgtgtgttataagtatgtaaatgttatagatctcatagaacttatccactctgccttagcttattcctagaagatcacagattactattatatagcatttgtataactctttatcatttgtgaacctttcgtaattatttaatggaggtcttcaaactactagtatagattgattttgttatttctattgttgggaagggaaaacaaagacagaatgatgaaaacttgtcagatatatcccatgttaccaggaaaaacaggattagcacacagtctcttattctctgatctgctgatagtctgttgagctagtgttttcctagcatgaaaggaagaaacatctattcatttccaattattattttctggaaaaggtattatggagatggttctctttatgttcaaaataaataaaatgtccgagtgattcctggaacttgggagaaaggggaaggtaaaccaaaaactagggccagagagcaagaaggaggtaaaggagataaaattcgtggtgggtgaatcctcatccgtcattacatgacagaagtatttaaaaaggaaagctactacctctcctcatctgaggcttcctccagaaccctgtaggagaggaagatacactgctgagtcttcatttggggagcagcaggagaaggcagtgcctccttagccaaatgaacctttcctgacagctgtggggatatgtgtttgtgccaccaggccccttagaaaattatccctaaaataactaatgtttagtcagtcaaaacaacaacaacaacagaaaaatagcagcttcaaagcgaaagttatgtggcgagagtaaataacccaaacttaacgtgaccttcctagcattattttagggaggcgttagggtatagagagtgaaaaacaccctgaggtgggatttacaagtcttaatttcagtttcagcagtttcactttctggctgtgtggtattagacaagtggcttaacctctctggacctctctgatccttcagatttaaaatgagggggttgattactaagtgacgtctaagagcccttctagagataaaaaattccccaatctatgataataataattaacatttgatggtcctttaccacctacaaatgatttccacatacattatctaatttgatcttcatgccagttctgaggtagtattattatgattatgcccatttttggaagagagattcagaaaccacaaaatggcagagttggcattgaacagatgttcccaagaggcaaataccccttcagtaaaagaagcagctgatgctaacaaggataaataagagcagacaattcagcctgtgagctcttgtttaggggtacaacagaatttctggaagctgcattggggtaatgataatccaccatgtggaatgttatctgatgatgtatttatcaaaaaaaactaataaaaagaaaattaaaaaaagatacaataattgttactgcactacaccctaatgaattattgtgttcaaggttcttacaaaaaaaaagtaatattatactcggcttatgttttaattgatttattaatattttatcacaggaatgtaatttaagctcctcatgatttagatctcataaacctttagcattttgcaaattcaaattccaatttaaagccagggcgagcaattaacttttctatcatcttgtcaggggagaaggttcgtgtttaatttgagacaaagtgacagaaatatatatacactgtatgtattactccaatttaatttatgagtcagcaccatccaccttcaaaatgtagatttaatagaagaggaggaagaaaaggccgtgctgtcatgatagggctgtaatatctgccctgaatttcttacatattaaaaaaaagtcactggtttgttgagataccaagctagattgattgcaggcctatttccagttcttttgtttcacattccacttcctgattcttttctcatacagcacataatctcatggatatcacagggagttcttacccccacttctacctctactcctaccccatcctccattttcatgcatagctgcttctacaggtttatcctaaatcttgacaagtgagataaatggtaaatattgctttgagatcacgtcttcatcacctttctcatctttccaaagccaccttctaagtgctctctacctaaaacaaacaaacattaaaactcctcgcaattttatattttaatgtgcagggtgtatctggcacggtaaaacactggcactttcccgtgatcctttacaaaatatttaaggacaggatatgaataaataagctaaaaccacagaaggtagtcaggtgaactgtagggaagtacttccccttggtggttattaagcactggaacagggctgcggagagaggttaaggaattcttactagcgccgttatcctataattcaccaaaggcacacaatgctctatgctgatgagatgagttacatgacatctcctccctggttcaatcaaaggaaagcaatttacatctcaaaccagttctctcatcagtgggacataaaaactgcagaacagagatgcagcaaatgtgcttatttatacagaatcaactcagttgccactgttctttattattttccttctctcccacctcccctgtatggtggccattttgaataggatgcttaaaattctaaaagtgagaaaaagaaccaagaacaattcagtaacaaaattaactaaagataacttgtgcttctgacaatcagtgtcccttgtggtgctaggccaatccctttgttccacttaaaaataaaatcggattcctcttgctggccacaggaaaagaattagaagacgattaatggaaaattctggaaggtagccttgtaaatgtttattcacttttcaggcatacaatgttgtgctacataagtgaatacagtgcatttgtcaaagaaaggccatgttgaattagtgtgaggtcttcattcataaaacaagcttatttttactaataatctctattaatctcagcttaattatattaggcatttttcacttgcatacaacagtaaaaatggccaaaactgcatttactgcacctgcttaaacgcagttatatccctaaaaacgattgcagggaacaagctcccacagacatggcttttaggcagaatatgggattatggcagaggggtttaaatacaggaggtaaaaatggtaatcatattcatcaactacacaaagaagtaaaaacaagaagctctagataattctttttagtggactcactaaaataacaataacagcttgatgaagagaacatgattgtcgaaagcttgtccattttacattttctctttacatagtgcaataaaaaggaagcacctgcagtttctacttgtgcgtgtattcgtgtgtgtgtgtgtgtgtgtgtgtgtgatgttgaaagaaatcatggacatcatatttgctttaggagctactagtctaatcttaagtgcacattccctaccataaagttgtatttgagctccgtgcagtgcagaaacattcttcagcttagaaagtgcagtctttgcttcacacccttttccttcattcagacacatcagcatcttatcactttggacattaaagtaaaagagacttctttgtcatgaatatttttagacaaattacaccaaaatatcttgtattttccattttttagtggaatctactttactgacatataccagcccaccataacatcactgttgtgatgtcctactacttatctaaaaaaagtactattaactacatattgcaggtatttgaagtatataagaaaaccataaactgaattacattgtatggctggtatgatctcacatgaagtttgagctatcattattaaaaacagaaattgcatttagttaatgcatctgacagtaagccagtcaactttcaaggttgtatgatgagaaaaaaaatattttttaaaaaaacagaaaatgcctgaaaaatttcacaagagcatttcacatgacaagagaattcttcctctcccttctgctgcctgcctgcccacctttcttccttccttccttcgttccttcctttcctccttccttccttctttccttcctttcttctttcttttcctccttccttccattcttccttccttcctttcttccttccttctttccttccttccttcttgccttccttcctttcttctttcctttttcctctctccctctcttctccttcctttcttccttccttccttccttcttccttttcttttctcgtgcttctctcccttagtttctctcttctttccttccttccttcaatttggtggaggaggtgcaaaaatttgagtaagaaaataatatttttgtttcagaatccacatgcttttactattcatcatgctaacttagggggaaatttagataacttcttatggcgttttttttttttttttttgagtttatagatatctttcaggggtcaagctatttccaaacattcttataatggcctccaatattccacactgcaatatatagcatgctctaagcaaaggcagtcttttataaaagactgcaatagctagtgaagaaatacttttttttgattacttttataaaggcacagagcaaacgacagtacagtatgtacataaataaagcaaaggttcaaactgcacttttacaactacaatgtcactaatagacctcatcccctctctgctattctatatatataggttgaaatctgaggcttaaaacaatgtttgaacaacaaaacagaataaatgactaacccaatctttcaggttccaaaaacagtactggagagttttctatttttataggtgtttgtcactatggacattcaatatctataattctgaaattacagccgggcgcggtggctcacacctgtaatcctagcactttgggaggccaagatgggtggatcacgacgtcaggagatcaagaccatcctggccaacagggtgaaaccccatctctactaaaatacaaaaaattagccgggcttgttggcgtgtgactgtagtcccagctactcgggaggctgaggcaggggaatcgcttgaaaccgggaggtggaggttgcagtgagccgagatcgtgccactgcactccagcctgacaacagagcaagactccgtctcaaaaaaaaaaaaaattctgaaattacaacaaaattaggatctgaatatgtgttttacaaaatgatttgctataggccttcatgggggagatggcaatccctagtatatcaaacactgtggcttaattttttttaatcttcacaaaactcttcaagaatggttgtcataatgtaagaagtgtcagcattaccagaacaatcagagatttccataggcagaataacattagagattacgtcattacaacagatagccctcatactcaatgcatcttacatggtcagttaaaccaaagggtaggaggcactataggataattgtgagaagagttgctttctaagtggaagaaaggtgaaaataaagcacctgcagtgctgtgctttcactttacttcctgccctcacagtcatcctggagatcttactggtgtgctttaactgtcttgtggcattctctttcaaaagcatcttcagggactaaagttcaggttttatcagaatagacatagtcctgtgctacttgacagaaggcattttactcttttttatggtttcactaaaatcaagagtatcacaaaaacatcttaagatctgaaactgggaatcgcctcataagcatgtcttccaaccctacaggttgtataaggcaagtatgtgtagattgaatggaaccctctatgtctggcttttcagtattgtaaagactttcaaagctcattaagtacttctttgctgatacacaccaagctaagtcccacctcagggcctttagaccttttgttacccatgactggaatgctcttcctctagggtttagcatgcttctctctttattctggtttctcctcaaatgtcacctcttcaggagacttacactgaccatcacatctgaaatagcttgccaactttactctacctatctcactttattatttttcatagtatttatttttttccggaaattatgtactgcttattatctgtctcccctaataaaatttaacttctttgaaccaaatactttgtcttattccttagtttattgctagtgtccagtactgtgcctaatatatggtaggtgctcactatatatttgtcaaataaataatacttaaaatttaaaaatttattctcctttaagttgtacagtttaagcctcaccttattttctgctgataagagaaggtatcacctacaatgacccttcacattctagacaattaacaaagtctatgtggaagaataactattccaggaagaatgtgttcagacctggtttgaaatcacagcctgttgctgtggggcatttattacccaccatttagctagattactgaatagatggagttaaccaaaatgctgacaagacacacaccacacacacacacacacacacaaacacacacacacacacaccccccaaaaacgaaacctcagccctccaaaactctccttactcttgtaattggagtgcattgccactttgctccaagccaaagaacagataagaaagagaagcaaaaatcagaagaactttggaagccatttcactagagctgccacctgtcacttacgtaagaagatgcaatcatccatctgtccaaactggtgaatcataaggtcttaaatactatttactttccccaaaatagtgaatcccttgcaattttatatcacataataacaaagggacatgattcttatttgtttttcctttagatacacatagaacattttctttaatgtggcatacaactttaaaaatataaacaccaattcactgaggtatttttttggtagaaaaaagtgtctatcataattttagtagcaataatagttctgtacatttcttttagcaattacaacctcagatttctaagcactgtgcaaacattaatttactaagttctgctgtgttctctttgtgaattagaatattatcatatcttcattatttttaggtgagagtcacatggctatgacttgccagggccacacggtaaataattttttttaaagtggtaagatgcctctgttttgaaagtggatgcccagggaagattaataaaataggataagaacatacctaaaatggcatctgtttttttttttttaacctagtgcttccattcaaattttgttttgggatatgaagtcacctgatagctcagttcaaaactcgaataaacatccttgaaaatagtagggttattctttaaaaatagtagttatcaattattgagtgtgcaccttgtgccaggcacagttctaagagatctagttctaggagggaaagtgtacgagtccatgtgaacaaggacttggtgtcttattcactattgtatgctccgagcctataacatacctggatggtagtgagggttcagttggtatttgttgcaataagtgtataaataagggaagctttcttggttccagaaaactaaactgtctgaattttgaaacacaacctgtttgtaagttgggggcatcatattaaacattttcttttggaagcagaggagaagggaagagattttatttgacccaatatataaccaaatctaggataatagtgatcctctttacaataaagttcatttattcaacaattatttattgaatacatactatgtgccaggtattggaagaggttctaggaataaagacaaggtccttatttcagaacttaaattactgtttatgggcataagaggaaaatatcttcatatacaatgcaattatgaggcaagatttttctatgaaccagtgacttctgtttgtttttaccatgttaccctcctaatttactaaggcttcaattacttggttttcttctgagtagccaggaggacattatagcaaaaagtaagtatactgattaattacaacatatatccataaagtggaggggatatctgaaaatcacctagagaatctgaccaatatctaagaaattaatttaggtcaaatgattagttctgaaatgtctgagttatctatattagttattcatattgccagttcttaacttgttctatacaaacacaatctgaagcttcatctgggcttcttcaaattggaacctagttacaactcttaatggataagttcaagaataatgccactacaataaaaaagaaataaagaagggcacaaagtattagaagataaattatctagagattaataaagtctttggtaagagtttgcaactctatcacatatgggctaattggaaatcactgcttccagggctaatgacctcatttgaggttaccctgtgggacaataacatggcctacctctgtccactaaacaaattctgtcaaaacataacttaccaaagtatagcttgttgaggggtatacatatctgaatttattttactctgataatctgcccgagaggttctgttacttgaaggcaatatcacttcctttgggttcacttgtaggacacaaaatgcagcttttacaagtatttctgcttgtaaactaattcttcagctatagtatataaacttcactctataagaaaaccaaagaggccaagggacattaagtttggtgtttaattgctatcagcaattaaaaattgctagcagcccacttaacattttcttcttcctctaaaaatgaaactgaaacgtatcttttagctgagagttctgtaatgctgagaaaacatcctaaatacatcttggcaaaggaagaaaagaaaaaaatgtgatattgatgtatttgctttcctagtatattgaaatcaagaactagatacaggtgacagatctgcttccacctgctggctcagtgaatttgtaaaactgaaatctgttatctaaaaatcactagtacattcagaattacttagcattccctttctgtttgtacatgttcatgacaatgataaaacagccccaggaattctgctaccaatcttcatatatatgtccattgacattgtctccatcaaattcaatccaataaaattaaatggagttaaataaagcagtctgcttgaacctcagtatctctcatttcttattgtattgtacctcttatcatttcttatttatttagccaaggttaaaaaaaatggtttccagattcaattataatttccctcctggtctcctatttcttaagtattttttcctttttattttcatataattacaaggatttttttttttggcaattgacatgaacaacattattcaaaggaaaaaatacttaaagtagctactatcttatagcaaagaggacatttccatctatgtttaccataaaaattttcactggattccaacattttcatataatactatctacaaatattgcctgctttgagaagactccaaattttaggaggtagatgggcgataggtaatgcatggaggaagttggtaaagaagacaaatttctaactatgacttccggagttaaattttaaaagaaattgagaagtatacaaaagtgttaagactgaaatatatgcaattggcttacaatttctccaaccacttgaggcaagagggtaactccaacttttgccccttcattgccacacttcttcaatctgcatatggattttatgtttcccctttacggctgcccttaatattaattttaacctcaaataaaatttttttggaaggaagagtaatatacacattataattttctctggagttttcctcccataagcaacagccagatgacaaccaacttctcattagtctcttgaaaaacgaatcagaaattttcttatgtccttcacacaggattgccatctattataaatagtgctgaaagaccccacacacagcaaactgaagcatgtggcatttaatacatcacacagaaggatcaagaattgagtcaacacttctagggcttctacccctcaactatgcatttccatggtacccatttccatggtttttagacttttaaacaaacacatttgtctaaaaacaaatacatatgtaggaaacatttctccagggctctcgccttttcagctgcttttggttgacagatgagaacccacatacagtattctgaaattctgcgtcttcttgtcttaagtactagagaaagaaatatttggtcctaggtggcagatcttacttatatcacttctattaaacgggcaagatagagtcacaaaaagaggacttatgattttcaccttataatggattccttcttggcttccttccacctcctatacatggatttgaacttcattttgaagacacttacaattattctgaatgaaaactatcattttcattctccctctcaaaaaagtttctgaagaaatttgttgcaaagccatgctatctgtaacattacgaatatgttagcatatttttagtgcttcactagatttcataaatcttacttacccatatcaataacaaccagtataatttgaaggaaaaaggagaaatcttgtgtcttaaattatatcatttaaaattcatggatgaaggtagtatccctagaaatgatctgattctatgtgactccgggaaagatactatttcatttctgttttagagattaagaaactaaagtacagataagttaactaacttgcctaaagccttctggtgaatgagatagccaagatttgaaccgtggagtccaacgccagaggcttaaccattacattattctacttctgtgttaagattaatagagaggaattaaatgcataattttggaggcaaacagcttaagttcaaatcccaatttcaccagttactagctacatgaccttgggcaaagatcttaaccactatgaaactttatttcctcatgtatttaaataatagctgttcttcactgagtactaagctatgttccagttatcgatgctaagtgttttacatgcattattccatttaattatcataataactcaaccaagtatgtagtgttatcatcccagatttagagatgaagaaactaaggttgagtaatttgcctattgttatacagtaaggggcgaagacagaattctagtaagggcaatctcactctagacaccttactcttagtcattaaatttggtgataataaccaatagtgtctacttcatggggtttggggttgtgttttggtcaggattaaattaggtaatggaggtgtaatggctaattttataggtcaacttgactgagccacagggtgctcagacatttggtcaaacattatttggtgtacttcagtgagaatgtttctggatgagattaacatttgaatcagtaactgagtaaagcagattggcctccctcatctccaaacagttggaggctggaacagaacaaaaaggctgactctctcacaggtaatagggaatttctcctgcttgacagcctttgagctggaacattcctttttttttcctgtcttcagactcaaactggaaacatcagctctctgcaggtctctggcctaaggaagttcagactaggactataccattagctttcccaggtctcaagcctttggactaatacgttggactaacgcaattggctctctggggtctctagctttctgactatagatcttgggacttgtgagcttccacagtcatgtgagtcaattccttataaaacatctcttctatacaggtatacattttattagttccaattctctggaaacatagtacatagtttctgacacccagaaatagttaatgaatgtttcttaaactgctttcccaagaaaagccaacagaaaaggaattataggatgaaaaagcccccttcagtaagagcaaagataggtccagatgaggaggataatgttctgtgggcactcggctcttaagagaggagcaggggtaggggcaaattttaaaacacgatctgcagctaggtcagatgataagcttgtttatgaaataagagatggcaggaaaaccaggttgatccagatatcaagaagaaaagccactttcatcttccactaccctaactggaagggaatcttggttccttaccatgatagcaagctgactagaaatatagatgtgatctttccctttgaaaagtaacaggttacagggaaagtgaaggaatttatagaaaaggtcaagtttgtttagtgccttactgtgtactacttcaaccaattcagctctatcacccaggttggagtgcactggcacaatctcgtctcattgcaacctccacctcccagattccagcgattctcatgactcagcctcctgagtagccagggttacagacgcaccccaccacgcccggctaacttggtattttcagtagagatgggatctcaccatgttggccaggctggtctcaaactcctggcctcaagtgatccacctgcctccacctctcaaagtgctgagattacaggagtgagccaccgcacctgccccaatccaactcttacatacatactttgtttccagctataaaccataggggcataaaaagacttctctatggaacaggttaggtccctgaagttttcaggtctaaacatgctggagatggcaattaaagctttctaatatatgcgagttacattaatatctttgaaatacccattcaattaccccagctcaacacctgttagacaccctctctgtcaaatctcttctgaataactttgtttagttagatttggggccagtatcgtaacttcacgtagtctgtacaggaagaaaataagtaagctttactctggatctcagggaacatgtgtttctcccatcatctaagctaaaaaacaaggaagctgcaacagctgggacaagaaggaaaagccaatttgatttttaaagaaaatagaaaataaaagcaatttgtccaattccaatgtgtggtatctatgctgatttttctcaaggaaaagtgcttatcattgccaaaatccccaaagtaaccacagctgacaaacttctcagcatcagagcacttggcaactgacaataagacctgctccttccccaagcggataaaaagccaggaactccccaaacaaaaccaacagcttttctgtactcttagtctgccttcatgtcttttgagcacagtatattgtcctgtgtaactggaggttcatgtagcacactgattttacccaaagcatcaaaactaatataattaatttatataatcttctagttacactgactatagaacttaccttcactacctacccaaatgtctgctgctgatatatacatatgattgcacaaattctaaagagtactctcaataaacagaaatgtaagtctgctaaaaatgcttaaatatacaaagaaatgcaaatataagctctctaccatacataggatctttgtttataccagttgcacatgatcaatggaaaaggacattcaaaacacttttgaataaacaaattattatcttgcattagcttgtatcaatagaatccttccaagtattttttgttcataataaaaatgtgtataggttggtttgattattttttactcttatcatggcaactcaatataacaatactgtgcaggtggaagagggaagaggggaaaggagagaagctgcaaataaccaatttaattaccctaacagtcatttttttttgcaggaaaaaggttccatatgataagaatgtttgttctgatcaaatatctttgctccataaagaccttatgaatcttccttcaatgtgaagctaagctatttctgaggagctactggaacctcctcattttttctagaggtatccatgttctaaaaatctcaaatgatctcaacttaggaggttactgaagctacataaatgtcaaaagaaatgatagatttacacttctccaatttctgcatttgttatgtagcataaattcatgacagaaaaaaaatgatcctcaaaactccttagaagctcgctcaaaatcttgttttaagtctactcaaaccaaaccaagttctgctaatgtaaacccttaagatttgtggtagtttttcattcccaatattaaaatagtcttttattaattctccatcacatcatattttcccttgactactaaatcaggtccacatttgttgcttctatgtttttgacatcatggaagaatctggagcagtggtacattttgctcttcagagatattttattggtttaaaatgtttgattactaaggggtttaatctagtaatactagattaagtactgtctaccataggaaaaaattcatcagacttaaggtgtttcctcttaagtggaagtagaaagccaaatttcaaagcctaccgtgttaataacaaatgcttccttttatattttcatcaaaaaacaagcctatttccttatctaagttctgtgcaagtctttctgattttctcacaataaactatatgtgtgaaatcccatcagtgttatcaccaatatttattcctgatggccacagcttttctaatctttgtgtagccatatgcttaatgttacataacccacttggaattcctttcttacaaacaaatagcaaaaatgtaagtttatgaagtatgcattccttttttaatgccaaaaataaaaacaaaggaaaatttctaaattggacatgtgataatacataaaatctatctgataaaaagtgtgtaattactgtcacaaaatcttcacacaatccttgaaatctcagcagtagggtggcaccaagttcccacacatcaattaaagcatgtacatatacgtcattggcaataggtcagtctcacagagaataatctcatgatgccaaagctatcctacctgaactttaattcctgaataacaatgttggctaatagtgttttactggatattgtcttacttgctaacatttcttatggggatcttgattaattggctacctaatccccaaagattattccagaaaataataatgtctgaaaagtagaggtcttttctttcacctatgcacaaatttgtcatagttaatatgaaattactttgttcatctgacccctatcaagtaaaaacacatgaattaagatcagcatgtaggtgaaatgcacaagaaattagggccatcttgagaggactgtcatctagtatgaatcacatactggttgaccattctccctccaatcccatatttttatggggttatacttaatacgaagaacaagtgattaatggagcattaatcacagaagtctactgactaaaaaggactgaaaattctgagccttgcttcagtggtgatggtggtgggaatgtgggaacaaagttgctgcacaggtaatccctagttttgatccaaagaaatagcagccaagcagaaacagacagacagacacacgcacacacccctcaatatatattaaaaagtcaaatttcattcagtttctcaagaaaataccaagaagaataagacagaaaatctctgttcttagtcttggccactttattctccacatggacaaccactttgcatcaaaagtctctctctacccttactttcacctctaagtcttttctccatcccttctatcccttatgggtacttttctttcctccctcctcatttttcctgtctctagccccttccttttacccaagtgaaattttgtcacttttgagttcccctcccctatgatcacttttccagttctatttttcattcccccaattccacactacccaagttttgacacctagctggcatgaagagagttcttagaagaaatggaagagaatgagaagaagaagtcttttctgtgatacaagaaaggagaaggccatgactactgacatgaaattaaccttgtcccaaccacatacacgtacacctcaaagctttgtaaaccactggcaaataccctcttattatctcccctgccccatctcccctttcttttaattttttggttagttaccaatcacaggagttaacttcctacatagagggtagacaaatcagggcaatctatgatctctttaggtccatggatagatgttcacccccaaatgcagagctctgctaaatacatctttcagtatctctgccttcttagatactctaagctataactctactttagttttagggtcctttttgcctttttctggccagaacatattgcttttatatgtcttccttttcatcttcccaaatgccctaataccagcttaggctaaatgtgctactggtataaaatgtatctttctccttaaaaaacaccaattattctcaacctctgggatccaaagcatccggaataggggccctcttcaataataatcagtgagtgagtgatcttaaaagatatgtggtttaggaagatgaagttaagtatttaaggtcacaaatcaagtgtggagtggggctgcaacccagatccagatgttctttctgacatgatctctcattgtcttttttcttgtattaatcagttgctaagtcttattatttcttcttcataaaaaagctaatgatcatcttattgcaacaccacactctctataccacaactatatatacttattttggaaagctaagattattcaagtaagactaaacaacacataggaccttcaaaatatgctcctaatcttcccttcttgtcttcgtttctgtctcctggtcccagttcctcccaactttatgtatgcatgagtcttttcatgatcttctctctgcctagagtttactttcacttcccgccaggaaaaaaagaataagtaccctttttaaataagcaaactcaaatattatttgctccataaagccttcccaatatctattccatgagcctttcccaacatctccactttcctactaacagatcatatatcctgttgctttaaaattcctactgctttcaaattctttcttcttgctagattgtgacatgcttactggcagaatccatgctagatactgggaacacaaggattaaaaccacaacccttgtactcaagaggtttccagtacactagtaagtcaaaaatataaacaactacggcacaggtctgatgtagaaaacatatttctatttaattgacttgaattatagttgcacacattttgtgttgtaaccaagattatgttacatatgataatttaagtagccaaaagttgactcaggttgagtagagaagtaaaagcacataagaaagagaacaggaagaaataaaactgtaaagatgtaatgggagagaaaatactgagttaactgaagtaatggcttaatgcagaaataagacgtttggggaaaggaagttgaattagttgaagacatttttggtaacaagagtcatgaagcctacagttgccagaaataaaaaaaaaaaaggactgactatggagtatttattaaatactcatactcactgtttgaagtacaaactaagaggaatcagaggatcaaagtggttggttatgacttgctcagctagtaactgcaagtgccaaaattcaaactgtggaatatttcaaagtccgccctttctaaattcaattttggcctaaatccaaggaggtagtgtccacagaattagctagaaattacttatttcctaaaagatcaaagtcccaaagaactctgtatgatttcaaggctgctcatatggtaataatggatacatttcacttcatagtctaatcaactaatagactttaggacagtgaatatgaatgacatgaaggtgccttgagaaccatcaagtcctacctcttattttgagactaattgaagatactgaggcccagtaattgaatcatatagattgctaaaagaagttctgagaagaaatgaaatacaaaagcttggtttctaaggctgaatatcatgagaaactatcatgttatcctgtgtgagtgagctccacgaggccaggtatcttgtctcttttatggtcaactgtatctccagtatctaggagagtttatggtactataactagcacatagtgagcacttaaaaaaaatcaggtgctcaaataacacggtttagtgaaggaattaacgggttcatatatgtgaatgtgtgtaaagtgggtgcaagcatgtaattaaatggaaaactggtcatatttagttagatgttactaaatttatttttatttgccatttggatcacatgattttctcctttaaacatcccagtgacattataaatgtcttatgtagcaaggtctttggcttcaaatgccttcaccaggaattaagagtttagtacaccatcaatgaatagaatttacaaagtaccctttgggcagaatcattaaggaattaaggaaagttttttaacatattgagaaataacacaaaaggttctgaaaataaaggataatatgaatatttcatctttgtcttagttttggggggtggggaacacagaagcaatatttcatttctaaaaccatgttcccatgaagctgagcagaaggactgcttataacataattttccagccaaattcccaaagggcccccaacaggctttctcaatttgtgggcgctgtcctctaacaatctatttctttccagactctccttggaaaccaaagatttatgtcattctcttcatattttaaaatgaaattgttccaggttaaagaaattatgaaaactgaaagcctgtctttatccaagaaccaacactgcctggacaaataacttatgaatacatcctattctggaggtatcatcaatgactttgcctctgtagcactcttaccattatttggacatttccagaaatcaagatccacttcagtttgtgaagatgagctgtgcttagacataggcttaaaaagaaaaggtaaataaatattctgtcaggttatatagagggaagcagaccctcccttttataaataacgtatacatttgcttaaactccagagtaaaggaaaaatctcatggactgaaaacattttttaaaaaaatgaatattcactaaacaatcctgaaatgctttttgctctctgaatacattcaaacaagtagatatcacagcatttcattgatagcttatcaaaccacagaatagaacaggaggacagaatacaaagggcattcttaagggagcaccatcatgattgttctgtaaaaacatatgaacatattgctataaactcatcttcacaggaagtcacacagcttaataagcacagacctgcaagttaatattaaaattcactttgatttcagcagcagcaaagctgatccaactaggagctattacataaaacccttattgtcatattcgtcatcaccactctcaatagagaccactgccagcaccaagaagccagccctcagttcacctcaggaaacaggctacacagacggccgtcccagtaacaatgcagcagtgagatggccctgtttattttatcagaatggcactcccttaatttttcagttctctttattgatgtcctttttcatgtacaggtctattagattctacttcctttactgtcctcccaggaattggtgcttgccaactacaataagttgttttgacaacttgtctagctatacaatactctgtttccttccctctacagtctttttggcttcaaatgagtgccttcaaaatatagcagagactatccaaccaaactatgctacaggggggaggagctttctatgtgtaagcaatgtcctgcccaaactacaatctttcatgtgctcatagtcctctttcttttcctatttatttttatggataaatcccccttgctatcttgtctactcctatcttaataaggaatgactgccgtgactacccccatctagctatgccattcaccgccagcacctctgctctcctcgtgtgcttcaagaagaactgattagcactttgcataattaacctgattagcactgtgcataatcaaactgattagcactttgcataattaaaaagaaataataataataacaataataagcactaagtaatatcaaaagctgttagtcccacagccctttggttacctccaagattagttcagtgcagcatattttgcaccttcacattgaaatcttttctttaactcaaaagtcaagaaaataaattaaaatgcttgcaatccacagactcgttatggttttcatatccataccagttaccaaaataatcagtttcttacccatacacatctccctcagtttgggtcttacatattttacccatgttaaaatggagaaaatggggatataaaaccaagtgaatgaaaaatatttagaataacattagaaaacaagatatatgatgcgtatagaagcatagagagagttatatagaactatataaccctcccttgtgttgcttctgggtgacaatgaggcatgtggaaagaactggacaacctatcagaaaaacctggctatgacatttcctggctaagtgatttaactttttggaacctcagttccctcatctgcaaaattaaaataataacaccagttctgctacctcaataactgtaattaaaataataatttaggaaggtgctttgtgaactgcaagacactttacgtacatgaggtattccattctaggtccctaaatctcctatcccccaaattttatttcacaccatggacaatattatacattatgaataataaattttaggctcagtgcagtggctcacacctgtaaccccagcactttgggaggccaaggcaggaagatcacttgaggccaggagttcaagaccagcctgggcaaaacagcaagatccccatctctacaaaattttttttaaaattagcggggtatggtggcatgcacctgtagtttgttttttttttttttaattttttattctcataggttattggggaacaggtggtgtttggttacatgagtaagttctttagtggtgatttgtgagattttggtgcactcatcacttgagcagtatacactgcacacaatttgtagtcttttatccctcacaccctttccccctggtccctaaagtccattgtgtcattcttatgcctttgcatcctcatactcagcaggctgaggcagaaggatcgcttgagcccaacagttcaaggctgcagtaagctaagaaggtgccactacactcctgtctgggcaacagagcaagaccccatctctaaaaaaataagataaaataaaaatttatatttataatgccttaaaattaaaaagttataaagtcctgttgcatgctttgccttatttcttattcagggctgaatgtgactaaaattttgacttggagttaaaactggactctagtaattattgtttccatcacagctctcatttgtgtttctgtggaggttaaaatcaagctgttgctggaaattcacaagagaggagaagaaaatctagtacattactattaatttgggactacaacataagagaattctgcaactctgcttttctccaccctaccatagccaaccatctgttccttaccaacttcgaggcttagttcagttccactttcctccaagaaaccacctatgatacccatagattggaaattctctctttctctctaatgcttccataatattttatctcatgcttccatagtacagtgtactatttattaaatatgtgtatatctatctgatacctttagtagattagctgctcctaaacagaactatgctgcctattcatttttgccccagaaatagctgccacaataaataatgtagtggtgaacactcaacacctttgttacagttggcttaaggaaactggatggtaaactatttttttcactaggcatttactatataattgctaaatgcaagcctgagaaattgtttcaataactatatgctagagaatacaaaggtgtttgacatacccataactacttaatcaaccattaaaaccaaccattcatttattaaaaaatagatagaagtgctagtaaatactaggcattgtgctaaacactgaatacagcattgataaagtttaaaaggaactgttggttcctctcaaggagcttatagtctaggtctctattaagaagttcatattagagaggctggagtggagtagtgtggaaaggaaaccttaaaatagcaagatacacatcatggagccactaagcctctatcaacctacgggaaaggaacccaaataagcagtcagtgttcttgggcaaatcattcattttacaattcatttaattcaagaaggaaaatgctgctgtggagattattcaagtccaaatgttcctggtgaaggtgcttccagtaattctgggaaagaagccaatcccttagttttatatgtaaatatttttaaaacacacacatatatataagcacaaaagaaaggtcaggaagacgtaagtcttttaaaaatctattttaataattttttctataactgtccacaaaagtttgggctttttttgtagccttacattttcttttacacaatacacctgcttttttttctaaactaaatatttcttccatctaatgactctctttattagacagcatctaatttgcatacatttacatacaatttaactgctagcttgtgagaacaaagaaatggctctgtattgtactgaaggacaatactcagtaaaggaaggtataaaaaccaaccagcttggtgactgtgtaagctctttgtttcagatataccaggctccctctttctcttttaacataccatttaaaaggggcaaaaattatttcatcaaacaatgaaaaaaagaaacagccctactttgtttaactgtccatttcctctccagtttggttactacaattcaggggtccaagttccctgaatctactacaatttcctctattatatttgatagatttaatccctttatctatttttgtttcgtgtctcattcctaaaacaacctgggattccactgcgataaagctctgttctgatgctaatttgtgctgccatcggccttgttcccaagcagacagggtagaatatggcatcatgctctccagtgaacaatgcatacacttacccttaacaggttaatagattttattgagactttgggtctttatcatatgaaccagctcttcaaaaagaaatggttttcagcatctactggagagatgatggaaaagaagacttgaatatagggagggaaatggtaaaatagatgttaggggtaaaagagtacttgagtcaaatgtttctccactcagcaatgctatccctttgtaagtctccaaacctgcatgactcttggagaattaaaaaaaaaaaaaaaaaaaagaactgaaaaccagggacccttgactctcctttgaaagtaaattcacatactctgtgatacggggtgagtcactatgactcttctctctgtagctctcatccttgacacatggaaaaggagattatgtaaagcaatcttgaagaggtttgttcagtgttttgtaaatattaacaattattgaaaacacacaaaataactaataaagctgcggtcacaaccaactgaaaataaacactaggctcattcaagtttctgaaatgccatgtctaaaataacacacaaaaaagaaatatggtacacaaaaatgcttcaagattataacaagctatacaaatgtaaagcaggacataagggcaaactgaaaattataaagccaggtacgaattggcaccaaagcctcgatggaattatcatccgtatctgggtgctgcaaatggtcatgggagatgcatttccttggacatatatttaacattattaatttggcctgttttctgcatctgataatgcaaatttacaattttagtgacccaaagaagtgtgaacttgtcagtgataagtgaagaaattctaccactctgtggggctgcagaatgcccacataatttggaacctttagcagccaaacagattgcacaatctcaactagcgatcttgaagcatgtctgattttccacctggtgagaagaagcctgagttatggggactgtatgagtgctggagtgctggcataaaccaactctgccaacttcttaacccataaacaattatgaataatgatccaaacagcatttaaaagaaataattagacactgcactttaaaaaaaaaccctcagtagtgactaaaatctagtcactggaatgagtagtcaggaagttgttgatcctccgaaaaccacggcttagttctaaaaacagccttaaattgcagagaacctgaccctgaccttcaaatcccttgctccatgaggaaatgagactaccgcctcctgagtgctatagtgtctgttctttcagagattgtcagtaagttttacaatacaattcctgtttctgaggctcattagatcttccttatttatacggatttgaggcagtacttgcttttgtgtgatagaattatctgttggtatccgacgtcagacctattttctacactctaacatattaaattctgccttgtttgtttctaaagcacctcttaataccaactcagccaacatcacctgtgctggaggtggttaagatccacctccccaatgcatgttaccacggtgacaaagtagtgacctaatttacacacacctgctgggttaattgggccaaaatgaaagatgatatatatgctcaaaatccaaaactgatttttttcctcaaaattaaatatttgattttttaaaaattagcagtttctaaagctaagtaacatactccaggtgtgcatttgccagttaatgtaccctgaatgtttcatgacacttgaggagcaaaatatattgagtgatgaatacaaatcttttatgtattttctgtgtgcaatgattagtatgagtaagtggtctcgatcactgaatacatggggtgtgcttgaagggtcaggccactgccttaaagcaaacagagacatctcaactgtgccaagttagcacgcagagtccgggccgcctttgaaagtgcaagtttgctttggagaaagctgttctccatagcctgaggctgcctgcaacatctcttagacaaaaacatcacttacctctgcttgacctcttcccacctctttgtattcattcttcccagaccactgagagtttttctttgaaccatattaagttttatgccaagaactgatgaggatatgaacaaatagatactttcagagactgctgggacagacacagcaatgtgtaaatggtatagctaaatgtatcaaaacccttaaaatacatatatctttgattcaattattacacttaagtatttacctgatgacataatcagggatgtttataaaaaagattgtcacaataatattcattgtaattcatgtttactggagaaaaattggaagcaacttacatgtccaaaaattagagatcagctaggtaaattataacacatccattgtatggaatactatataatcaattaaaaaaatcatgtcacaaaaaatattgacagaaacaaatattcataatatattgctagttgaaaaatcagaatcataaccttgcataatcctatgttgttgcatgcacacatacatatacacaccaaaatattaagaataactttttctttaagtggtaatagtaatatcaatggtgattttcttgtcttctttctgtctttttgtgttttccaaatagttttacactgatagcgtactacttttagaaaggaaatataaatatgatattaaaaataaaatgaagagtaggaaaaaagttaaatgacatttcctaatccctctctcctacttagatttcacatttcacctatatttacttctctccttgtcaactacagatgtaaatataatagatgttaaactggtcaatgttcttttattactgaatattcaacttttctagctgaatggatctttcacttatttacaaatcttacaaagatgtcagtcagcacaactcttagaaagagtctccaatctgctttttatgcttacaaaaaccatgtgaaataattgccttttaataacaatgattacttgaagtgaacttttcaaggtacaaataaatctatttatcaccaagctattgtgtcccgcttaaattacaactttcacattttgatttcatttgtacagatatagggtcttactgataagtaagtgcttttgttaagtaaataaaattagtattaccatatgaactggatttgctgttaaaagtatctcactaggggtttgatttattctatgatggtttcactgatttaatcattgcttaaattagcaaaatataattatatatttttataaagaagatgttttcttgggattttcctatgtcaccaagaatagacatcagggattgataagtaataagaaatgtcaattttaaaattacatttcttggtctaatatgctttctttttaccttagtgatgatcgctgccttcctaaaaagttcataaagcttcagaaaaatctaaaattcatgaaatttcaaagaattaaaaaaattggtgcttttatttcaagtgataaaattaaactttattttcattctcaaaaataagttttggttgaatcaaagatgtaaatattaagagactaaatcataaatgtgctagaagaaaatctgagtaatttttctggtgtaagaagttttctaagccataaaggaaattattgaaaaaatgaaactacataaaaaatttttctacatatacaaaactcaaaaagcaaattaataaccaagaaatatgtctaacacatactacagaaaatttattttccataatatacaaagaggctatacaaaccaataaaatatttttaaaaactcaatagaaaaatacagaaaagtattatagccaattcacaaaaaagtaaacaaaaatgtaaatggccagtgaaattttaatatgttgtttaatctaactcctgagtaaagaaatgtaaatcaaaacaatggtgaaatatcattttcacttttctgattaggaaaaatttgctaaagcccagtactgatgaggctgtgagaaagcaggaattctcatataatgttgttacatgtgtgtgtcagaaaaatgtttttgaaggaaaatttttaacaggcatcaaaattttaattatataaacatatctaagaaagtatgctatgtggatattaaaataaaaacaaggatatatttagaaagctgttttgtaatatttttaaacagcgaagaaactgtaaataaccaaatttccataaataggcagtggttaaatacattttgtgacatccataaaatggaaatattaagtagctgtttaaaaagaggaaaaggtaaaatataatataccaaaatataaacactataaaatttctagaatatataaaatctctaagacatggcattaagaaaaaagtacaaatgtatttgaacagtatgattccctttctgtttttaaattaaaggtatatagacacatttctctacgcaagtacagttgaaactttttatctctggtgaatagtgctatcagtcggtaaagacatacttttcactttatatccttgtgtaccattcaaattttttaaccctgtgagcacattttaaaaatacaaatagcagaaagattgttcagtgtaatggtaaatggtgaaaggtatatacatggaagtaaagagtactgcactgttaaatttctcattctagacttctctagtcccacagtaaatcattcaacttcactgggatttcatttcctcatttgtaaaataataattaaattagctcaaagaataatctgtaagttaccttatagttctaacagtacatattttcatgtgttaataatccaatacagaatggtggaaaaatatgtttgagacttaaatatcaattttgagcacctgtacctactacaataaacaaatctctacttggtattttgtatgtagactgtagccatgtctttatgacaaaaacaaacaataaatgtactgaaaattttggctcattgaataaactaaatattatcttaaagaccatccccatgcacaagtacctctgggtctcaatggtttagttctgccaaggtgttgaaacaagactatcaaacaaaactgatcagaaatgtattacttacatacttcactgccaacttaaagccacaaccacgaagctgacttgttgaatctaaccttgattaatgctctcatatatacaaaataatgtcaaaatatcaacattcatttataattcaggtatatattgccacaagcactcttaatatgtttttgatattggataacctgatagtgcatgctcacaagttaaaatagtaatatccatcttgtttttaatttgtggtacttgaggcttcagtataataatggccttcttccattgtgacttaatattcctatcatttggttatatatttttaaagcaaaaatctctcgatcgttattcagatgacaaattatatggtcatatctgttagatacagcaaagtctgcactgtggtatttctaagaaagcaagtagttcattccttcatttctgggttccattgtgataaggacagaaccatgggaatttccttggtaagattcaaggggtataactggtaagaatggtgtgttctttttttttttttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtgtcgatctcctgacctcgtgatccgcccgcctcggcctcccaaagtgctgggattacaggcgtgagccaccgcgcccggccggtgtgttcttaatcacacaccataggtacatttgtaaattaggatgtggctaaagcctactaaaaagtatattgatagatttttagtatctgtagtgaaaaaagttagattctcacatctaaaaacctcacaatttctgaaactgtcatctgactgtgtttttcaaatgttcacagtagacggcctacttccttgtgcattttttcacatagtatcagcctgggtcatggtaatactgttatctggtataacatcgagcaatgggaaaataatgtggtgaatgaacagttgattagacacattaaactaaggaaaattcaatcaaagatcatcagtttcaatgatttactaccatacatctttgcttagctatgaataaaacattttgaatgaagcttttggtgaaatttctgtttcaagatgaaagtagaaatgagaaaaatagacatcctgtgctcacctcaaatggagagataactatatattccgaaaaagttctatgttaaatcttgggctcctatgagactaataaaaaaaaataagtttaacccttcattttcagtttcagtcttgatatacagaaaaggaggaaaagggctgatactactacttgaagaagtgatttgcgaaagggagaaatgatggctcaaaaacccctgtagctcctctaacaaaccctggtaccagagcagacaatgaaattgctagggagagctaagagtagcaatgaattcaatccctccctttgtggccaaacttagttctgctttcagaaataacaaaatttcaggagatatggttaaaatttataggatatggcaaagtttaaggagatttggttaagcatttttaatccattcccaaatgcttactatggctatatttagtaccaggataaagaggaggataaactggttgcccctgaagaagcagacctcccaactgtacattgttaatagttgacagaacactcctcccttgccacagctactctaatacacacaaaccttggatgcacaactctgtgtaacctgtaatgatttagagattgcatttcttgtacacaagatcttcccttgaatggctccttcacgtcattcaagtcttataattcaaactttatttcctcagaaaggacacctacaccctgcctccggattaccagccattcttcatcctttttgttgtagttgtatgttaatttgtttagtgtctctctctcggtcttctagttcagagctctgtctctagtgcctgagatcaactgaattgtaattatttactcatgatagaagagtaatcaacaccagaaagaaatctgctatctaacaaaataatagtttcttcttttttttttttcggcaacagatacaagacaaactaaaacaggttaattcaattaatgtgttttgggtgcaaatcccagtttggtattatcaaaggcatattttcacatttaactatattatcatttcagggattacttaattttcattttcatttctatttcatcctttcttttctggcagggaagcctaagctcatttgtaaaatttttctgtcctctgagcatacaattatattttatccagaacagaagtgcaccaaaagagctgaaagttaaaagaaatgttcagtagatgagacctataatactggttctgattaattaatataatcactctattaattatctatgtttaaaattcaaatttatctatgttggcttattgagcattcttaaagaaaacatacttgtaatatcctacaaccatgaggtggaaagggtcagcaaatgcttccaattatatcccaattattttaggaatggtttacttcaccttctgctccctctacccactcaccctaatagtggtctgctccttacttaaaaggggaaaacacaaagatttcctgcagtttgagaatcaacttgggagaaatagaaaaacaggtgtctgagttgagcagagctgagtttagtcctgtgtcagccatttactagctatttaaagttagaaattaactttctgagccttgggcttgctcttttaatctagacctggatattcatgattccagtgttcatttaatggatgtgtatttgtacgtatggccatatccatagttctctaataaagacctggccgatgctaagcagagaaattagacggattgtgatctcaacatgcagtcatccagcacaatacttttgtccatctacgacactaaatttcaattgtatacttggcttatattatctggagatcattacgaaaaacattttctgcaactcttgatttacttaggtcacaagtaaagttatgtgaaagtaccatggactataagagtatatttggcatctcaacacacatggattgacagaaaagttggatgataccaatgtcagtttttagttctgcagtccatctgcagagttagtgactgttggttacctattctatgcctcaaccttgtcatctataatgagaagtttcagtagtttaaaaaagtatgacagaaaatgattcataattccatgaaattcataaaaaataccaaggtgctaaggctacaagtattctaaaaacagaggacaggataaactttgtcaaataccgaggggaaaaataattaacatgttagcatatgtcttagtctgtttcctgtcgcctataacggaatacttgtaactcagcaatttataagaaaggaaatttatctcttatagttggaggctgggaagtccaaggttgagggagcaaaactggtgaaagccttcttgccgtgacaacactctagaatcctgagacaacgtaggacatcacatggcaagggggcagactgtgctagcgcaggtctctctttatgtttctataaagctaccagtcccattcccatgataacccagtaattcattaacccaagaaaagactcatccattcatgggccctcatgacccacctcttaaaggccccagctctcaatactgccacactggggcttaactttcaacatgagttttggaggggacaaaaattcaaaccatagcagtgtgtaaataagtcttccatagatatttactaccaaaaaataacattactctctatagtaggttgaatgttgactagagtccccaaaatttcatgttcacctggaacctcagaatgtaacattcctgggagatacggtccttgcagatgcaactaattaagaaccatgagataaaatcatcctggatttaaggtgggccctaaatccaataactgatatgcttttaataggaggagaggacacagagggacacatacagaggggaaggtgctgtaaagatgaaggcagagtttgacgtcatagtgccaaaagccaaagaataaatgggaccatcagaagctggaagagccagggaaagattttcactgtgagccttcagagggaatgtggccctgctgcattttgatttctgatttctagcctccagaactgtgagagaataaatttctgtcgtttttaagtcacccagtttatcataatttactacagcagccataggtaactagtacactttccctgtactctctaggactaaaacagaggaagacatacagaagttttataagtgtaaatagtgatctcaaagcccccaattgataggagcacataaggacaaataaaaatcaatgagaaaacttaagaggttgcagtgatggtttctggtagtagtaagcctcaaacgaaatgtactgccctctatttggagctgttccctcttaaatcaaatgcagatgccctccaaaagtgatgcaacatcttctgatccaatcctttcaagcaagccagaaactgatcttaacgtggaattggtcattaaaaaaaaaaaaagaaagaaagaaagaaaagaaaattaataggctgggtgcagtggctcacgcctgtaaatccagcactttgggaggctgaggcaggaggactgctggagcccaggagtttgagaccagcatgggcaacatagtgagacccccatttctacaaaaaaaaaatttaaacatctgctgagcatggtggtgcacacctgtagtcccagctactgggaagctgagatgggaggactgcctgggaggttgagactgcagtgagccatgatcatgccactgcactccagcctgggtgacaaagtgaggcctttatatttttaaaaatccaagtggtatattgatgtaaataattaatatcttacaatgatatatgatcaatagcaaaagtatactggaaattacttaattggacataaatcagttctcaaataaaaaattatttatgttcctgaagaacttgattcagagagtaaatatacctatttttcatcaatggaaatttaaatataatatcagtaacaaatttacatagaggaaaatcaattttattttggtctagagtatatactatcatgagacttggcaaagaccctaataagtatacagatcacggcttgaggcatcagatcagcatgattaaagattatgtttgaattgtctcctgatatacaaaattaaccatttcttaagtaatactaaactcagctatcctatttgctacacaaatttaagccattatagaagcaacattttagttaattttcaatatctctatttactttctgtgcatatttttatgtacttacacttaaatcttaactttcagatagtcctaccttatttaatttttttacctttaaaaagtcataacctgtggtataatcttcttttgatatgcttaacaaaatataacaatgaaatgtagtgtaaaaagtttaaatacttttaaaaatatatttttaaatagcttaagaaatatattttgaaaatatattttacacaaatatgaatgtgtgaaatatctattcacacatttttaccctaatgcacagaaatcctttcgtttagaaaaatagaaattgtattcataatttcccttaaagactctcaaaaccataaggatgatacatgcagatattaactattagatattacatgtttaaagcaggaaagaatgaaaacgttaacttcctagaaaactgcaaatatcaaattctttttcttttggttttttaacttaagagttgtgcattaattactattagtaattaattagtcaccaaatattctaaaggtgggaacaaaaggttcttacaactcagagatgaatctatttatatttgactttttttctcagacactggtctcctaacactttataagttcaataagatgtgaatatagataattagggtattcctatataatcaggtagaaagtgaatacatttgtgtcagtagctacaataatttgcattaaatgaatgagtgaataaaaaataaatcataaaaaggcactgtttgggattggtataaaacatttacttttaatacataaattattaatattaagcagttatattacaaatgacagagaactgttattgaggtgcaaataactcaacagtaaatattagccatgactaggttatagggtgtttctggaattcttgcttctttttagattagtataatgctctactcaaggtgtagagtaaatctgcaataactagagcaaataataagtggtagaaaaaaaaggatctatacagaagaccatattttattacatggtttcagaatagcattatgattatgatgactaatgagaggaggaagaagaagagatgtttttaattttaaagtgctttggtatgttgtcatctctaatttacagatgaggaaactgagcgtaaaagcacacgaagagctgcctatatctcatagccaataagtgataacagagaaacttaaatccctctcttctatttctaaaccctgtactctttctactctattatattgtctctttattccctgaaaccagagatatgtattaacagtaaaattcttaaatactgcagttaaaatagaaattcctccaagccagtgttgaaagcaccacagtatttataaaaataaaaatcagcttcttaaaaaattattgttcttaaataaatttaaaaagaacaaaatcttctttgagttcccctatattcctcatacagaatcttggcagtgataatctgcaccgtaaactgtgaagtaaattgtgtatgtgaatgaaaacaataagaacctacagaaacacatgggagatctaactcggataggatggtctgagtagcgtagggacatggatgaagctagaaaccatcattctgagcaaactgtcacaaggacagaaaaccaaataccgcatgttctcactcataggtgggaattgaacaatgagaacacttggacacagggtggggaacatcacacaccgggcctgtcctggggtggggagacgggggagggattgcattaggagatgtacctaatgtaaatgacaagttaaggggtgcagcacaccaacatggcacatgtatacatatgtaacaaacctgcacattgtgcacatgtaccctagaacttaaagtataataaaaaaggaagaaaaataataataatattatcacatttcacagagtttacagtctggcggaggagaaaaacattaaactaataattatataaccacttatttatttacacctgaggtctattcgttatctttgactatgccacataattccaatctgaactcacttgtatgcattacttagcttggcgatgcttgatgttctcctttctatttccttatgtcctatgcttcatgtttttttcaaggcccagcttaagttcagcctcttcccagcagttcacagagatctctgcctccactaaatatctttagcacttaatgattctttttcaacaatggcaaatgggtttcctattacatgaaacttccaacaattggtatggctgtcaaagtactgtcttcagagggactctgaggtcaagttttggtgtagtgacagagacagccataatggattagtgttgtttcatggacagtgaaggggagacaggggatgctgaatttagaacattgacttcacaaatagactgcctaacttaaaaaaaatgtttgtagcatttattttacaccaaatccaggtctaagcatgcaatttgacactgagagtgccttgttttattttttaaaaaacctgtatcatgtctcctcaagtatcataagattcttgcatgtaatacttctctatgctcacagcatgtagtcatgccttgaaacataggcatttgctgatgacaataaattaccattttagaattcactcttattactattgtgaactccatttatgtcatagcttctctcaaaatattatcaatattgaacccattttagaaaaactttgtaacataagctataaaatgtaagtaaatatattgtctttaccatgaccagattcaaattcaacattaggatattgataacacttaacgattaaatatatacctgccaaataataaaatgaaacaaagagaagataactacttcttaaatgagtttaaacattttttaaaaatccagccaggcgtggtggctcatgcctgtaatcctagcactttgggaggcccaggcaggtggattgcctgagctcaggagtttgagaccagcccgggcaacatggtgaaaccccgtctctactaaaatacaaaaaactagacgggtgtggtggcgggcacctgtagtcccagctactcggaaggctgaggcaggagaattgtttgaacccaggaagtggaggttgcagtgagccgtgatcgcgcctctgcactccagcctgggcgacagagcgagactccatctccaaaaaaaaaaaatatccaaatctgtgtatttcaaaatatattttacatacttattatgtcctaaaatttgtatctctcttttagtatacttcattttcctgcacatagtaagtgttgaagaaatccacagtggttagtttagaccttattttagagagatagctccattttacattccgtcttgctaaggaagtgtattcatcatattccataacagctcacagtttgttatacattaactgcttattctctgtgccaataagactgtgctggaacagcaaataaatttggtgcattcatttaaatgattctgcaaaccacaggctacccagttgtctaatgataagagagccccaaagccacctgatcaccattatactcccttatttttttggatttgcatggtcagtactgtcaggatctgaatacagagaagaatgagaagtaaaagtatacctcagacctaatcatgaaaagggattttattaatttcggcaccagtgatgatgtggctaggttggaaggggaatgggatataagatctggagtgctttatctgctccaagaccaatgctggttttggcacttctctcactctagtgagttgcaaaaaaacaagcaggtgctagcaatctgagagaccacatgccagctacagctgcttcaaactgattcaattacatctgcctgaatagtcccaggacatcaaactagttgaagagatccataggttgcaaggagactttgtctatcctgatggacaactgtctctgagataatgacctgcaaatttccaggttgtgatataaagtgatcattccatcaccaggcataagagaaaagatgggggaatgcgatgttttattcactttaaaattaaaaattggttgtagaaagcacaaaggcctctttgaatttaaatctgaaagtcactgaggccttatggataccttgaaacagcccaattttgtgagaacatttcccaaatcattgggtacagcacatttacagaacatgctcttgggatccggacttcgctccaaaccttgtttgtacaaaaaggggccaagcagctgggaaattctggagtggagtgtgtcctcattagttcccatctgccaccagaactcagctcatggcaagtttggctaagtcctggtgtactcaggtccaaatgtgggtcagttttaattacactatacagaattcagtgtgcagttttaaaatccttattatacagcacagaggaatgggcagctctccagctaatcaattttttaaaagtacatatataaaaattttaaaccaggctagacagacagtgggtggaaaaaaatctttaaatgagtacaagggttacttaagagaattattagtgaaattgggtcatgaacaagttctgctttaaagcttcaaagtgagaaacaaactgttttcattggtaagttggaaaacttatgtaaggtacacaatgtgccttgctctttagtgtgaataacaataagcctgtggccagggtacacaacacacctacaagtgaactggctttcatgtaagcagaaatgttcccaattttgtgactcttcactccatccccttttgatgtttatcacttatggcaaagactggataaaagaaaaaaatcacaagctacctggtaaatagtgaaaaaaaaaagatgaggaaggggagggagtgagagaaaaggagagtagaaagcacaagtgctgagtagcagactctgggcatgacttgtctctcagtgccatccatacaaatgggggccagaatcaacgcttgcagtctatgttcagattccatcctgtccaaaagctttatcaggttcaggagcgctaaaacactaagccttcgaagacaattgtcagtaaaaaattcaggagtaaacacgtcggcagtcagtgattaggcatttatgcaccatttttgatagataaaatgtcccttgacacaagtcctaatgacaacaacaacaacaacaacaaaacacaaaaaccttaaatgttcaaagtatctttgggcttttgactgagtttttatcaggtttatccatttaaaagcagcacgggatgctaggttcaaataccagcattgaatatttacaagctatatgactttggacaaattgcttatcctctctgacattttgttttctcacctgcaaaatgggagaaataacatcttcctcacagggctgttgcaaggatcataaaacatatatgcatacatatattggatattacatatctatatatacatacatgcatatatatacatatacactcacataaatgtgcatatgtatatatatagcatctggaacatgaaagtcactcaataaatgttaactatcattaacccagttatgatgaactaaattttgttccccaacccctccaaaaaaaaacatgtgttggagttctaaccccaagtacttccaaatgtgatcttacttggacataggtctctaaagaggtaatcgagttaaaataatgcaattagggtgggcctgaattcaatatgactgatgtccttataaaagcagagaaatctggggacagagacagatacttacagagggaagacagaggaagacatatggagagacataggaaggagatggccatctatatgtcaaggagaaaggctggaacagatccttccctcacagccctgagaagaaccaacctggctaataaaccttgatttcagacttctgaactgtgagaaaacaaatgtctgtttaagccaccaagtttgtggtcctttgtaatattcccaactaaataaaaattccattaatcatcaatatttaccttgattcatcatggtcgaaactatacatttgatattaggcaggtctgtattacctctggtgagtaataatcaattctatatatattatctagtgatgttttcattattttaaaagaatccttttctgattgctgtacaagaagatactgctgcaatataaacagcctggcagaggaaaatggtttactataattaagatcatctagttattattaaagataattaagggaaaatcatacatataaattcataaatccacttttctactgttgagtttgcatagaaggaaatcagaaaatcttaccacactaatttccttctcaagaaaaaataaaaccttacacagcgatttatgcactgacaactatgctcactaaacctgaggctgcttagattaccaacaggaccacttttaagtcattttgatgcatatgaaagtaactcatcaagcatgggttcttcatcctttgcaagagactgcttttaaaggtatctgactttcagaagagggatgagagttgtctgggttgtgtcaacacgctttctattgcaagacatacctccataatcaacagacattgaagtgaatgtgagcatccccatcttaagtttttctttaaacagccctagccttctatagaaatgtggcatgtatagttagaaattatgagtctaattatgttgaactgagataagcaacagatatcacaagagccataattggaccaaagttaactttcttaatgtatgtgtcccacacttccttgaaattcctatactactgattataaaaatttttatattttgtcaagagaagagaggaaaaaataatacacagagactactatgcaataatacataggtggtagtggtgcacaaaataaagtattttgtatacctaatttactttaatccacatatccaccattaaaaaggtaggtgttgttaccaccatactatacataggaaagcttgaggcttagtaagctctgccaacctcgatgaggtcgcacagctactgaataatggagctagacttttggtaaaggtcagtgggagggaatccaaagctcctaaattcaaactcaagcatgagatttacaatccagatatcctaagtgcatcactgggttccaagatggtgatttatttaaggaattcacaggcgtgttgaaagcatttgaactcacataagcagtagatgtgttcttgctaaacctaactcaacttattctccttatgaggaaatcaatgctattcacaaacacaacctaaaaggctttattcaatttaaatgaaattaatcttattataagaacacatgaaaatggaattaccatacaatctagcaattccacttctgggtatatactcaaaagcattgaaagcaggttctcagagagatagttgtacacctatattcatagccaaattgttcataataattaaaacatggaagcaatccaagtgtccactgatgagtgaatggacaggcaaaatgtggtatatacatgcaattaattattattcagccataaaaacaaggaaatcctgacatgtactaccacatggatgaatgctgaggacattacgctaagtgaaataagccaaacacgagaagagaaatactatatgattccacttatataactacatagagaagtcaaaatgacagagacagacactaaaatggtggctgccagaggctgggggtgggagtgcagagggaaatgggaagttatattttaatgggtatagtattttagttttacaacatgaaagtgttatatagagatgtattgtggtgatggctgtgcaagcatcataaatgtatttaataccattgaactgtataccaaaaaatagttaagatagtaaacttcatgttgtgtgtatttttcccaaatacaaaaatttggggaaaataataaaaatatcacatgaaggtcttttagattcagtacattgcttcatgatttttataatatcttctaaggccagggaagcagaggtaactttgtatagaacctctgagtacaatctatgtgataatgcccaaccaggatccctgctcccaggcaattagatgttcttttttcagagtctaaactgcagtagtggtgatggcgagggaactggtagtgatagaaatgacagtagcatagctaagatttcttcagtacttgctatgtgccaaccagtggaccaagaatcttacatgtagtgtgttattaactctcagacaacagatactattattttcccagttttacaaatgagtaaacaagggaacagaaacattaggtaacttgattgagaccatactaataataagtggtgaagtcaaaaagaactctattgatatatctttgtctctcactagcctgtatcctcttgagaacaaagattttgttgtattcatctagcctagcacaatttctagcaaacagcagacatccattcaccatgcagaataaaaggaaatgaggaaaggagagagggaaagaagggggaaaaaagaaattatatctagtcatgctatgttcttaataaatgtggattttctttctttatttccttaaccctgaaatcgcaggggaacctgcaataatgctcaggaatcctagggcataggaattcctccctctttgagattccaggctaattcctgacacaggaccctcaaaaagctgctaatatctgtctagtttaatgattaatattctagcaaatatatattcttggctcatctcctaatttctaatattgagactaacagagagatagagttcaatctaccacactaagattcactggaaaaaaccgatgtctttgatattggcctcttgcacactggtgtgaactgaggtaaaagaaaaactgttcccagaggaaaggtagttccatgcctaaaagtacatgtgtcataaaccagtggtactaaaatttgagaagcctaaacaaaaggttttaatgcaatagataactggcttattatgtaaactgtgccaatcttatgtgacgggcttatgccacacaaaacggaacattagaatgatctatctaaagcaagtcttaactgttctattttgactctactcttgcttggctttacctctatttataattaaaatttagtgagtcatagagaccataattataaacatgtatacagtaaacacagggtccattacttttgcttagaaaaataattacagattttttaatattctgatcttaactgacccaaaggaattaaacacacattttatttttgtgttttagtgagatagagatagggagggagaagcataagccagtgctcaggaaagacgaggcattaaccatataacatagatttgtttatttatgggctgcaaagtatttccaaggtgacaagtaacttagccattaatgcctcagccttatgtgtataatgggaataacatacagacttcttgtaataagtaaaagttagtttaaagcacattgcaaatagtgttatttcaattattcattaaaatagtcaaaaaggatcagttcttatacattaatttctcattttaaggacagaatttatcagtattctcatatctatgtaactggcagtatgagaactaaaggccatcaagacttatctaaactgtataacaagtaataagattttaggacacaatccctctatttctaatacaactccagaaatgttttattcataaatgcattcattcaacatttactgatcaactactatgtacaaggcattgtataagaggctgtggcaatcctctacttacctttgtactgtgtttcctacttccaaagaggttaaattaataccaaagtgatttgttaaaaatacaaaaaaggattccaaatgggccaataaaaggaaaagacacaccaactctaagaccagatttatgttactaaataccgacggaaactcctcagcatttaaaagaatacattaaggagagtaatgcaagtcatttggatgttttcaatatgagaaatttgagcctactgaataaattaattaaatatctttaatattgagttgcagctttttattgcatttatagaactttacctattagtaaaatatacaatctataatagcttgtctatatcaaaaatatagatatctgtcagaaaacatacaaagccacaactaaaatacatttaatatcattaccagtaacatttgtgaaaaaataccaagcatctagcatttgttaaattaaagaataatattccataaaatctacatctggattttagcccctcttttagaattactatttaatcttcactttttttctctctcacttctaccccaacagcaacagaaacacatgcacaaattaaggaattatcttacaatatacccttaaattttctgaatatgccccatgtgtccactaatagccaaatgctttcaaatctgttcagctaaatggatcaataactacatccagcctcacatagtggggctgccaacacggtgaaattgagccaaacacaaaatgtctctaccaggacaaaaattattatcaacccagttatctgaagagatctactctcccagatattctttcgagaagttggcatacacattatctagggcagtcaacagctactaaaaaaaaaatatttgagtcataaaacagaggatttaaagaaaatattcagaagctaaaaccagtgagttttagaataaaccaatgtaacagttcaaggtctacatcaagtaagaatctttcagagtcagagtacacaaaacacgtaagagcacaagcacactgctaacaagcttctctgtgctctcactcatatgacacagctgcaagcaacaattgagcaggtgcaaccaagcttttgagaattcctgcctgttgcccaggaaccacaacactgcatggttgagattttaaacaggtgcaaacatttttttttcccattcgtctagtgcttgagacagtggagcagacagtacatctgcaaccactccatacctaaagcaaccatcacagaaaataaactcaaaagcagcaaaataaaaaaaagtttaaataaaacaataatggcaaaactgtggttttgcaatggtctgaccccacatcaccgttcactttaatagtacaattccataaaataatctcttcaccagatgaatgctttgtaattaaaattatttgccttatcaaatcttagaaatgtttacttgattcttacaatagaataaaataaaatatatgtataaaatgtactatcctttgaagctgtcattatctgtaagtaatcaagaattaacatttttacattatgaaatctataagcaattttaatacataaaaatattataacttgttagttaatatatagatttacatagttataggtaattcatatacatacctgtgcagctatggggcacaaacttgcaattcatcaattctgaaatgtaaaagaaatatataagtaaaaattaatttactaagttggaaccagtatttatgttgcaacaattcctgcagagaagtaggaaaagtttcagtgcataaagaggtaaattattttttatcaatattttccctataggatatttcatatatctgaaaatatatacacacacacacacacacacacacacacacacacacagagtcccttagcagtgtatcataagcactagcaagggactctgactcaccatggcctctgaaactcaaatgctttcactagaggacgaggcaaacactttaaaatgatttttttttttggtattcttccaagactattgccttcctaatacaaatatgactgctgctctctaaaatgaaactactcagattcatctgcactcagtttggatagaatgttgttaaggaagaaaggtgcttttgtagagcagtccacaaaaaaatgcatgaataaatgaaagtaaactttgaatgttcgttaactttgagttacaacagcaaatagaaatgaaattgattgctacaagaaggaatgctaacaccacgtcggatataatgcaaaatgcctcaactcaacacactttgacaaaactgccagcgaagtaggtattgatacagaagactatgtaagtccacattaaacaaaagtagcagtttacaattagacctgaaaaacatttggatttaggtggaaactgtattgcaacatacagcctgggaactactggtactcttaaaaatatttcctagttctagccaggagtggtggctcacgcctgtaatcccagcactatgggaggctgaggtgggctgatcacctgaggtcaggagttcgagactagcccgagattacgctattgcactccagcctgggtgacaagagagaggctccatctcaaaaaaaaaaaaaattctttttgaaagcaaacggacatgtttaatttatatagttcttctgagcacagtcgattacagcaacacattatagtcagtaagtccactttataatactgcttaaaagtatatagaggtaataattttgatgatggctcaataaaacaacatcttcgtatattctgatgggaatgtggattacaaaagactttctagaaacccactgagtactatgtatcaagaacccaaagttcaatatttttactcagtaattttagtcccaggaatcaaatgtaatagaaaaccaacagaaatttatgtaaaaaagataatttttatgacagtaaaaaactataagcaacctaaatatctaatagaaaaataattaaataaagcatagcacatctatataaaggaatatttggcaaaatttaacaaggtactttaaagaatattttaaattttacggaaaaatgcaaatttatagtattatgatgctaaaatattatataaacatgtagactaccaattacatggacagtatgaaattatgtgaataagaaaaaacaaagaacaaaacaaagaattaagagtgattatatctggataataagactttggatgattttaattttttctttttactttcatatatagttaattatctacaataagcatgacttttataataggaaaaaataatagtaggtagggtaggggtaaaaggaaaaagttataaaatgctatattgaattcataaatgtaaccttcctaagagaaataaattaattcagtcacaaataaaacccagtaactgtgcctacagtgagaaacaccctcactgcttcctcaaaggggcatagccagggtcttttttatcccagtgctttggaatctacacaagtaattcaataacacatttttaaatcatcttagtaaaacttctttacttattatgcagagtgaaatgatggcaagaataatttaggacttcaaatctcttcaacctagcacagcctaacttattcactaattcaatcacattcagtgagcatctactgcctgcatggtgctgtgtttggcactgcaacgtgctaacagataaattaggacacaccttaccctcattgagctaacaatttaaaaacactaaaaaatgtttagacacagctcacatgaagaagtaaacacaatacagttcaaagcatttgtgacagatttggtacattttaaagcaagaaaacatacactaggtttattttttatatttctgagcaaacacctatctttaggtaacaataaaaagtcatgtgtattagtatcacttattaatgcactagcaaattaagtatttaagttttttccttatgtgatctattttttgttaatggacagttacataataggagattaagtatgaaggaatagtgacccaatctggaatgcagatgtgtaagattgtctcagtttatctgaggccacataaaacacatgcacaattattaacaggctgcagttatttattggaaaccaaagcaaataagttagttactggttaatcctgctaaaagacactgttatgacaacaccaccagggaaagaaaagaagatagagcaaaccacttttgttatgcagataaaatgattcagcatagagattctctcaatagcagttcagtttcctgctggcctgtaaacataatcagcaatgcccttctgaggccagtgctgcaggattattccaatgtgaggtcaatggggtcaatctgtgtgaagtggtgacaaacactaagagaaggtaagaagctatttgtgtgatcagtgatccatagactggggctcagagttctgggaagcagtagagttatgaggtagggtggtagttaagcacttagcttttgccatcaaacaaacctggaatcaaattccagctccccatctttagttctgtgatcctaagcaatttaaattttctgtctgtaaaatggtgatcatgttactcaccctacgaggttgtctatgcaggttatatgttatagccatataaaggaactagcacagtgccagccatgaggtaagcatttgataaaagggaactgttagtactatcatagttgtatgaaaagggaaagcatgtctgtccctttaagctaaggaactaagctaggcaaggagtaaggagataaagaaggcttgttgaagacatcaccctacagtccagcagctcatccaaaagccagtcatgtgcttgatgttcacagaacatttctgaatcaggcaacactgcaacaatagtaatagccacaataacaattctaaccagcacttttaagctccattcctatgactgaaaagaaaggcagtaaagtctaaataatacgtgcagcaacactgccgaacttctctgggtgaaaaatgaaggatcactttccacatttaactgaaacaatcaggaaaaggaaaataaggacaaaatgaatataattactcaactggaattggaccaaggtgccgtgtaatggtcttagcaatcacatgtaggcacttatcacctttttatgtattctaaggagatcctgcagatgaccagagccttatatatgaggtttgcaactctaagtaaaaaaaaacgttagagtcagtttttttcttatggctgggaagacagaaatggatgcatactgatgttgttctagtccttatttgtgttttgatttaaaggacagcacagatcctgagttgttaagtggcgtgtcttcagattcccacacagttcatgtaattgctagagttgtttcactcgcattgggtgaagttactattagcaccattccagatgcagatatactatagagtgtttgtttgtttgtttgtttgtttgaagttctttttacttctaggttggcatagctgtgttctccagtgggataggtccaattctatgttacagaatacagaaatagttcatcttcccttcatactagttgggcctggctagagatgccccttaagccattaataaatctacttgctaattcacttagagtactaacaaggatctcacctgggcctgtgggtacaaccactccatagaagagctctaaacctaaatttaaacaaaaagaatttcacccatgactgaggaagcatccacaggactattttacatgctttacatttaaatttgatattttgagagaagactatgtaattcaaaataattttattttatttaatatgtatttagtccttctggacccactacagagctggatgttgtatcattattatatggttattataaaatgtacactttactcatcaataaagccaattttacttttgaaaattgaggtacctggcttctgtggtttctctcaacagaaagtcctatgaagagtaagaactataaattgtcaagtagacttgaaaaacttatgcttattttgtaaattactgagctaggtctggcccttcattttgaaaagctatctgcctataagaaagaggaagtatgaggagcacagttatctattaatcaacactgtgaactggaaacagataaagtgcaataaagaaggaaaaggaaatcatatggtaaacaccgttaacccaacggcacagttgatctgtctagaccttaggtcagataagctgtaataaagctataaaatccacgaaaaactaaagcttatttacaaaaactgcaaaatttgaattttctataattaatgccacttaaaatgaaagaatttaatatcaaatttcatgtataaacatgataaatttgaactctcaagtagaaacctcatctacaatacactaagtgttaataattctaattgtcctataatccacacttcacagcatattctagagaaaatagctgttgggtttttatgacttaacttaaacttcacaacttttaaaataaaagtttaagagctaatttaaaaatgtatttaagaacctaaaatttagaaaatattaaaaattatattttcaaaatatcctcaacttgaagttatggctattgaaatcaatgatttattctcagaaaatgtgaaaattttactggcctgcttgtatacatccctggggtcttagtttagatattatctcctccagaatctgatatcctgtgtctaatcctgtcataataatcattttattgcactggaattgtcttttacataagactgtaaacttggggaccagcatttgtatcttattcaccattacatctgtagtttttacttagcacagtacataatgtgtggtaggtaggtcttaaatattggctaaaggaatgttgcatgaattgtgttagcttgtattcttgatgattaagaaaattcacactgcataaaaaattaaggaatcacattcgtaaacaagttattcccaatctttaaaggactaatcttccaatctattttcttgtgctttttctacctatttttcctcttaatcagtacaaacttaaaatatgagaatttgagtctcaaatgttaacaccaggttagaaagcctcgttagtttggccccacattggacaagaatgagttgtccaaatcctacctgttaacagatactcggtatggaagaaactgttacacagagttcactgaaagagttctgcagttcctaaccaattatgtggttcttatactttctctaaaaaacttcttctagctatagttcctgagacagatacctccactattttattcttttgtggcatatatgacagtttaaattattggggtgattattggcttatgtgtttattatctctttctttcccactagattgtatactccatagaggccacactactttattcactactctatacccagggtctagtttagtgcctgacacacagtcaacacttaataagtatttgtcagatgtataagacaaacatgagttcaaaaatatgagcagtaaatttagagcagtagctttcaatcaagagactataaaagtaggcagttaacagctacccctaaaaagtgttttcatttgaactctgtggaagccttgatgatgtagaaaatcttttattgtaaattctgttcaatcaaaggcaaggcagaaaaacttcaaaagcaattctaggtaggatgaaggtatagtacctagaaaaagcaatggaatcacaacaacagcaaccactttcaattagaagttttgagtttgaattaaagcttactaggtatgtgtcctaggtaaacttacataaccatctctaatattcagattaatcatatttaaaatgagggggattttatataatataaaatttttatattatataaaattttatgtttttatgatgacttaatgagattatatgtatacaagtagctattagcattatctatggcatttaggagaaggggctcactattgattagttcctttaccttggccagccagcgtctgcaacaagattgagctaaaacttcatcaagtaaccaggataatacattttaggtaggaaaacatagatgaaataagggcttaaatgcagagaaaagtaagttggtgttagggttaatacataaaaaaaaatgtgtaagacagagtagcgagaatttcacagcagttagaaatggaaaaagatttcaacatgatacaaaaactgccaagaaatctattagcttttcccttaggtgacgcagtcttcccctcatataaataaaataattgctactattatagttggagaaaaatcaactgaaatgtacattaaacacgtattagagatttaacattcttcacatcatttcacatgctgaaaactcaacctttgtaaatatagccatgaaccttattatttactataataaagtaacagcatatccttttctatgtactacttgcagaagtataaaaggcaaatgtgttcttgctctttaggtgcaattacaaggcagcagaatgtagttaggctaattttttgcattttgtgctcatcagacagtggctaccaaccctgcaagaaaaaactggtaccaaaaatacttcatcggaaattctattttcatacttagttgctttcagtattcttactaatttggtcaaacttatgtcagctccctcattaaaattgttttctgtctaaatcgttatcttttctgtgtacgtatatgtgtgtatgtgtattatttggtcaatattcagacagaacaagtctgagatgcaccgcataacaaaagtaatcaccccatccccatacttctcagggaatatctacctggtaccaataagctcatcaagagttcatctgaattcatagcctttgtcaatcagaggtgataaactgtgattttagtagtctatgttccctgcaagaccatcgtcttcatgagggctagaatctggtttattttctttcttttttgtcatcaccacctagttcaggacaaagcacacaatatacaaccattggatatttcattcatttattctaaaatgtttattgagtacttactatgtgacaggcattgttccaagtggtggtgatttaggagtgaacaaaatagatggaaatttctgatctcatggagattatatatatttgttgtggatgtctgataataaatatatagaatgacagacaattatctgcgctaaggaattaaaataaagcagggaaagggaaaagtaaatgatgggattgggagttggggttgaaattttagatagggggaccagcaaagaaattatggaaagatcacattcaagtgaagacccaaaagaaatgaaggagggagttagccagaaatgccttggagaaaaggcaaaggaataggaaagagtttcctttaaaatgccaggctatattcagatagaaatgtttctattaaaatataaaggtatacgaaaggcattcaagccaaagaaataggaaagacttttctttaaaatgtcaggctatattcacacagaaatgtttctattaaaatataaaggtcctatagaaacatttctgtacgaatatataaacatcaaatacataaaagttttaaaatgtttcataagaaaggaacttagaaatcaagaagatagagctagggtatttggcattactatgattctaccacaaccctcccaggggaattatccagctcagtaataacctgagaaatttaggggtacaaataaagtttgcaataactgtaatcactgagaatggcaacctcctaatagatctggaatacctagaagaaacaaatccacttttgcaggataccttcaacaactcaggtcatgtgggagtctcacagaaaaagcaaacaccaatgaaaaagagctcatatatcaaaaatatcaaatccgaagaaaggttcatccataaatgagtcagcagatgaaaaactttaaatgaaatgtacgcattaagttcaaaatagggcacaatcttagggaactaatctgagggccaaaataaaaaaagaaagaaactatgaaaaaggcagatttgataaatatacagagatttatagaaataaaattgtcattaaaattaatatctgaagtgagaatttatcatattaaatggagctaaagggaggattactgaactgaaaaataattccaaggaatttacctaccataaaacagagatagaagatattttttaaaaagattaggagatataaatgacaaaataaaaaactctaacatatctaataagtatttaagaatgaaaaaaaataaagacaaaaatgcaatatctgaaatgatgatgaatcttttccaaaactgataaaacctcagaaaactgtaaaacagcatcaggtaggtccttcagggaatatttcagaaaaaggaatttttatcacaggagatgacagctccatgcatgttattacgccagaagaccttccagtgggacaagatgtagaggtggaggacagtgatatggatgatcccgaccctgtgtagacctggctaatgtgtgcatttttgttagtttttagcaaagtttaaaaagttaaaaaaaattaaatggaaaaaatacagaataaagatgtaaagaaaaaatattttgtacagctatacaatttatgtgagctttaaactaagtgttattacaaaaaattcaaaaagttaaaaaatatgtttataaagtaaaacacttaacagtaagctagggttaatttattattgaagaaatatgaaacttttataaatttagtgtagcctaagtgtacagtgtttataaagtctacagtagcatacagtaatgtcctaggccttcacattcattaaccactcactcactaactttctcagagcaacttccagtcttgcaagctccattcacggtattaattataacttataagcaaaagactataccatacagcatacgtgtacaataggccataccatctacgtttatctaagtacactctatgatgctcacacaatgatgaaatcacctaacaatgcatttctcagaatgtatccctgtcattacgagatgcatgactatatatcaaaactcatgcaatgcagctaaacagtcttagggagcaaagtacaactttaagttaatatgctaaaaagaaaagacaagactaaaattatcaagacattagaaaagttacaaaaaagtaaaaccaaaaaatgtaaaagctgaaacgtaacaataatactgagcataagggaaatgaaaaacaaaaatgtaaagacagtcaacaaaattaagtgttgctttttttaaatgactaataaagtagaaaaatctctgggaatttttattataaaaaagaagatagaaataaaattaaaaagaaaaaacaaatctatttggacatttaagtgattactgaatactatgaaatactttatgctaatttgacttaaatgttcaagttattttacaagtgaaataatatgaacaattttgtagaaaaatataacttgcctaagaagaactagaaactctgattcgacaattataaagatatcacatatgtggttagaaatttatataaacatacacacacacatgcacgcgtgcacacacacacacacacacacacacattaccaggcccaaatatatttaaatataaaatttaataaacctttaaaaatctgttgaggtctatgtgataaaaattggaccatagaaaacaggaaagcacctcaactcttgtataaggcccttgaacactgatatcaaacccagataaaggtattatgagaaagaaaaattatttacaatggtgaggatttagaagaggtacaagctagccaaaagacactcagaaaaagaaaagtaacaatagctattatttatttagctactactaagtgtttgataagagttttgcatatattatttaatctgtatatcagccatataagtggttttattttcattattatcacaattgtataaataaaatgatgctcaaaaaaaataaatgggctcaaagtcataaaattaataagtagcagcagttgatagagggagactctaaagaccatgtacttaaacactgccttgtactatttactcatctttcttaattatgttcacagaggacattatgctgtctccctaacacttcacccaattttaaataaagcataatttttggtttttagcagctttactatgatgttcccaagtgttgttttcttcacgtttattgtgtttagagttcactaagcttcatgtctttcacaaaatttgggaatttttaacctttcttcttaaagtctttaaatattttctctgtcctattcttgttcttcaataccctacatgagagaacaggaggtccctcagacatatacccccacagcaataaaaattttctagttatcccaaaaaaaaaagtgccctagttgaaactttggggctcaagtagggggttgtgaacactagtgacacccaagacctaagaaggccattttgagagggtagaatcaagcccacatgacagacttgccaatgatggtcccagcttcagacatggaaatagctccaacatcctgtatcaaaaacatcgacaaaggggcctggaagaagtcatgcacactaatgcctcaggtgacagtcatttgtcttggctgaggatcctaaaagggagctcccacttagctccagttcctcttggctgctctctcagagcagtcctgccagcacagggaaaaagaactcaaaataatgattttcaataagtccaatgagatgtagaaaacacaaataaaccacaaaatataattaggaaaataattcattaaaaaattagtttagtttaaatattatattccataaaaaaaggaccaaacagataccctatagctgaaaagtatgaagacagaagtgaaaaattcaatacagggcttcaacagcagactcaatcatacagaaaaagaattgatgaacatgatgacaggtaatttgaaattacccacctagaggaacaacaagaaaaagactgaaaaagcatgatgaaagtatgaggaacctatgggacaataccaagtgtacaaaaatatgaattaggaattcccagagaagacagacagagtaagaggacaaaaactaatataaagaaatactagcagaaaagttcccaaatcctgggaggcatatggacattcagattcaagcagcataaaggcttccaagagagatcccaaacaggaatgctctaagacatattataaccaaattgtcaaaagtgaaagacaaagagagatcttgaaagtagtgaaagaaaagagccttgttccatataagtgaacatccaaaagacaatcagtagatttctcaagaaaaaccttgtaaaccaggagggaatggaataatagattcaaagtgctaaaagaaaaaaaaaaaaaaacctgccaaataaaacagtatatccacaaaagctgtccttcaaaaatgaaggagggataataacataaccagacaaaggaaaactgagggaggtcatcacaagacttagaagaaatgctaaagaaagctcttggagtggaaataaaaggatactagatgataaaataaaattatatgaaagaataaaacttactggtaaaaataaacatatagtcaaaatcagaatactctaatactgaaatggtaatacgcacatcactttttaatagggttatttgtctccttattatttgttattaggtatacttttaaactttttattttaatatttttggaacacagtaagtatatatatttatggggtacatgagatattttgatataggcacataatgcctaataatcacataaaggcaaatggagtatccatcacctcaagcatttatgctttgtgttacaaagaatccaactacactcttttagttattttaaaatatacaattaaattatttttgactagtcaccctgttgggtgatcaaatactagatcttactccttctttctagctatcgttttgtactcattaaccatccccacttccccggctcctactccccagttacccttcccaacctctggtaactgtcattctactctctatctccgtgagctcaattgttttaatttttagctcccagaaatatgtgacaacatgttaagtttgtctttctgtgcctcactgacacacaaaaaagaatgacagaacctcattcttttttaaggctgaatactactccattgcatatatgggccatattttctttatccattcttttgttaatggacacttaggttgctaccaaatcttagctattttaactagtgctgcaataaacatgaaagtgcatatatatcttcaatatactgatttcctttgttttgggtatatacctagcagtcagattgctggaccatatggtagatctgtttttagttttctgaagaacctccaggctgttctccatagtacttatacttatttacatttccgccaacagtgtacaaagattctcttttctccatatcctcaccaccacccattattgcttgtcttttggatgtaagtcattttaacgggagttagatgatatctcattgtagttttgatttgcatttctctgatgatcaatgatgttgagcactttttcatataccagtttgcgatttgtatgtcttcttgtgagaaaagtctattcaaatcttttccccattttttatttggattattggattattttgtatatagttgtctgaactccttatatattctggttgttaatcactgtcagatggacattttgcaaacactttctctcattctgtgggttgtctcttcactttgttgatggtttcctttgctgtgcagaagctttttagtttgatgtgatcccatatgtccatttttgctttggttgcttgtgcttatggggtattaagaaatatttgcccagtcaaatgtcctggaaagtttcctcagtgttttttttttcagtagtgtcatagtttgaggtattagacttaagtctttaattcatgttgatttcatttttgtatataatgagagagaagggtctagtttcagtcttctgcatgtgggtattcagttttcccagcaccatttattgaagagactgccctttccccaatgtatgttcttgccacctgtgttgaaaatgagttcactgtaaacgtatgaatttgcttctgggttctctattctgttccattgctatatacactgttggtatgccagtaccatgctcttttggttactatagccctgtagtataatttgaactcaggtgatattcctagttttgttctttttgctcaggatatctttggctattgtgggtcttttgtggtttcctataaattttataattgtgttttctatttctgtgaagaatgtaattggtattttgatagagattacattgaatctgtagactgccttgggtagtatgggcattttaacaatgttgatccttccaattcatgaacatggaatatctttccatttttttgtgtgtccctttcaatatcttgcaacaatcttttatagtttttattgtagagatctttctcttcttcagttatttcctaggtatttaattttatctgtagctattataaattgaattactttttaaatttctttttcagattattcaccattgacacataaaaatgtcactgacttttgtatgttgactttgtatcctgcaaatttactgaatttattgatcagttctaatagttttctggtgaagtcttcaaatataagatcatctcatctcccaacaaggaaaatttgacttattgctttccagtttggatgagcattatttctttctcttctctaattgtactactatgacttctagttttatgttgaataacagtgatgaaagtgagcatccttgtcatgttccagatcttagggtaaaggctttcagtttttccccactcagcatgatactagctgtgggtctgttgtatgtggcttttattatgttgagatatgttacttcgatatccagttttttgagggttttttttttatcatgaggggatactgaatcttaacaaatgtttttttccagcatcaactgaaataatcatatggttcttgtccttcattctgttgatatgtggtattatattgattgatttgcatgtgttgaataatcattgaggcctgggataaattccacttggtcatgatgatcctaatgtgttgttgaatttgggttactagtatttgcttatggatttttacatcaatgttcatcagggatattggcctgtggttttctttgttttcttttctttttttttttaaatgtgtctttggttttggtattaggatgatactggcctcacagaagatggacacattccctcctcttctatttttcagaatagtttgagtagaattggcattagttctttaaatgtttggtaaaattcagcagtaaagcgatcaggtcccagggtttcctttgctgaaggactttttattacagctaccatctcattacttattactggtctgttcaggtattggaattcatggttcaatcctggtaggttgtatatgtctaggaatttactcatttcttctaggttttccaatttatttacatgtattaatagttgcttatagtagcttctaatggtcttttgaatttctgtagtatcaattgtaaggtaacctttttcaattttgattttatttatttgggtcttctatctttttttctgtcaattttgtttatcttttcaaaatgtctgtcaattttgtttatcttttcaaaaaaccaacttttcatttcactgatcttttgtattattttcttcatttcaactgcatttatttctgcactgatctttattatttatttaattctaccgattttgggtttggtttactcttgcttctctagttctctaagatgcattgttggtttttttattgaaagtttttctactttcttgatgtaggcacttgtcactacaaatttccctcttagttttgatatgttctgtttccattatcatttatttcaaaaaacttttaaaatttccttcataatttcttcattgaccaactgatcactcaggagtacactgtttaatttccatgtgtctgtatagtttccacaattcttcattattaatttctagttttattccatggtgatcagagaagatatttgatattatttcaaatttttgaatattttaaagcttgttttgtagtcttaggtatccttgagaatgatccatatgctgatgacaaaaatgcgtattttgcagccgttggatgaaatgttatgtaaatatgtattaggttcattcagtctatggtgcagattaagtccaatgtttctttgctgattttctgtatggatgatctgttcattgctgaaagtgggatgttgatgtcttcagctattactgtactggggtctatctctctgttaagctctgataatatttgctttatatatctgggtgctccagtgttgggtgtatatttatttacagttgttatatcctcttgctaaactgacccctttataattacatagtgaccttctttatctcttcttgtagtttttgtcttgaaatctgtattgtatgatatcagtatatttcaagtatacttccaaatatgattacagtattataatgttgtttttctatgtacatattacgtacataccagtagtattatgtactatgtaatagtaataatatttttactgttactgcaagttttgtaccttcagatgatttcttattgctcattaacatccctttctttctaattgaagtactccatttagcatttcctgtagaacaggtctgatattgatgaaatccctcagcttttatttgtctgggaaagtctttatttctccctcatgtttgaaggacatttcaccaggtatactattatagggtaagagtttattccttcagcactttaaatatgtcatgctactttttcctgggctgtaaggtttccactgaagagtctgatgccagatgctctgttgtatgttatttgtttcttttctctttctacttttagaatccttttccttatatttgaccttttgggaatttgactattaaatgctttgagatagtcttctttaggttaaatctgcttggtgttctttaaccttcttgtgcttgaataattatatctttctctaggcttgtgaagttctctaataccgtcctcagaacaaactttctacctctacctctctctttacctcacttttaagaccaataactgttgccctgttgagtatcttgtaggcatgcttcattcttttttattctgtccttttgtctcctaaatatgttttcaaacagtccttcttcaagctcactaattctttcttctgtttgatcaattctcccgttaagaggctgctgcattcttcagggtgtcaactgcatttttcacctccagaatttctgtttgattcttaaaaattgtgtcaatctatttgttaaatttgtctgataggattctgaattccttctctatgctatcttgaattttattgagtttcctcaataattctgtctaaaaggtcacgttatctctgtgtttctgagattgatccttggtgccttatttagattgcttgatgaggtcatgtcttcctggatggtcttgatgcttgtggatgtctgttaatgtctacacagtgaagaagtaggtatttattgtagtcttggcagtctggacttgtttgtacccacccttcttggggaagcattctaggtattcaaagggacttgtttattgtgactaaatttttggtcaatgcagctgtgtctacattgggggcactccagggtcagttacactgaggctcttacagactcatagaattaccatattggtggtcttgtacaagatctggaagaattctctggattactaggcagagacttttgttctcttccattactttctcccaaacagagtctctctgtgtgagtgtgcttagctgcctggtgctgggctgggagagacataatacaagttcccctgtggccatcaccactgagactgtgctgggtctgacctgaggccagcacagcactgggtcttgcagaaggcccactataaccactatttggctgctgcctacattcactcaaggccctggggttctacaattatcagttaccaacaccagccacatctgtgtcctttttttcatggcaccgaatgcccccggccccagatggttccagagaggccctctaagatccagggcctggagtaagaaaccttaagaatctacctggtgctccattctactgcagctgagctggcacgcaagccacaagacaagtcttttccacaagcacagaagtctcttctcttggacaccactgccacaggcccatggggagtactaacaagctactgtcaatgttcattcaagacccaaaggttcttcagtcagcttgtggtgaatgctgccaggcctgggactcatccttccatgtggtgagctcccctctagcctagggaaactccccaaatgccattcaagaaccaagtcctggattcaggaaccccaagagcccacttcctgctctacaacactatggccaagctagcatctaagctgcaagacaaagtccccttttctctcccatctgtttttctcaagcagaagtagtctctccctgtagccaccacagctgggaatgttctggatcacacctgaagccagcatgtttcagagtctcactcaatgcccatgacatgtactgcctggatattgctgctgattaggaaaggcccaaaggctctttagtcagcaggtgatgaatcctgccagggctgggtccttctcttcaaggcagcacattcccttctagcccagagtatatctagaaatgttatctggaagctagtgcctaaagtgggtgcttcaagactctacttggtgccctatcctactgtggctgagtgggatccaagttgcaagacaaagtcctgtttactcttcactcctctcctcaagtggaataaaggagtctctttcagagctaccaattgcattgcttggtgtcagaggaggggtggcagaagccctcccttggccaccctgtctggtgtctcactaggtcatatgacccctgcatccactggctccaagcctagcagagcactaggacttgcctaggagttgcagtccttgtggctcagactgccttaaagtttatttaggaccccagagaattttagcccatagtggtgaagtttgttgatacttgagttccaaccactgggatggacaatttctctcttgtaaatcccttttaagcctaatataaaagataaaagacaaaaaatatcaaaaacaactatagctagaatatttgttaatggatacacaatataaaaaggtataaaatgttatatcaataaagtgggggcctgggggaaaagcaagatacagagtttttatatgcaatggaaattaagttgttatcagtttaaatttgatggttgtcattacaaggtgtgttatatatgcctcaaggtgaccacaggaaaaaacctctagtagacacaaaaaatagagacatgaatcaaagcaaaaattgaataaaatacaaaagaagacagcaagattggaagaaagaaacaaaagaactacaaaacaggccaggcatggtggctcatgcctgtaatcccagcactttgggaggccaaggggagtgaatcatgaggtcaggagttcgagaccatcctggccaagttcgtgaaaccccgtctctactaaaaatacaaaattagccgggtgcggtggcaggtacctgcaatcccagctactcgggaggctgaggcaggagaatcacttgaacccgggaggcagagtttgcagtgagccaagattgtaccactgcactctagcctgggtgacagagcaagactccatctcaaaaaaaaaaaagaactacaaaacagtcagtaaacaattaacaaatggcaatagtaagtccttatttgtcaataattactttaaatgtaaatggattaaattctccaatcaaaatacaaagagtggctcaacagaaaacaaatatgtaaaatccaacaatatgctgcctataagaggctcactttagctgaaaggatacagagccaaaaagtgaagacatgagaaaagatattccattcaaatgataaccaaaagagaataggagtggttatagttatatcagacaaaatagactatcagtcaaaatctatcagaagacacaaagaaggtcattaaatgataataaagtggtcaattcattaagaggatataaaaaattgcacatatacatgcactcaacattagagaatctaaatatataaattaaatgttaacagaacagaagggaaaaatagacaccagtataataatagtaaaagatttcaatattccactttcaaaaatggatagatcatatagacagcaaatcaccagggaaacagtggtctttaaaagtactacagaccaaatagacctacagacatatatagaacattctatccaacagcagtagaatatacatttttctcaagtgcacatggaacagtctccaaatagatcagatgttgggccacagaacaaatcttaacaaatttagaaaaaactaaaattatctcaagtatcttttctgactacattataaaattagaaatcaatcaaaggagaaattaaaaatgaaaaaataaaagtggaaaaatcacaaacatgtggcaattaaataatacacttcttaacagccaatgtgtaaaagaagaaatcaaaaccaaaatcttgcatatctttaaacaaatgaaaatgggcacacaacaagagggaaggacataacaatgaatgcctacattaataaaagaagaaaaatctcaaacaacttaacttcacacctcaaaaaattaaaaaaagaacaaagtgcacaaagtcagcagtaataaggatatattaaaaattagaccagaaataaatgaaatagaaaatagaaaaataatagaaaagatcagtaaacctaagagttcgttttttgaagacagataaatctttagctagattacccaaggaaaaaaagaaagaagactcgaatttaaaattttgtaatggaaaatggacaattaaaatgatagaacagaaacacacaggattataaaaagactacattaaacaattacattccaacagattagataacttagtaaaaaataagttcctagaaacatataagatgcaaagactgcatcataaataataaaattcggaacagattaatagcaagtaaggagattgaatcagtaataaaaaattctcccatcaaagaaaagcccaggactagatgtcttttattttttgagacaaagtcttgctctgtcacccaggctgcagtgcaatggtgtgaccttggctcactgcaacctccatctcctgagttcaagtgattctcctgcttcagcttcccaagtagctgggattacaggcacccaccactacacccagctagtttttgtatttttagtagagatggggtttcactgtgttggccaggctggtctcaacctccagaattcaagtgatctgcatgtctcagcctcccaaattgctgggattacaggtgtgagccaccgtgcctggcaaaagaactagatgtcttgatgagcggattctaccaagctttaaaaaattaatgcccatccctctcaaacagttccaaaatgtttacaagaatgacacacttcctaactcatttcaaggccagcattgccctcataccaaagctggataagagtgctttatggatatacaccatcagcaagctatcgcaaggacaaaaaaccaaacaccgcatgtcctcactcataggtgggaattgaacaatgagaacacttggacacaggaaggggaacatcacacaccagagcctgttttggggtggggggaggggggagggatagcattaggagatatacctaatgtaaatgatgagttaatgggtgcagcacaccaacatggcacatgcatgcatatgtaacaaacctgcacgttgtgcacatgtaccctagaacttaaagtataataaatatacacatatatatatataaagagtgctacaagaaaagaaaattacagagcaatatcttagatgaatatagatacaaaagtcttcaacaaagtaccaccaaaccaaattcaacagcacattaaaaggatcatacaccatgatcaggtgggatttatctctgggatgcaaggatggttcaacatacacaaatcaataaatgtgatacatcacattaacacaatgaaggataacagtgcgggaaaagcacctgacaaaaatcaatgctttcttgataaaaagcctcaacaaatttggtacagaaggaacgtacctcaacataataaagatcaaatatggcaatcccatagaaaacatcatactcagtggtgaaaagctgaaagcatttcctctaagattaggaatgaaaaagcatactcactctcactatttctattaaacatagtattggaattcttagccagagcaattaggcaagaaaaaaattggaaaggaagaagttaaatggtctctgtttatagatgacataatcttatatgtagaaaaaccctgaagactgcagcaaaaaaagaaaaaaaaacctgttgaaacgatatatgaacccaatagtttcaggatacaatgtaacatacaaaaattagttgcagttccctacattaataaagaactctctaagaaattaagaaaaagatccatcttagtctgtgggcattgcttattacctaaggctgggtaatttataaagagaaaaagtttttttggctcatggcttttccggatgtacaagaagcatggcaccagctcctggtgagagctcaggctgcttccactcatggcagaaggtaaagtgaagccagtgtgtggagattacaaggcaagagagaaagaagagagagctgccaggctctttataacaatcggctctcatgggaaccaatagagaaagaaatcactcaatacatcaagacatcaagaaggacatcaaaccacttatgaggaaactacccccacgatcaaacacctctcattaggcctgatagctaacattgggatcaaatttcaacatgaggtttgtggggacagatatccaaattataaaacgattccacttacaatagtatcaaatacaataacatactaagaaataaatttaaccaagttgatgaagaattggtacactgaaaactcttagacactgatgaaagaaactgaagacaaaaacaagtgtaaaaatattgcacgttcgtgaattgaaagaattgctatttttaaaatgcccatgctacctaaagcattttcagattcaatgcaatctatcaatattataatgatattttttacagaaatagacaaaacaatcctgaaatttgtttggaaccacaaaagatcacagatagccatagcaatcttgaaaaggaacaaagctggaggcatcacactctgtgatttcaatttgtcttacgaagctacagtaatcaaaatagtttggtaccagcataaaaacagacacttaggtcaatggaatagaattgagagcccagaaataaatgcacacttgtatggttaactaatctttggcaagggcaccaactatacacaataaggaaaggaaattctcttcaataagtggttttggggaaactggatactcaaatgcaaaagaataagactggatccttgtcttgcactgtacacaaaaattaactcaaaatgaattaaagatttaaatttttaatttaaaaatgtaagatccaaaactgtaaaacaaagctccttgacattggtcttggcaaagagtttttggatattgacacgaaaagcacaggtaacaaaagcaaaaataaaaaaaagtagaactacaccaaactaaaaacctttttcacagcaaaggaaacaaaaactgagaaggcaacctactgaatgggagaaaacatttgcaactatatatctgatgaagggttgatattcagaatgtatgtagaactcacacaactcaatggcaaaaaaaaataataacaataactcaatttaaaaataggaaaaaggcctgaatagacatttttccaaagaaggcatacaaatgggcaagaagtatattaaaaagtgctcaacatcaataatcatcagggaaatgcacatcaaaactacagtgagatatcacctcatgcctgtcagaagggctaagagataaatatctgcaagaatgtggagaaacgaaaacacttgtccactgtaggtgggaatgtaaattggtatagccattatggaaaacagtatggagtttcctaaaaaaatttaaaatagaataattatatgatccagcaagcccacttctgggtttatatccaaaggaaatgaaatcagtatctttaagagatatctgtaccctcataattattgcagcattattcataatacccaaaagatggaaactacctaagtatccatcaatgggtaaagcggataaatgaataaagaaaatgtggtacatatacacaatgaaatattattttgccataaaaataatcaaacctgtcattttcaacaacatgaatgaatctgtaagacattatactaagtaaaataagcaagatatagaaagacaaatagtctgtgatctcacttacatgaaatcttataaaaaggtgaatctcattgcaacagaaagactgatgattgccaggggatggtggtggagaaaataaggagatgttgattaaagggtacaacatttcagttataagttgaacaagttccagggatctaatgtacagaatgggtggtgaagaatgtgtgaattaacttgattgtgataatcactgagaaatgtatgcataaaacaatcacaatgcacactttcactatatacaatctttgtcaattaaatatttttaaataaaaaataaataaaattgtacttccggtttttgagatactgcttattttttatccactcttttttctcactcctttttagattagataatttctattgatctatctttaagttcaatgacttttccttcaacccctcctccattatactgttaatcctactaatttatttatttaatataatacatttctctgttttaaaattcccatttggttcttctttttttttttttttttttttttagatgaagtcttgctctgtcgccaggatggagtgcagtggcgcaatctcggctcactgcaacctctgcctcctgggttcaagcaattctcctgcctcagcctccctagtagctggaattacaggcacatgccaccacacccagctaatttttgtatttttagtagagatggggtttcaccacgttagccaggatggtctcgatctcttgaccctgtgatccgccccctcagcctcccaaagtgctgagattacaggtgtgagccaccgcacctggccaatttggttcttttaataatttcttatttctctgctgagatttcctatctttttgttcatttcaaccatattccctttcatctcttaaagcgcagttttaatacctgctttaatttttttgcctagtaattccaacatgtgggtgattttaagattgtcatctgttgattttctttatccttaagaaagggtaacattttactgggttgaagtaattatggggtttttatttgtttggttgtttgtttttgttttgttttgtcttgagacggagtcttgctctgttgccaggctggagtgcagtggcacgatcttggttcactgcaacctctgcctcctgggttcacacaattctcctgcctcagcctcccgagcagctgggactacaggcgcccgccaccacacctggctaaatttttgtatttttagtagagacggggtttcaccatgttagccaggatgatctcaatctcccgacctcgtgatctgcccaccttggcctcccaaagtgctgggattacaggtgtgagccactgtgcctggccaattatgggttttaacttagacatcgtcaatgttaattgtggatactccagacttggagtccttaacttggacaatgtgttacattgagccaaagagtgctaatatctttgttctcatgggacattaatttggctaatctcatattgaaaaatttgtgctttttggatctcagtgtggactgatttcagtctgccctgtgcatgtgcagttcaggggtcagacaaagacttaagacagaatttatacacacaatatcccatctctgtctctttactttcctatgtttttcctcattctctgacatccccgttccttcccagagttcctacagcctacagagaaagcaagggctttctcttggagttaaattgtcccatgttgccactgcaattggagatgccctcagaaaaagcctcagaaatgtgaaactcacttcatctcatgacatttgcttaatacaaagtttgaacctcctctaatatttctctagtcttatccattctccaaaacctttacagagttgtattgtgttttgttatgctttgcttttatttttggtttttgtccagagtttatagctactatctgcaggctggttgtttttttggaagtttatttctccacacaagaagcaaaactcttgtattattactaatcctgagaacagaaggttacagagaaacagaaaacagaaggctttaaaaaagtaccaagagatacaaataaaaattgaataaaaaacaaacaaacaaaaaactagaaaaatgtctcctgcttctaggagagggctgaacaaaggcagatgaagaggcaataaagtaggtaataagtacatttacagaaatatatgccatcaaataggtaagaatgcaagtaaaatttatatataacaaatacccaaaagttttggaagcagaaaaaatgttagtcaatagttcatattgtctaacaatcaatctgtcacccaggctttgtcacccaggctggaatgcagtgacgtgatcatagctcactgaaatttcaaacactatcctcctgagtagctgggactacaggcatacaccaccacatctggctaattttctattttattttttgtagacatacggtctcactatgttgcccagactggtcttgaacttctgggggctcaatcaatcctccctgcttggcctcccaaagtgctgggattatagtgtgaaaggaaaataaatcttggggcccaaaatcactaagctaaagggaaaagtcaagctggggactgcttagggcaaacctgcttcccattctattcaaagtcatccctctgctcactaagataaatgcatatctcattgcctctttgtcaaggctaatcagaaactcaagaatgcaaccatttgtttctaatctaccaatggcctggaagccccctcccactttgagttgtcctgcttttgcttcaagttgtcctgcccttacgaaccgaaccaatgttcatcttacatatgttgattgatgtctcatgcctccctaaaatgtataaaaccaagttatgctccgactgtcttgggcacatgttatcaaaacctcctgagactgtgtcatgggcatgtgtccttaacgttgacaaaataaacttcctaaattgactgagacctgtctcagattttttagtttcacaacaggcatgagccaccatacctggcctcaaaagtttcaaaaccaacactcttcatcagatcccagaaccaaagaaggaaaaaacaattgaagaatttatgtccacagttatgccaagatttacactaatgcataccacatctcaaagattgaagaactctctcaagaactggcaataattaagtttccaaccaaattatattttctaaattaaaaataagcacacatccaagtgtaaaatttaaaaaaacctgaagctaaagcacattcaccttatagataaaaatatagtccatacctctctattttataaatgcattttcagacttgatgcattataggacatggtaacttcaaacagcaaggaaaaaactcttatttaaaactcagtaagaatataatctctgtaagaaaattatcattttaaataatttcattaaactgttttctcctttgatatacccctggatgtaacactattaggttatagtgaaaaacaccctcaattaactctcaaaaagtatggttccaccattaagctactatgagactttggacaggtcccttcacctatctaggcttcagtttactcatgtgaaatgtgaggctagaacatatggtttctgctttccaggtgtaaaattctataactacataactttatcccttcgtttcatgcagttttatctccgtcttccacttctgtgtcttcctggctggagtagctttatctgtcgtctgaggcatccggggcacaccccatcatttcaggcttagccgtttctaagtcgaaggctgcagtcactgagggcagcctcaaggttcttcaatgatggagaacctcaaggttcttcaatgatggagaacctcaaggttcttcaatgatggagaacctcaaggttcttcaatgatggagaacctcaaggttcttcaatgatggagaacctcaaggttcttcaatgatggagaacctcaaggttcttcaatgatggaaagattcttgtttaatttctaaaaaataaatttggcaaattcctcagatctcaggcccaaagaaaatatttcaggagagatacattatgcctttcacgcaagtgcaaaaaaattaaaaatgtagactcccacacacaatctcaagcaaatcatcaactgacatctgatgttgtcttacctacagagttaagaagcttgtttacatctgtacttcaggtgagtgagataattttgtgaatggtaggttaaaagtaatttcaaatttgagaattaagcaatgagaaatgtgctgtaaatttcaagaaaaagatgctgcaatactgtttaggattctgagaactttagatctatcttcttataaaaacttccacttagaaacaaagaaataaacaaaaaccaggataaacaatacaatgctctttccaacttgctggaattacattcactcagataaacatttattaagcacttagttggtacaaggtgtactgtcctctgtgagacacacactcatagaaaagaattttgtatctgctttagtgagtttataatatgccagaataaatacatactaaaaggcatatatacataaataatataatgcattgcaggaagaggtaagtactatgatagagggacacagaaagtcctgtgcctcaggccttgctccctgcagggcactaagctatttcgaatcacactgcaggaggtggccaactacacagtatgcagtgcatcagtgctatccagggaagaaaagactactacatggttaagagagcctgaaaaaacagaagcagagaggtggacctagaaaactagcagtcggttgaaggtcaatatgttcctacctggaaaatagggtccaactactgggcagaaggccaggacccaagggtgattctgtgcaactgggggaggtgagaaaggagagaaaggaagtgagtattctgctgtgggaagaagggaattccaagatgacaacacagcaagagcttaactatagatgaaggaattctgaatttcttctagtttcccatctcatgatcatgtcaatataaaaggaaattactataaaatgtaataatttctaccagtctacagattctggcaggctaaattaaacctgaagataaggacaaaattacattccagttcctacttacaacttctatcacataaagaggtacttacatagttcatatgtgcaaactgagttgcatgctttctaaatcgttttatttaattgtgaaatgtttggaattgggtgtcactggtcttcattttgttttgaaaaggcaatataagtgaattaatctatcatcaggctaataacaagaataagtattttaactccttcctttgaaatgaaaagacaaattctttagccaagagcttccaagtttaatttacgattcacaaaattctacaaacataaattatatagtagaagtttcccttattcttacttgaatataactctaatcatttgaatatcagttttaacaaaatgaataagagtacaacagagttcagatgaagctcgtttcttgccaaaatccatatgaatgccaaataccttccaagcacaaataaatcctgccttccatttaaacaaacaaacaaacaaacaacaaacaaaacaccacattgcctaagattgggcaatcactactaagtgactactaagtagtgagtaagagctaagggaaacggagcgaactttaggtcaccagggcacggtacactgaaaaacatgtgctgcgcttcttcagaaacaagctacaacagcagaaagacgaggtaccttatatcttgtttataaatcttactttataaaggagaaaaaaatgaaaaaagggaaataatattcccttatatcctattttgtgctaggcacttagacaatgttttattatttaattgaaacttgagttcaatcggtagcaggagcggcgagcggaacccagagagccctgagcagccccaccaccgcccccggcctagttacagtcaccccagaaggagccacaaccctgcagccagcaggtcaccatcacagcaaccacaaccctgagcaaagacgccaaggcagccaaccccaagccggcaccacctgcagcggcgcagggagcagtggcaagggcgacctcacaggcggcgcctgctgatggggataagatcaccgcaaggaagattttgggaacagtaaaatggttcaatgtaagaaataaatggtttcatctatgcgaatggcaccaaggaagatgcagttgtacagcagaataccatacagaagagtaaccccaggaagtaccttagcagtgtaggacacggagagactgtggagtttgatgatgttgcagcagaaaagggtggggaggcagtaaatgttacaggcccctgtagagtccagttgatagcagtaagtatgcagctgaccttaaccatcattgacgctatccatgtggtcctcaggcaattaccagtagaattaccagaatagtgagagtggagaaaagaacgaaggacgggagagtgctcccttaggctcggcccaacaatgccggccctgctgcaggcgaaggttcctgccttactacaggcagagaccctacggaaattgaccaccatattctaaccctccttgcagggagcagcgacggagggtgctaacaactggggtgcaggagcacaaggtaggccagtgaggcaggatatttgtatggtttatagaccacgattcctcagggaacctcatcgccaaagccagcctagagaggacggcagtgaagagagtaaagaaaatcaagatgagacccaatatcagcagcgacctcaacatcggtgctgctaaaaccccaattatctatgtagactcccagaaaaccctaaaccacaacatggcaaagagacaacagcagccagtccaccagtcaagaattctgcacccgaggcagaagaaggttgagtaaatgccggtttaccatctccaccatcatccagtttaatcatccaacaagaagaaatgaatatgaaattacagcaatgagaaatgcaggaaagaaatgctgaagaccttaagtgcttgctttttgcccattgatcagaaaccagaactacctgcattatctacgaagcatggggtttttaaaattatttttacctacagacatgtctttttggtaataacaaaggtttttattgttgttgtttttgtgtgttttttttttagtttggtttttctcaacatgcctttaaaagcttttaaattggttcatatgtcaagttgagatttttaagcacttcacttttaatttgtaataaaagtttacaacttgattttttcaaaaatgtcaaccaactgcaagcacccattgaaagtcttaaataatacaaaaactttaaattaaatcaaatgggtattaacaccatataatacaaaaaagaagtgaggttcgaaaatccttatgcttttgtgatgccacacgtcacctaactggtagcacaacttgattgcaatctgactctgaagcttttcttcattcctagacatcctatttttgttgaagtcctagattttaaaagtataatttttttaggaataaagatctggtaggcaggaaattctgctgaagctgtttctgggcaacttgactttgccagggcctttgcactgattgtgttaatggccacctcctcttcagatgtagggttatggatcacctgtaaccacctgtaacctgtacagcaagctgaaggagtgtttgcctaatatccaatccacagaatttatttcaaaaatggtgagcctcactaaggtgatagcagtagcctgtccacaggctgatcaacaaaatcttgtctttgatccatggtttctgcttcttggagtctcccaaggtacattctgccactgctggacctagaatcatagtctcctttcctaccagccttctcaccctgccaaacttatcatatacaattgtttgacatcacagatattatcaatccctaggcctctctagctttctgctcttgcaatttcttttacattgtctttgtcacccagcacagagcccatacataagtcatcactctattttcttagaaatactttcagttcacttcttggttttcctatctcacttaccaagctgtcttagtacagatctaagatgagaattttagtacaaataatttattttggaaacaaccccatgaaacactggtaagggagaaaggatggaaggcagaaaagggaaataagatagaatgtttgcaaagataaccatcaatagttcctcaaagccttgctctagcatgctgctcttcccatcaagaggcagagtttgtttcccccactcttgaatctgcactgaccttgcaccctttttttgaacaatagattgcagcagaagtgatgctatgctagttctaagccaaggctgcaagagtcctggcagcctcttcttttgctttccttagatgcagataccatgtaaagacgctcagactagattagtgaatgatgagaagcaatggggagagacaggcccagacagaccccagccattctatacattgcactgaggcctaaaacccataagtaaagccatcatagtcattcctgacccagacaggcttccagtcaagtgcaactacatgagtgacccaagctattactaatctaagcctgggcaccccaaagatttgtaaaaaataacaaatctttgttgttttaagtccctgtatttgggggtagtttgttacacagccataaatgaaacagggacaaagccaaaaaagggtacaattattaaacaagttactgctatgggaaatgagtttagtccttctgggatactctggaaaacagtaaagaacatgcctcacagttatcccatgtgaagggtaaggatgatagtgtaatccacccacttgctaacagttatttgcttaagtctttttctagtgacagtaactatttggtactttaagcctgcccaacactgtgagccaaatctgctcagcagccacacacaaaaaatgccttcaggcagacagtcacagtatcaggaataagcagtcttctgtgacaagaggtgagtggtggaaggaaacaggaagagcgtcaacataggtgaaaacccaggcctagagcagtccagctatctgctttctccactcctagaactgcaacagctaaagtgggtcacatacactcacagattataaccactacacatctacagctcccaaacttagctgggtcccaaatgttacttaataatccttccaagtttccctaatcatctgtttactttagtatattttacatctatttcaaaacttcccacttttattaaatcttctattccacctacccctcccccttcggtatcagcaaagcaatatgctctctatcccaatgagaaaataaaggtcatcagatcaattttttgctacctccattgcactgcattcagaatcatccttccttccttccctactaataccacaggaaagggtcaaggtaaatgcagcattaatccagcacctctccatctctggaataccccaccttagaatacaagaacccattatgtacttgcccttttctgtctctcttaggtccctaatgcatgaatctcatcgagttatagatctgttgaaaccctacacctatggatctttgcaccaagcattgttcctactgcctaaaatgtaccttccccaactttccccatttctagactctgccctggcagagtcctcttcatcttttagacctccacttacctgcgacctcttcaggaaagccttctttactttgctgcccacgattcctcaaatctatgcttacctctgccacagcactttgctcttttctgaaatcgctcattcctttttctgatatccttttcctcctcctttacctcccactgaaaataagctcctccaaatcaggtatttgccttatatatttttgaaccatagtatctgtgcctagaacatagctgtggattaacaaatagcaccaaatttaaataaattaattaatcatctcttttccttaagttactttccagagtaactttagtggaagctgcaggcaagatttatgtgtactgtggcccttcctctttctatctttttttttctttttaacattctaagaggtatcatacaggtcatgataaactgagtctcttctaaatttgcatatagtgaaaaataacacgtcaaaatgcatttgcttagaagctcaggaatccattgttcagttaaaacttgttgccttgttataatgttatgacaaaataggcttccatactggcttttaacatataattgttaattatcatcacaaaagtttcaaaatttcttcagttttaaaaagattttcataagtaaaaatgcatacagtacttgtatactcacagtgagcttatttaataatatgtttgtagaatgtaaaatagctttctgttttatggtcagatttgataggcctatcaaaattggtttttatagatatgattgctactttcatcaaaaaatgaaccatcaactttaagagaaatgaaaaaatcaatttgggtcatggtaacttctaagccctactacctagtcctagaatttgttcttaatagaccagactgtctgcaaaatactttgaaacaaagaatgtgtactttgcctcctccctaccatgttcttggcaactagggaatatgggacattttaagtctttaagataaaattaatcacactgatttagaacaactaaaatcttgtcagagtaattcctaccttctcccttccccaccatgttacctttaggaagaggagacacacttgaggaagctcttcaaggctggtcttcagggaaataaagacattgaaattccactccaattattttttattacctgccaccttgaatccagaatatatgttacattatgaagtgtcgtattcttgactcaaaacatccttccaattaagattttcttttttaaaaaaaattaggttaaagcaaaaatgcagaaaagaagggtaaataagattagtaaaccatctgaaaattactgcattttgtaaactttggtaaaatgtatgaagaagcatgttttccagtctgctttctcggcctgtggatacctgggacataattcagtttgccatcccctgttcccagatcagctcagtctttgttcagctccatcttcaatctggcatataattacttcttcagctcctgtgctatttggttttaagcacctcttacccccaaggcctcatggctctaagggcttgttgaatttaaacaagcacatttaaatctttgtctttaaatgagtaaaataaaagtcttaacacctaacacagagtactcttctacactctaaatgtgcatgttataattgcctaccagatcataatgagcatctatccatcctcaaaatcagagaaaggggggctcattctagaggtaaatttacaataaatggctttattcttgattagctatgtgtgtttggggacacagagactggcacctgcataatttaaatacctgataggaatcagatgatcaggacaccttggaaataaaggtggaaaaacaatagtggaggaaacacaataatggaggaaatacagaagaaaaaaaacaagattgttaaaagaaattaataaaatacaacttaaggaattttaagcttcacctctcattggaaaaacactgcaaactcatacacacactgatgcatgcacacatgcatgcacgcacacatgcatgcgcacacacacgtatgcaatataattacagaaatgttaaaactgtctgtctttcctgagagtcaggagatgtggattctgccactactgctgctggcaaatcataaataccatccagggttttagtttagcctgagtaaatgagtaatcattacatttgttccacatacatactttactccaaacactggtagataagtattgaatgagaccctcattcaaatacacggtcaaaaatgccacaaaaagaagtattataattataactattaattataagtaaagttttttaatgaatggataaattagtaaaacaaattttaatagatataaatggaaaacaaagcatgtgcaatctcactagtgatgaaggtaatagaaattttaaaagtgagatactagtctttcacctatcagatcagttaaagtcaataaaagaaaaattcagtgttggaagaggcactgcagtgggagtgtacattagtaccattaagcactatgtatcaagggcctgaatcatgattatgtactgtgccagtttgggtcctcttgtgccaaggtgaattgggtatgtgagataattatttggggtagaatctatacatgataaaggggaagaggtgtaggtaaggagagcactcagactatgatgcaattctgacatctctgaaaggagaaaggcaaggaagcatttggtaggaagagatctgcatgcaggaaagtcctgagaaagtctcagccagggttggttccaagtctttgttattgtgaatagcgctgcaataaacgtatgtgtgcatgtgtctttatagcagaaggatttataatcctttgggtatatagccagtaatgggattgctgggtcaaatggtagttctggttctagatccttgaggaatcgccacactgtcttctacaatggttgaactaatttacactcccactaacagtgtaaaagcgttcttatttctccacatcctctccagcatctgttgttttctgactttttaatggtcgccattctaactggcttgagatggtttctcactgtggttttggtttgcatttctctaataaccagtgatgacgagctttttttcatatgtttgttggtgacataaatgtcttcttcttcttcttcttttttttttttagatggagtctcgctctgttgcccatgctggagtgccggggcgcaatctcggctcactgcaacctccggctcccgcgttcaagtgattctcctccctcagcttcccaagtagctgggactacaggcgcatcctaccacatcctgttaattttttgtatttttattagagacagagtttcaccatgttagccaggatggtctggacctcctgacctcgtgatcagcctgcgttggcctcccaaagtgctggaattacaggagtgagccactgcggccagccgtaaatgtcttcctttgagcagtgtctgttcatatccttcagccacgttttgatagggttgtttgttttcttcttgtaaatttgtttaagttcctggccgggcacggtggctcacgcctgtaatcccagaactttgggaggctgaggcgggtggatcacaaggtcaggagatcaagaccagcctggctaacacggtgaagccccatgtctactaaaaacacaaaaaaattggccggccgtggtggtgggcgcctgtagtctgggactacttgggaggctgaggcaggagaatggcgtggaggcaggagaatggcgtgaacccaggaggcggagcttgcagtgagccgagaacgtgccactacactccagcctgggcaacagagtgagactccatctcaaaaaaaataaaaataaaataaaatatttaagttccttatagattctggatattagccctttgtcagatggatagatggcaaaaattttctcccattctgtaagtcgcctgttcactctgatgataatttcttttgctgtgcagaaactctttagtttaattagatcccatttgtcattttggcttttgttgccattgcttttggtgttttagtcatgaagtctttgcccatgcctatgtcctgaatggtatcacctaggttttcttctagggtttttatggttttaggtcttacgtctaagtctttaatgcccatcaatgatagactggataaagaaaatgtgccacatatacaccatggaatactatgcagccataaaaaggatgagttcatctcctttgcagggacatggatgaagctggaaaccatcattctcagtgaactaacacaggaacagaaaaccaaacaccgcatgttcgcactcataagtgggagctgaacaatgagaacacatggacacagggaggggaacatcacacattggggcctgtcgggtggtggggaagtaggggagggatagcattaggagaaatacctaatgtagatgacaggttgatgggtgcagcaaaccaccatggcacatgtatacctatgtaacaaacctgcaaattctgcacacatatcccagaacttaaaagtataataaaaaaaaaattctagaaaaagaagttgcatctgtactgaacatgtacagagttttttccttctcattattccttaaaccatacaaaaaagaaagtctcagccatgttggtagggagtccctgaaccagagttacccattagaagaatctagtattgggcagaaatgtccccgttctggtattcctgacatgttcagtcactcggtggaagcagccccaaagaaggatggtttcagggtgaatgttgtggtggatccacaggtatagcagctggaggctgtcaattatctatgctctctacaaaagctcctcttgaaaacagagctgagaaagacacttgtatacatatgattttattcccgttctaggaatctatctcaaggaagcaatctaaataccaaaataataatgataaagagctttatgaacaaagatgctcatcgcagtcttttaaaaaataattgaaaggatagaaacaatttaaatgtccaagcataaggattgattaagcagctatagtatgtctactttaccaaaaatgctgtggctattacaatggaaaacttatattttaagtaaaattgaaaatagagataaaatatggtataacttttaaaattaaaagctttgaaaagatacatattttaagactggcagaaaataaaccaatatggtagtaataggaagtttttttgcatttttgaattttccaaattttctttattaaaatttatgacctttagctgagggaaggaagcattcaaaataaaaaggcaaaaaagcaaaatagttaaaatgatttagagtcgaagtaagcaggggaaatatgaagctatagaagagaaaacaaagaagacaataaaaatatctgaagaatactgtcttaataattctgggactaggtgtggtggctcactcctacaataccagcactttgggaggcccagccaggaggattactcgatgagcccagagttcaaggctgtagtgagtgattattgtgccgctgcactccaggctgggtgacacaccaagacccagtctctaaaaacaaattctggaaaacagcttcatggctccaacataacattgaacaaagccaaagatgggaaaggaaaagggaatgtttttattttcattgtagcattgggtttttaaatgaaaactgatgtttcatatgctcttctatgactattcagtataggtgtttcaccatcattgtaaggagtatcttctgtgtatgtaagtatgtgttcactagtgcattcattttttcaacatgtgattaaacagtttgagagtcaccatatgccaggtactgtgcaagcaaatcaaaggtcacagtgtaaaatgagaaagggtatgttttggccctctattctagaattgtttatagaaagtgcataatttaagcccatatgtcccatgtcctaaagatacctgtccattaaatacagtgcatttcattgccttttcagactctcttcactatgcacataagtgacaatgtaattgcaatttgattaattcatataaactaagaaaggaggaattattcattcatttctgatttttttttttttggaaagtatcccattcctactatagtttgccaaaccctctcagggtagacctctatttacttaaaagaactagtttcatagattgctgtcatgcaccctaattagacaaacgtgttttccaggtctatttgaaggacattctgatataatgcatacctatcttcttaatcttcttattcagcttatgcatatttcttttcctttaaaatccatcaataaatgatctgtgatctgtaagtaattaatttaatgattacatgaattaaaataatgcacattgctttaaaggagttagtattttcggtttatgttacaatattggccttgggtaaatatcatccattgcctgaatttcataatggttcaaggataaaccatttcctctttataattcagtaagtttgttccaaaggagcctattgctcctctactcaacaatgaaagaaatgcattcagggaccttaggttgcctattcttaataagatggaatcctttcccggtttgttaaattcactgaatttataactcattgttactgatgaaggaattaatccaagcccgttaccagattgatctcctaaaatccacagagcgaatttggtgtcatttttaaaaagaaataaaataacaaaaataaaaatacaaaggatgtcagtaagttacagacaggagggcatacctcatatttatcacctggaaaactagagaaaagtttcatcaaaactgtttcatgcatctgtgcagggctaaagtcatctgctaatcagcactaataatgatggggataacaataataatctgctacctttacataacagtttttaccttgggaaaagattttcacatactactcttcatttagttcttataatgactttgagaaactaacataaatgttttacaagtcccattttgtgaaagagaaaattagagtacaaagaagagactgacccaacaataacatttaactggagctagactcctacttcaggtttttaaaatgctttcaaatcaatagaattcatgatttgcaatgttttcctaaattctgttaaaacacacttaggaccgtaaattttcaccaaccataacagacacctggtaagcgggcatgtaataaacaattgagatgttagaaaaaaagatatgtctctgatgagcagggcaaaagtgaatgtaagtcaaaagatatctaaagactctatagcttctggaataataaattggtagttttctttatttttcatttgttgtttcagaaagtgtttaacttttgatactaccaccaatgtaaaatataatagattgttagtaacaataaatcaatctctacgttgtccaaataggtgtgtttacccaggtccacactgttcaagttttattaaaactgtttcgttttatccaggtttccagtattgcatctcctaagacaaacactgatatttatctgctgatgcttgttttactaaccaaatattacattacacatggtttatcacattacccagggaggtgacaatatttcaggaaaaaaattaacaaatcaaaataactttgaaaactgtttataccccatgtacaaaagtactgtctatgcctagttattcactactatcacaagatatacataaatcagagtttttaaataatactgacttccccttataaattcctttaccccttgtgaaaggaacctagcaccattatgacacagttaagcattagtcacagtttaataaataatttcgttatagcctcctagtctatcagtattatttggattctcagaatgcatgtaatcatgtaaattacaaaatttcctttgtatcagggataaccaactgtcttttataaataatgttatttttggtgatttttcaatatcagaacagtatagttttggctagagaaattactataagcattcaaataaagattaatcaatttatacaaggcaaataaactttttgtactcttaaatacttaaagaataatatatacattcaaatatttgtaagaaattcatatagaggggagtataaaacacatatggaaaaggaggtatgtctgcagaagttactttgtaaagaaacatagtgctcaactaccaccctccctcaaatatcatgtcaatcaaattagcatcataagaagaactccagttctactgtgatagagtagcttatatcaaatcaccccctcgttgagaaaaactattaaagatgaataaaatgaaattattttaaaaactgtttgaaggcaccaggcaccaaccaaagtaatttcaatttaaaactcaatagtctataaaggaagtaaacacgttaaagtaagccctatgttgtttattacttttcaaattcaaggcatttgctgtttcctaagtagaacagaatgcgagactgagcacaaagctccagattagaacattaagaagtcttgtaaagagaggagggcacaaataacactttggagctgtcagcacagccaagacatgaagaatcaagatcctggataaactgtaaatgcaatgaggtgaggcctgtattctttttccacttttaacccctaaaacatttccagttcctctttcttggagtgagaaaatcaaaagagaaacaagcagaaaacagcaacctaaatactaggacattaaaaagaatattcagtagtcttataccaacgaagcaaaaactggagtttagtgactacttgaaaagcactccaaaattttatttgaacctctaaatgactatttataaaactaagggaaaaccataactagagtagccatcacaaagatggaaacccaacttcaaattgtcttaatccctgataagattaagtaaattacctttattctaataatctgtgaggagaaaattaaatccccatggaaaaatataataccatacaaaacactctaaatttttaatatgaaaaaatcatcaagcatgctaggaagtagaatcaaagaaccaaaacaaagagaaaaaataatagacaaaaacataaattcaaaaatgatacagattaaagaattatcagatatagtcttttaaaaacagtgataaatatggtttcagaggtaaaggaaaagagtgagaataatcagagaactgggatttatattaaaaacccaaagattattctagaactaaaaataaaacaaaattaataactcaatcgcagccagttagacacaacagaagatccaagttgtgaacttgaaaataggttaatagaaaatatccagaataaaacaaagagagaaataaggatgataataaaagaagaagcattagagatatatagaacatggttaaaaaatgttttaacatacaaatatctctagtcccagaaggaaagggtaaggagaataggcagaagcaaaattcaaagcaataatggccaagaattttccaaaattggcaaaagcatcaagccacaaattcaagaatgtctaagaaccccaagcaggataaacacaaagaaaccaactacaaaaaaaaaaaaaaagcctgtttgtaaaactatttaaaaataaacaataatcaaaaaggcaatctcaaaatagccagaaaaataaaaatgcattactttgtaaggattagtaagtctgataactgattgctcatgaaaaacaattgaagccagagaacaaagccatgatatctttaaaatgcttttaaaaagtaactaccaacctaagaaacccaaacaacagcaaaaaactaaataacctgattaaaaaatgagtaaaagatctgaacacacatttctcagaagaagacataaaaatggtcaacagatatatgaaaaaatgctcaacgttactaatcattaaggaaaagcaaattagaaccacaatgagatcacctcacacctgttagaaaggctaccttcaaaaagttaaaagacagtaagggttggcaagaatttggagaaaatgaaactctcatacactgttggtaggaatgcaaattgggtacagccattatgaaaaacaatatgaagattcttcaaaaactacaaatataactaccatatgatccagtaatttgacttcaggatatatatcctgaggaactgacgttagtatgttgaagagatatctgctctcccacattcatcgtagcattattcacgatagctaagatacggaagcaacctaagtggcatcagcataaaaacagataaagaaaatgtgttaaatacacacaacagaataatattcagccttagaaaataaagaaatcctgtcatttacaacaacatacgtggacctggaagatactatgttatgtgaaataaggcagacacagaaagacaaatactgcatgatctcacttaagtgtgaaatccaaaaaggccatagatacagggagtaaaatggtggttactagaggctgagtgttggatggtgatgaagaaaggggagatgttattcaaaaagcacaaagtttcagctagacaagaggaataagttttagagatatactgcacagcatgatcactataatttataagagtgtattatatattttgaaactgctgaaagtatactttaaatgttcttaccataaaaacacgataattatttgaggtgatggatgctaattagcttgatttattaattctacaatgtaaacatatactgaacatcacactgtatctcataaatatatataattgtcaatcaaaagtaaaataaaaataaagcaaaacatatatatacacaaaaaagtaaataccaacgtagaattctctaaccaatgaaagtattcttttaaaaagtcaaaataagaatattttcagaaaaacaaaactgcggaaatatttcaccgaaagattcatactataaagaatactaataggtatctttcaagtaaaaggaaaagcatctcagacaatgatagagaaatgcaaaaaataaagtacacagacaagattagtatgcgtataagtatagaaaaataataaaaataatgttttaggaattagagcacttgaagaattataattcaggacaatgataagacaaaaaatgagagagggacaaatataattattcattgaaaagagataaaaggtgtaagttacagtagagctcattagggtaaccactaagaaaaattaaaaatacgtaattagcaagttaaaagaggggcaaatgaaataacaaggttgattaataaaaaaagttaagacagaagaaatgggaaacataaaattggtagaaaaaatagaaaagtacagtaagatgatagaattaaatcaacaaatattagcaagtgcagttaatgtaaatttaaaaagttgcattgaaatacaatgtcagactttgaattaaaaatcaccattaataatatgctatttgcaggacacataccttaaaagtaagtatacagaaaatgtgaaaggaaaagtgctaaaaaaaatttaccaaacaccaacgaaaagaaggctaatatcactatacattataatatcagtctaagtagaatgaaaagaaatagtacaagaagagcattaaataatactagttaatctactaggaagatatcacagttccaaatttgtacaaaccaataacataagcttaaaatgtacaaattgaccaaactaaaaggtgaaataaacaaatacacaatcaagttagaaaattttgacatatttctctcagtaaatgatagaacttggtaaaaagttggtagataaataaaagttttgaacaccaagatttagcaaatttgatctaatttatatgtacagaatcctgcacccaatagcaacaaagtacacatatttgcaggtgcacatagagcatgcaccaaaagtatccttaaactgagtcatatagcaagcctcaataaattttcaaagtatttatatcatatagaatatcttctctgaccgtaattgaattaagctcaaaattaataacaaataagtattataaaatacatcaaatactttcaaataaagcaatagataaacttgataaaagtcaaaaattggggtcttttggtaaagaaagacaaatataagcagtagtcttctagaaacacaaatttcaaagatgaaaaaggacaaataaccttaacaggaatgaaaaaatggagtattgttacagatgctacagacatagtacaaagataataagatctggtgaacaagtttacatcaataaacttgaaaaaattgatgaaacatataaatcccctgaaaaacacatattaccaaaatggacacaagaagaaatggaaatccttcatagtactacgtcttttaaaagacatgaatatttgatttggaaaactcttctggacactggtctagagaaagaattcattaataagacaccaaaagcacaagaaaccaaaacaaaaacagacaaatggtacttaattaaactaaaaagcttctgcccagaaatagaaataatcaagagtgatcagatgacctgcagaatgggagaaaatatgtacaaactatcaatcagacagaggactaacatctagaacttacaaggaactcaaactaaataacaacgacaaaacaaataatcctatcaaaacgtgggcaaaagacatgaatagccatttttcaaaagaagacatacaaatggccaagaaacatataaaaaaaaaagctcaacatcactaatcaaagaaatgtaaattaaaatcacgatgagagatcatctcagactactcagaacagctattacttaaaaagaccaaaaacagcagatcttggcaagcaattgcagaaaaggaaacgcttatacactgttggtgggaatgtaaattactacaatcactatagaaaacaatatggagatttctcaaagaaccaaaaatagatctactatttaacccaacaatcccaccattgggtatatacccccaaaaagaaattattataccaaaaatatacttacactcatatgtttatcacagctctagtcacaatagcaaagatatggagccaacttaaatgtccatcaatggatgattggattaaaaatgtgaaatatatatgtaataggatactatccagctataaaaaagaatggaatcacatcttttgcagcaataagaatggaagtggaggccactattgtaagtgaaataactcagaaacagagacaaatgtcctatgttctcacttataagtgggagctacctaatgtgtacacattgacatagagggtggaatgataaacaatggagactgggaagggtgaggaggaagggggtggatatgagaaattatttaatgggtactatgtgtgttattcaggttatgaatacactgaaagctctgaattcaccactatgcaatatatctatgtaacaaaattacaattgtacaccataattttacacaaataaaagataaaataaaaaagtctttccacaaaactttctgactcaaatagtttcacaggtaaattatttcaaaaatttaatgaaaaaaaaatagcaccaatcatatacaactcttccaagggtagaaatagagggaatacatccgaactcattttatgagaataatataactatgcaaagaaaacctgacaagaacattaagagaaggtaaaattacaagctaatctctcttttgaatgcaaatagaaatatcttaaagaaaatattaagaaaatcaaattctctatgaaaaggataatataacatcaagtagggtttattctaagaatgcaagggtggattaacattcaaaaataaattaattaaataacaaaaatcctatgatctcaatagatccagaaatgtatgtgaatattccttatgatttaaaaaaaaaacaaaacagacaacacagaaacacacataaaacaacaacaccaactcagcaaactcacgaattgaagagaaattctctagtggatacaggaaatttacaattttcaaaaaagcaaaaaccaaacctagaacaaatgttatactagtggtcctagctagtgcacacaagtggtcctagctagtgcaacaagtcaaaaacacttataaattaaagttatatggaatgaaaaggtagaaataaaactgtagttattcacagaaaacatgactgtgttataaaaaattcaaaagaacccacaaagtctaatagaattaataagtaaatttagcaagattcctggccaaggtgaatctctctctctcctctctctttctgactctctctctctctctgtgtcatagatagatagatagatagatatgaattgttttcttatatagtaacaatacacatttagaaaataaaacttaaaatgataccaattacaagagcattaaaaaatctaattgtagaaatgaatctaacaaaaagtatgcaagtccactgtgcagaaaactataaaatattactgattaaagaagaataaaataagtatgaattataatgcatttatagattagatatcagtattcccaaaataccatctcaatcaaaatcccagcaaattacatattgtagagattaacaagcagattctaacatttttatggaaataaaaaggaacaagactaactaaaagaatctaaaagatgagcacagctaaaagatttacactaccagatattaagatttcttctaaatgttcactacttagtcatgcatcattgatgcaagggtaaataaatagattcctggaataagagtccagaaatatgtccatgaatatgtaggcagtacatttataataaagttattgctaacatactcagggaaagtatttttgacaaatggcacttgatcaattttttaaaaagaaaaaatgaatcctgtccatccttgcccccatctcacacctaacacaaaaaaatgaatttcaggtaaaatgcagacctacattttaatggcaaacaataaagattctagaagataacaaaggaaatgtctttatgacattaaggtaggcaaaagcttttccatttttttgtttttgttttaaacaggatagaaaatactaacactaaaagaagaaattgatcattgaagtgcattaaaataaaaaacttttgtaaccaaaagacaactataaggtcaggcgcggcggctcatgcctgtaatcccagcactttgggaggccaaggtggccagatcacctgaggtcgggagtttgagaccagcctggctaacatggtgaaaccccatctctactaaaaatacaaaaattaactgggcatggtggcataagcctgtaatcccagctacttgggaagctgaggcaggagaatcgcttgaactcaggaggcaaattttcagtgagccaagatcgcaccactgcactccagcctgggcgacagagtaagactctgtctcaaaaaagaaaaaaaagacaattataagagagtaaaaacataagcttcagaataaaagtagatatctgtaataagtatatctgacaaagaagtatatatcagaatataaaatgaaatcccagtaacttaataataaaaacagaaacaaacccaactggaaaatggacaatacctttcaacatgcacatcacaaaagaggatacccaagtggaaaataaacatatgaaaagacgcttaatttcactaatcattagagaaatgcaaaccaaagccatcatatcatgggctaccatgtcacacatgcctgaaaaactaaaatgaaaaaagaccaagtgttttcgacgagtagaacaataggatctctcttatacagtagtccccctttatccatggggaatacactccacctcccttagtgaatacctgaaactgcaaatagtacccaatcctacaaatactatgtttttttcctatacataaatacctatttaagatttaacgtatttatacctatttaagatttaatttatttaacattaatgtataaattaggaacagtatgagattaacaacatacttaatcataaaatagaacaattctagcactatactggttatatgaatgtggtctccctccctcctcttctctctctatttccctctcaaaacatctttttgtacttaagggtgagcccttcttgtgatgatatgagatgataaaatttgggctgcagctgactacggataactgaaactgtggaaaactgaaatcatgaatcaagtgggaggggcattactgtgctgctactgatcatgtaaattggtataataacattgaaaattatttggcactatctactaaagctgaacataagcacaccagcaatatcactcctcagcatatatccaataagaatgcttaaatatgtaaaacaagacatgtagtagaatatgcatgtggccaccacaattcataatggcttcaaactggaaataagccaaatgtccatctatagtagaagagctgaaaataataataatagaattgtgattatattaatacatggaaatattataaagcaataaaatagttttaaaatctgcaagcacatgtaaatgcaacataatataaatgaatctcagaaacataatgtgagcacaagaagccacatacagaagaatatataatcacatgattctatttctatatttttcaaaaataaactaatattagaagtcatgatagtggttatcctgaggaagtagagactggaaagatagataaagggatctttgtggtctgctaatgtttttttattggtctggtgctgcttacatgaatatgttcactttgtgaaaattcacttacctatatttttataatttctgaatttgtaactgttttcctgcactaaaatatttcatttaaaaattatctttaaaaacaattgcgaccataagaatttccattgcttttgtttttttttctctgttttcctgctacttagccttaaatatgggcatagtcacagaaatgtgcatatgaggtaaataaagccccagcttgctggctggaggacataaaggggagctccaggaaaactaaaaaatactaatgagagcacagagaaaaaggggctgcagaaagtgatcttatagggttacaaaattctgggctcatctttagctgtacatgcatggatctgatgttaatcagcatatgaatacaattaagaatgaaattaacagatagaccaatgtctacatccaagattgttcactggtatacacacaggacagacctgaaaagcaccgtaagcaaaactgatattgaaaccacagaaggaatcttgtatcttacaacctgaacctaaccaggtcaattgccttttaaaacaaaaatgtcaacattctccatagaatttcaatatgactcagaatctcataacatgatattaagaatatctaagaaataatcctaaatcaccaggcacaagaagaactaggaacatgtgaactcatatgagaaaacataatcaatggagataaaacctaaaatgacacagatgttggaattgtttgacaaaaactttaaatttactattctaaaaatgctgaaacaagcaatgagaaacaggcttaaaactcaaaaataaaattttaaaaaaatacaacaaaatatcactggatggtttccaacaaaataaagataatacagaaaacagtcaataaactttaagatagatcaactgaaattatgcaatatgagcaataaagaaaaaaagtggctcagaaacctgtgggacaataacaagaagtctagcattcatgtcattatattaacagaagcagagaagaaagagtgtgctatgtgttgaatgccccctccaaatctcatgtggaaatttaattgccattgtaacagtgttgagtatcaggacctttaagaggtaagtaagatagactaatgtcattaatgtgggagtttattagttatcacaggagtgagttgttgataaaaagaatagtttggcccagtgtcctctctgtcatgtgctttcttgccacatgatgccttccatcatgagatcacccttgttagatgctagcatcatgatcttagacttctcagcttttagaactgtgagccaaataaatatgtctgttctgtattaattatccaatttctggtattcttttatagcagcagaaaattgactaagattataattctgaaaaggtatttgacaaaatagtggctagaaaattctcaaattctgtgaaatacataaacccacagagtcaagaagtacagcaaaccccaaacagaaaaaaaaaaaatcaatctctggatacattaaaatagaactgctggaaattgaagacagggaaaactgtcttgaaagcatccagagaaaatcacacattatctgtagggaaacaccattcaaatgactgtggaattctcatcagaaaccatgaaaacctgaaggaaatggcaccccttttttaaaggtctgagagagcacagagaattctatatcctgtataaaagagacctgctctaaaacatttgctgaaaggaagctctccagacagaagacaaatgatacaacattgccactgatataaacactgaacattaggaatgaaggaagaggaaaaaaagtgataaacctatgagtaaatataagaaacgattattcttttgggttctttaaaacatgtttgacaatttaatgcaaaattacaacattatctgacggggcttccaatgtatgtagatataatatatgacaaaacaataatgcaaaactgggagagtaaaaggacttatatggttgtaagatttctacattctatttaaatgtctaaaatattgattctaagaagagtataaaaagatatgtatattgaacaactttagaacaacctctaaaaacaactatacaaagaaatatcgtcagaagaacaatagataaatttaaattgaatgctaaaaaatgttcaaataacccaaaacaaaacagaaaatgaaaaacaaaggaaaacagaagaaacaaacagaaaacaaaatataaaatgaaagacattaattcaaatgtaacaataattacattaaatgtaaatggcataaatataccaattaaagacagagattatcagaacggattttttttaatgacccaattatacactgttttcaacaaatttacttcaaatataatgaaaaaggtaggtttgaagaaaagtgtacgtgctgcaaactccaattataataaagctggaatggctatattaatattggacacagtagatctcaaagtgaagaaacctgccagtgatacaaaggacatcatataatgttgaagagttaattagccagtaatatataataagtctaaatctgtatgccctaacaacagagcttcaaaatacatgaagacataaaaactgacagaactgaaaggtgaaatggaaaaatctacaattatatttggagatatcaacacccttctctcagtaatagactaatatataattagtaaaaacagaactgaaaaaattagcttcataagagagagcatatgatcattcagaaacttaacagcatttaagagattatattccttaccaaatttttaggttaacatgagtaaggttttttgatatagccaactacagttttcgtaagagtaatggttacttcttcagagataagtcatatcagcagaggcagaaagctgagaatgggggaggtcaaatctttgtaagatgtaaactgaaaagaaagttttatagaaatgaatttctgctgatctcactgtgaaagtgcagttttcatacttttatgaaacaggcttgttactttgtttaaatatttgtgtaatccaaatagttttgacttcagttaagctgaatatttgctttaaatatttgtttttaaaccccatttatcaattctttagaatcttatataaaaggtacgtggtacttgcttaggaaaataatcaaaaatcagaaagtggcccttttaataatgtgaaatgattcaacaaacagaaaaccaatattttcttataaaatcagtaaggtggtaggtaggtagctataaaaatatttagatttttactacatattaatccttaaaagaaatcaggtaatgagtctgaaataagtttaatgtgtccttcttatttctattttagttacacacacacacatatacacacacactcttacagatagcaaaatatgctaaataggaagtaaacatggtactatggtatggattagtaagaaagtcctaccttagatagcattatctgagaaagtgttttttactttaagaaggattcgactaagcagtgtgagtttaagtgtcagggccagtgccagcatgcttcaatgagaacactgagaataagtgaaagttgaattgtcactggtttcttctaagctaagataaggtttggggcacctaaagtgcactcaactgcaaatactgttagaggccactcatcttccaagggaagtatcaggggaacataaaacttcattgagttctggctagaacaacatcttatgaagctaggtagattccatgtttctcttgctgataccaaggaacaaaggtaaacaaaggtgtcttcacttgcagctgccattgctgctgacaaagcttatctgcccacagagtggtgaatagtaattctaaaggaaacttcttgtctgccaagtagaactttgaagttctgtgtcatcccatgcaactaccccacaaagagcaggtgaatcctgaggtgaagggcactactgcccctatggtgccctgaaagttggagatcaagctttgagcccttcaccaactcaggataaaccagcacaattagacctcctataaatatgaaagaattctgataactccagctccagagattcttggacaagttactaaatggcagtagacagagacagcatagctgcaccttctgctgtatacctgaacactctagctaaaagtcagatatatctatccatgcactaagtggttgaggatcaatataaacaaaacacagttgcctgagttctgtttacagagcacatacgaaattgtctttttctctccacattgtttgcatcattcctaacccctgaattgaattcacttgttagctgcactgttgtgcaggtcttctgatcttgctttactgacttaatgacaaccactctctaaagactgacaaaaatcacactgtttcttttcacactgcccaactgaagtgggccaagttctcatcatcttagctctagtactcaaccttgaaatcatccacagagatgtcttccatgcaagatatttctcactgtaagggaagatgatggtaagtcatcatcttcaaatagaaatgatagctccaaagaggaaaaggaaaaacaactgccactccatcacctctctgactttggctttctagggaatcagttcttctgggtaaggttaaaccaacaaacaaacaaacaaaaaaatggaggtggggggtgtactttattctgttttgtttttaaagaaatggccacttttcatagatagagcaatataagtggaaaataaccaggaggttttagtgaaaatggaaaaggaaaaggcaaattttgtgacatactaggtctaacaattgtttaaatctaaagtttggtgccaaatagtgatggttttaattaatagatggatctgaaacacccatatatcatgctaaagatttagtattaaatatgttctactactgaaaataataccaaggtctctaacgacaagataaacacatgctatattgacaaaagtatgcaaaaaaatgctaatcaaactcagctcataggagcaggagctgaattgaatgatcttgttcccccaaaataaacttccaattcactactcaggttattttccaattgtcactgggacaacacaacaaaagcaggggacaaagttaaaacctggccttttcagtcaagcaagtggacaaatactcaagacaataacccacaaacaaggaagatgacagcggaaaatcccccacattcagttcacccctttgtgaccaaaccctgttctgcaggtcttctgatgacttagactttaagacagcaaggtagacatcctggaaataggccaataataatcttcaactaggaagacatactgaaatcactagggaagcttttttcaacataacctttccctccctcagctgggaatcatagattagatttaatttgtataatcacttcagtttgaagtaggtggatgacctgaagaaaattaaggtataatggcaggcttgccatcagcaagtacgcatttacaaacattttgacaagctatatctggaaatatcctgaggatccaagaatcttggttaactttatacaactacgataaattgggcactacaccaaaacatgcaggctatttgactctgcattttcctcaatcaacaacatgtaacggagaggcctaatataccaaatcattatcgaacagcttagggatgactcactttgacaggaagagcaaagtgtttcactctcatctcagtgaacctgttcatactgacataatgccacatggttcctaatacgcaacaatgtacactgttccagcaacatagaggcagctttgagcctttggatccaaattctgtgagtgagctgggctagagttttctgtttcccttccctcattatcatggcaacagagggcaaaggtggcagttaggctttatgcctggactgctggcatacaggtccacacctcttccaaaacaaaatttggacaatagttacacatgaaaatgttgtgttctgcttaggttataaggaaactaaatcatactgcaggcaactctttagttattttctcttttatcctatcttcaccagaaaatttaaagagctctaaaacagtgtttctcaaactgtaggtcacactgtcagtgctcttgaaattaagatagtgggctgtagactttaaaggaaagttaggataagataaaataggataagataaagtaggataggatgggatgggatgagatactagaggatagaatggaaaatgcaacacataggaagggtaaatactgtcttatgaaattttgttttaattatatgactgcatgtagactgtgtcatgatttaaatgcatttatctctgtggattattaggaaaatgtatgaaaaccactgccgtaaagaacatctatcttatggccctaacagcatttctctacagaaacactattggctttgtgactgggcaaatctcttttctaagtaatttcagctattcatggcaggatttaacatcatatctttcccctatccactgaattccagtagtgcttccttttcatcgtgacaaccacacattttaaatgctacctaggaggagttatcaccatctagagataaatatgaatccatagacaaaaggttgctagctcaactcatatctgatgagaagcaagtgtttctaagtatccttttgtatctagagtttgtcctccaggatgaatggaggtcagctttgatagctcttatctgggacgtgtacactgttccagctacttattctgcaaattaagtcttcctttcctagcacccatcaatctaatactaaattcattagcaaaatgaaatgaaaagaacacaacatacattgctattaatggaattccatgcatgtcactccccacacattgtactaaaaatgaactcatctccatttgagtgtctctacacaaatatctgtgtttattaatacacagcatttcagaagtgagattttccttaaagctgtaaagccatttgctttgtcaagctcccttttcagggaaaaacttcaggaattttcactatcaatttatgttgattatttactcttttgtggatctgctattctccaggcaaaatccaataaggagaaatcatgattactgtctaaagaatttattttgtaatattttttcttacttcctgtaacttactttgtgtgacagtaataaacagttcataatgctccatctactatcctcatccataaaatctagtaacagttcaacatttaaaaattttttaatgaagacaaaaatcagctggtgacttcctactggagcacaaaattaacacttgcactggagtgggtgagattttcttattcagagcagaatacagtctttttcttacggatttaaaaatcttagttacctttccctagcttgaaataataggcattttgggctgggcgcagtggctgatgtctgtaatcccagcactttgggaggccaaggcgagcagatcacttgaggtccggagtttgagaccagcctggccaacatggtgaaaccccatttctactaaaaatacaaaaaattagccagggtggtggcacacacctgtaatcctagttactcaggaggctgaggcaggagaatcacttgaaactaggaagcggaagaagttgccatgagccgagattgcaccactgcactccagcctggccaatagagtgagagtctgtctcagaaaaaaaaaaaaagaaagaaaaagaaagtaataataggcattttgaagacttcaggagaaatagctagaattcataaattacccagaagtgataacactgtacttagattttcacacataaattttcctattcctggatagtgtgggaccaaactatatataaccaagttttaaggtgaccaaaaattaaaattcacaaatactctgaatgtctcaactactttccttccagaaacccaagaaaaactgaagtgatttctcacttcccctaatgagcactaatgacaattagagatgaacagctaacctcaaacacactaaagagtgtttttaaaacagaataccacacaggttgtataaggcttatcttcaaacattttcctcaataaaatgttaataaacaaaaaaaattgacatgagggaaaagagaattggaatgaagaatatcctcctttacttttaaatgacaaaattaacaaacatgagagaaaacaccatttttaaaatgaaaagatcactcatatgagagaaggcagatcacatagtggaatgtctaaggggaaatccaggtggattgcccactggagtatacagttaaaaaatatccaaaggaagaaagaaaagacattagatatttggaaaggtaagtaactaagtaaataaataaataagaaaaatgatgacaaatttgcaagggacaccaacaccaaatgcggtttttgttttttgttgttttgtttgtatgccaaagagaatcagtcagctagtaacaagtaaggaaattcaaacagtagttgttctaggtcaaaaacaaaagatatatatgtacacacacaccacacacacacacatctatatttatatacatacacacacacacacacacacacacacacacacttggagactctcatgcctcaaatatattttgaagcatacaaatttagagagtctagatttaaaacagtggcaaatacaaaagtctttcttaattaaaaagctagctgcagataagtcactagcatcaaataggtaccaatcaaaagtaaaactgtgctcagaaaaactaacttgttcttaaaatggccattttcacaaagtactgaaagattggcaatgtggccaaattcccccaaaaaaggggtttagaagcagcctttgtaaccaaaggcaaacagtgggaatatgtataaaacaggaagatacacgaaaagcttttgcccacttggtgaattgagcctctctatctaggcttcttgtggcattaaagaagcatctgcaaatgcagtaactagaatatataatctattcagattttcaaaaggcttttgagaaagtttcatagcaataactgtgcaaataaattttgggtaaacatggaattagaaatacatattttcacaagcacaaaactatgttagatataggaagaaaatgtgaagtggaaatgatgagagaatgcttttataaattttgactgtggaattcaaagtgtcaactgcacatatttatatttcactatccttttcaaatagtaaaatatcaaaccacagcatcacggaatcctaaagagctgggatgactccctacgtactacagattaagaaactgagctacagaggattaataattgcccaaggttaaaacatatagacatcaggaagatttcataacgtttacaaacttgaacaaaaagtaccacatgagctcccctatggggatgtgttgagtattatatttcactagtgataaagaatacaaaactgttcacataaatgtggcctttaaaatatggtccctaaacaagaaccttaaaagaattataatacattccctgaaaacatttcaatgtgttctggttacaaagatattcaaaattctagacatcatcagaagtgctttggatccagtcttagggagatccaacatttaatagctatcagaaaaaaatgcctgcaaaggacatagtgaggatatcagaaaaaaatgcctgcaaaggacatagtgaggaaatgacaaggagcataggaagaaaatcaagaaagcatgacgccatgaaaaataagggaagaaagcattgcaataaggaaggagtggtcagcaagatcaaatgctcagtgaggtcccagtgagagttaatttggagaagtgatggaggtccctgcagcagacaaggtgaattgctgaatggattggtgaagaaatggaaatagagagtagaaacatttctttgaagaaatgtgagtgtccttctacaggtaaaaaaaaaaaaaatacatgataactggtcaatctctgaaagtgtgggtccagcggttttaagaggagattcagtattacccaccatactcgttttttttttttaaccataattcctagtcaaatatgtcataagcccaggaaaaggatctcaaaagaacttagaactatcctccttcaatacaaaaaataaaaggcatctggtttgcagtagggttgtagaccttgcaagacttctgcattttggtttaatcagagattttccagaagtctaaaaataattattcatctttgaaaaataagggtaccatacagctatctagctctgtaatccaaggaaaaatcaattatcttaaaagatgccttatgaggtcattgtttcacatgataaaacaagaacattaggaggacaagtctcggttggaagtctcagatcactctaattgttctaattgatgaatcttcttcaaggaaaaaagtgggctccatttctgtttttaaaaatccagagtatctgtagtagtgcaactaatgacaaccttcccgttgttcttgcctaagaggaaaccctataataagagcttcccaaaatgtcaaataatacttgtctcataacagggcttctttgttcattcaccatgtctcttttgatatgcacagataataaaagttcatataaaactaaaggtaatatagagcagaagccaacactaattctgtataaatatgtctgattaataagaatgctattgttatggttatttcataatgtcacgattgttacaagaacagaggatagaagtactcttactcttactgttttcgttcatcctctgtcatccaaccagtttgcaaatttctgttcaacgggaaaaatgaaggatagatttttgtccattaattactgctgttgcataagttagtctcataaattgtgaaatgagcattaaattcagggaaaaattaggggttttattttaaaattgaactccacttccactacaaaaatgaatacatgctccaggcttactttctaagctcccttttccacatgcacagttgctatattcttctggtgctcatgaacacatgaaagatagaatttagcatgatagcactaaaatctaggtaagagcctagtatattaaacctaaactgtggtttaatacaacaaccatacacaaaattgtatatgggatttggttccaaaaattagaaccccaccctggtgaagtaataagtaaccccacccagatgtgagtatctggtcccttactggaaaggaaataaaaacaagtaataagataacagtctacactcactgcagacagacagcccgatagattttgaaggaaattctaaggctggtagataagtttgtattgtcattattttgcttttctctttaaattcttatctcctagatcctggtattcccccttggggcagcagtataatataaaagcttaacagtcgatcttaaatttagctgacatttttatatccttcaaaacataccttttagattgcacccaagaaggagattattaaatagtagcaggagaccagttagtggaccattttgactgaacaaaaaacagcactgtgccttcttgttgacaaaccaaaaaacatttatatagtcattataatcaatttcataaataaaaggctattaatgactgagaaaaaaagggaaaaactgtatttctcccaagtcccttcatcctctcttaaactccatattagtttaagaaagtggaggaagctatgcatgaaaaatagtgtacttagttgagctggagtctcttgtgaaacaggttctgtcagtcagaaggcaagggtacatttctataattatttaagcctagtttttttgtagtaattagccagagctccattttgctgaagctggcatcactcacagctcacttttttttttcaatttagacttttcattcctttttataaaataaatttacatattttcagtctctcaatccctcctatgttttatttatgaatatagcccttcttgatggtaactctaatgtgaaagaggtagtaattaatgtcccaatctgctaggttaatccctttccacactctctatagagaagtttaaggtaagtaacagtttacagtcaatattaggtttaattatgcttaatgagagttggtgtctctgtttactaactgcatttaggtgtgtggatcctagatgaattttcccttggcctcattctgatttgttaatagtgccactgtgtactgtatactcagtgcttaaatctataaagctgcttctggagaacaaagcaagtaaggcacctgtttcagttgaaacattattaaacaaatgagtgaagttttaccgcaaccacatctttctttgggaaggtgctgttattttataatgctttccaaacaggtccatgtaaaaggctaattgctgcctaaattcaagatcctaggttaagtctatacatattaaaaaatgtttcaaactaagtacaataatcaatggtgagtattttaaaactatggagtattaaacacttctaagactttctgtattaatctttcaatgttttcattccaagtactataattgaaaactactttgacaagtagtttttttgccttgaaaatgtcttttgtcttaaaattatattcaactttgttgctgtgtataagacaaaacttttgtttccttactgaaactataaaaataagcatcaaaacaaacaccttggcctcaaggaaatcagatagtaagccgagggaaatttagtaaacaaatttttaaagaacccctttttcctatatttttgttatggataaattatgtatacaactgaccatgtagtttctttaagtccattcatagtctaatcaatttagtaaacatttattgagtaaatactttgagctaagcacaaaaatgaacatgacatactcccttctctcaagaagcttaccatctagaaaggagccaggcatgagttaaaaactttaataggctgggtgcagaggcttacacctgtaatctcagcactttgggaggccaaggtgggtggatcacctgaggtcgggagttcaaaaccagcctggtcaacatggtgaaaccccgtctctaccaaaaatacaaaaattagccaggtgtggtggagcacgcctgtaattccagctacttgggaacctgaggcatgagaaatgcttgaatccgggaggcagaagttgcaatgagccaagattgggccactgcactccagcctgggcaacagagtgcgagtctgtctcaaaaagcaaacaaacaaacaaaacccaaaaaacactatgctacaatatggtaaatcatactcatgcattaagaagacacagaaaagatcagttgatctgtagaggataaataaggcctctgctggtgaaatagcaagttttttctgggtcatgtgcagactatagcaggctaaatgaacagtaagagcaaaggcagaaagcatggcatccacagtgtatttaaaagacagcaaacagtgaagtgtgtgttgaaagaactatgtgcctgggtggaggaggcggggggtgatgggaagagatatgggagtttggaagttaggggctcaaagagtggactgagaccgaattaagaattttcaatgtcatcttgtgttagcttttatgtaatatgagggataggaaaaggtaaagagataacactactaaacaaggataaggtctgaataaattccttcaaattaaactgaattcttctaagcctactgatctttgaaaaacattttcaaatttcaaacctcccataatgttatttggaagcccttgcatttagatcaaagaatttgtgccatgtggaaaaaaattcctaaaatatgtctatctgaaagatgggatgataacatattaatggaagccagtagaaagagaagctgttaggtttataccccagggaatcctgagaaatctgcaaataattaaatgtactttgtgatataaaaatctgtttataattaatttcagaaattttctgccttttgaaaattctcccttagttaatatatcatgatgttgtttttgttttttaaattttaattggcaactaaaagttgtatatacttatgatatacaacatgctatttttaacgcatgccttactccacatatttttgtagtgagaagacttaaggtatactctcatagcaatttttaagtatagagtatatttttatttacacaatgtacaacatatctcttcaacttattcctcctgtctaagtgaaattttgtaccccttgaccagcagctccccagtctctcatcccagcctctggtaaccaacattatactctccgtttctatgagcttgacttttttagattccacatataagtgagatcatgcagcatttgtctttctgtacctggcttatttcacttaaaaatcctccaggtctatccatgttgtcacaaataacagcattttcttttttaaagatgacttacattgcatcatgtttatgtatattattatctattcctccattgatggtcacatgataacatccattctgacaggtgtgaggtggtactcactgtggttttaatttgcatttctccgatgattagtgatgttgagcattttttcatatacccattaaccatttgtatgtcttcttttgagatacgtctattcaggtcctttgcctatttttcagttgggttatttgttttcttactattgagttgtttgagttccttatatattttggatattaaccccttatcaggtgtacattttgaaaacatattcttccattccttaggttgtgtctttactgttaagtgtttgcttttagaaaaataaaaaaagaggcaaacatttccttaaaatccataaactaatgagttttaaaagaaaagaatgccatccaaactacctaatcagaaaaagactttctacagcttagatcctgtttttatagtattttagaaatgtctaaacacatggcctatgacaaatacttgcctctttttggaacatcaattacttctttgtaacggtatactgatttccttttaaggaataatctctttcccttccagtatagtattggtgagacggtaactccaggttcaaagataaacttggggaaattaggtagataaaaacagagaacatgcaaaaaaataaagaagcacacgaggtgaatgaagaaaaatgtagcaaatttatcagaaagatggaaattgtttaaaaaagttttaatattttctaaatatggtgaacatttctccaatttaaataatcatcagttatttaacactttctatgtgctaggtattcaattcatcaatttattaataatatctccaatcctaattataaccccaagagatagatgttattttttccattttattttatcggtgtgtaggcttaaacccagagaactaaagtaatttgcccaactgttagtgaatagttcagtcaagactgaatctcaaatccagtggaaaataaaatggtatgtccagtataggaagtacaaaacatacaggttaaataaacaaacgttcacatatacctatcaataaagaactccaaaattacatcagtctgttaaaaacaagccactcaaagctctagagttaactaaggtagtaacataattctgaaattaaaatgaaaatatttacataaagttaaatatttttttaaaaaatctttaaaaagtacactcaaacatactgggaaaacatttttcatgggaaacattttaggataatactatctattctataagaaaagagtcaccttcctgaagagttctttgctttcagtgctgttgcctaaattaactttctgttatgaaacacatcacgctagttttaacctagagaataatttgaacaaaaccaagttaaccatttctaaaatacttaaaatacaaagaggtggttgtgtaaccttgaagataattattcagatgtttttaagtattcatctctccatagtattttagatttaattttgtgaatttagcaacaaagaacacagtttagcacaaaatgagaaaacctgttcagaagtgaagaaatcatctaaatattaatagattttattaaatagcagcagaaaacgttatacttggtgttattttcagctatataaatatcttatttttatccaataaaaaacatactaaattcctccatttcaaatactgatgatatcagcaaagtgttcacacatctggatatctttctgtgtttacctaaactgacctttctggtatgtactgtactttctatctcagtatcttcagtgtacatttgcaaaaactacttgaacagtttacattctcccacaccatgctacttcaaatggtcttcaagactttcaaattactgtcagacactgggcattttgtaggcatatacttttgcattcctcctcaagggaaaaaaaaggggggaaagcctagattcaaatggtaataaagtctctttcaccctgataaatacatttaaaaagttgatctcggctggtcgcagtggctcacgcctgtaatctcaacactttgggaggccgaagcgggtggatcacccgaggtcaggagttcaagaccagcctggccaatgtggtgaaaccccatctctactaaaaatacaaaaattagccaggcgtggtggcgggcacctataatcccagctactcaggaggctgaggcacgagaattgcttgaacccaggaggcggaggttgcagtgagccaagatcaccccattgcactccaacctaggtgacacagcgagactctgtctcaaaaaaaaaaaaaagagttgatctcatcctgatgctagagttgtataaaagaagatcttagtgttaactcacaagctattatataaaaatatttgtatatatgtataccaatgtactatgcataaacacatttgaatatagcatgcgtatatatgcaatctatttagtatatttgaatgtatatattatatatagatacatatgcatttacatttccacatttattccaaaaacttagagagaaaatacttaaactgttttcaaaatacaaattctaaatgaaataaaatgttctttaaaaactgtaattaatggctgttatgtcaaactgtgaaccaaaaaggtcaaaccttataatttacagtttgagaggtcatacctcaaattataaccttaaaaaactgattatttgtgagtaatttgacaaatgcatctaatataaactgaatgcatatgaaatatttttgcgagtaaaaagaatgtatgtccaagtggacagctgatggaggaaatagccttttactgaacaaggctgaagtccaacataatgacttggaatgcctttgaataagcatgcaggttggaaggccaaacagtacacacatccaaaagggagcataatgaactatctgatcagaagacaaaaatactccacatatacacccaatgagaaaaaagaaaacacacttcggtcacctcctcttttttcatcattactataccccaattcacgaatgaactctgggctattgataaataatcatcaaaagaaatgatttttataatttaaaaatactagaaattcctataatattccaatctgagattttcaaatgtctatggagatcttctatatcatataaagtaagccaggtttacaaaactgtttacgactcatcttggatgcaaatattaccacacctagcttcatctcaaagccacctgctccttaaaacataatctgaaatactttggcctctccacaatttttaatctacaagtcatccaccattaagaaggcagatcattgaagataattttctccaccgtagactcaattccctaacccaagctagaattgagaaggttagcaaaatagtcatttattaatatatctatgtctctaatatttatttatgtgcttattatatctccctgttagactataagctcaacaaggataaagactaagtctcttttgttcaacagttatctataacatctacaaagtttctggcacagagctagcattccataaatattcgctagaaaatggaaagaaggggttgacagaagaaaggagggaggattgagttagctagtctcctctagtattatttgtgcaattgtggagagaaaaatccctaaaaatgtacactgtatttaatcaatttacccatccaacaattcactgatacatcgatccttgaaaccaaaaagatttaaaatggcttccaaaagtacacaattatacaataaaataaattaaaacagatgaaaaatgaaagggatacaaaatatagttgggaacaggatatttctatacgtatactggtaaagtcagttaaatcacaggaaagagaaggaatttgctttttaatttctccaatttaaccttattgtaactactattataatagtgttataaacactaagcaaatatttactcgttccttatctaaccattactatggcaaatactctataaccaggtaccttatattatgagccaggcaatctattggatgagacaaatattcagttataagaaagtataatatgtatgttataacagtaaaattatagatttttgtaggagagaaaagtaggattctctgaaccaacaaaaatgcttacatggtaactgctgaactatgaacccaatacttcatgtaccaagagatttttctgatacatgtaaatatgcatagttcttgatacacagggaaatatgtggtctcaaatgttaccagtacaaatgagacttgcacatgtaaatcacaatatgataagaaaacacatttgaaaagcattatctttcttgtaagtgaaagcttaaatctgattccacttagcctggtaagtgtttttgtcattccgttgggccagcccacacatactgggctcttgataggtcctgggctcaaccagctggccctttgtgtacttaattctttttttaatactgacgagtgtattagtaacacttccttgatcactggtaaatatacagctaccacacaactaagattttccttaattctgaaattcactaattagttgtgggtacgggttagtattacaaaggtatgttgagtggtactacaatgagtaatgtaattcccaaaaagaactgtgttaatttacttcccacttcattagaggaataaaaaacatcttattatcactaaaggatacagaaagagacctgggtattttagggaatggtagacagggagaaagcatgaatgcagcattgaggcaagaaacacaaatcacctatacatcttggacaatgttcgtgcttcttcttaatactttctgcttgcttcatttattagtgtgtttcatgaaaacattttattcaattaataaacaggtttccaaagaaagcaaataaggtaaatgattcctattttcaaaaacttatcattctactggtacgtaagttatgcattagtcaactctggaagctgcattaatcttttcaagccaataaggtcacaatcaattacttgagatagcagaataaaatacaggcttaaaagaaataatgcagccgggggcggtggctcacgcctgtaatcccagcactttgggaggccgaggcgggcagatcacgaggtcagcagatcgagaccatcctggctaacgcggtgaaacctcgtgtctactaaaaatacaaaaaattagccaggcatggtagtgggcgcctgtagtcccagctacttgggaggctaaggcaggagaatagcaagaacccgggaggtggagcttgcagtgagcccagatcatgccactgcactccagcctgggcaacagagcgagactccgtcaaaaaaaaaaaaaagataatgcaatttccaaaggtgctaccaagtcatttagagagaacatatggtacaattatgagtatcaaaactgggaatttatatattttaagcctaccataaaacatatttactttttttcttttgttggatgagagatattctaacgctgtttattttttcggaagattcagattattcaaagtgtatcagctgattgttatgtgtgttaattcaagcactgagtttaaataatcataactcaactccctaaaactgaagattctgtgtaaggttgggccagtgccctcattcctaggatcaaaccatgtaagaccagacaaaggtctcagagattttggggggttccagtctttctcctttgtccatagacgtgttagggaaaggatgacattttcttatagtacttaccccaaataactaaaatctcaacaaaaaatagataaaagtgcggattgtaaaataggtgttaataattccttaatcaaatcttgtaactaatgaaaaaacactagtttatatgcagaagtaaactgacgaaaggatgaacagaataaacaaggaggaaaagacacatttttaaatatgtaatttagaaactgtcaaaaaaagtgggacatgtcttatttaactggtgtatgagaagaatggatggttttacaggcacataaatgcaggtacagaaaggtaataggagctttgtattacaatggaacttaaactcctctgggcagtgatcagctaagatggaacagagacagttacaatgcaatgattaactagtggacaaagctattatttatggcaggtatgtaagcaattggggcagcaatgttggaggcccctcctcatcaagcagctttgccagtacagactggatgcctggaaccaggaaagacacaaaaacaataaaacctagagccagctaagggagattcaatgcaatccatctccaaattttaaatattactggaaatctacactgaagaatgttttcccttgggattggcatacactgtggttatagaatgttgaccaacacttacctttatttatctcactatgcagagcaatatgcctaaaatacctacttagaaattctcattatattacagaaaaaggagattctaacattagttggcaaaaatttttgttgataggcatgaacatcatgtcattacatgaacagatcattaaagtgagtccatttcattgacagtatatattgtgggtctttttattctgaacaaccaaacaaaacaaacacacaagaggtcattgtgccttccctcatttggttggcagctttatctgtaaaatatgaaaataaaaaactaacatggactacaatcctgcatgtaccattggtacctgcatagtaccatttctgcataagatttaatcaaatattttattcatgttctgaaatcctgatatttgtgaagatggaaaaatacacgggatatttttaactttcaacttcatgatctccagtaaaagtagaaaaataatcatatttcatattatttggttttttgagctagccaaaaaattattagtatacaagaaaaaaggaagttaccactcttcacttgtcttcaggtcttttaatgtaatctcaggaaaaaaacatatttaacaaaaatggaaattatcatgttaaaatctattccactttgaaaagcgatattctttctccctctcagataattttaaatataaacctgaaatgttcataaccaaataaatcgtctagcagataaccaatcaccaaacattaattttacacaatgaggtttctttaatttctctctgtctctctcacagacacacacacacacacacattcacacagacaggttgctaacttgattcttagtatggtaacttaaactcataaccactccaaaatatactttaccttgattttgtgaataaaaataaataatcttatggggcaaggcagggataaaaattagaagtatatttctaactttaatagctaataataaaaagaacagcagaaattactgaaaattatattgctaaaatgtatctgtacatgtggctgtgaaaacttacgtgcaaagagaattctcgttaactaccttcagaaagaggtaatgaaatatgaggtttaagagtacatctttagtacttctgtaccttaaaatattgccgagtattaatttttcatcaagttgtcattttctctgacatttggttttattaatcaaggcatttatcattaatttgtagaaaatatcgtaattaagccaaataaaataaaatccttaaaaggttaaaattagaaagcaggtgaattagaactttgacattaccctgttgacatacaggagctttctggaagtatgagaatgaagtttttttcagtgagtttggtgcctcgatcttggggctggctggtttttaaaaaatgttataaagatttgatttaaacctctctgacagttttgacattcaggtgaaagtactgctgctgcatttggaacaatttgcatatcccactgctaaacggaatgtttgaggtgtgcactggtgtaaagaaattaaaaacaagctatcacacatgcttaagtgtatgtattcacaaaactgatggttggatcgcaccaccccatccccctccaatgtaatctgtgatttactcttctataataaattaccctaccatgttagtctcactggaaaatctaaccatgcatgtaagaagaaaagtaattacagccccctcttgtctaagaagcctccttcaatccctgtgagctctttatacacaatgcagccacacgagtctattgtaaacttcttgcctgaaattctggacttctgactatcagtagccactaaatctcatctgaagagtttcaatgtccccaacaaatacaattttatttcttatagttaattgtaaagctcttcctcaggagaaattgttactgacattctgactttaagccaatatgtctgtttaacaaaagaacacagtttaaaatcatgagttccaaaccagttaaaaaaaaaaaaaaaaaggaggacagagggacataatacataatgaaatagaaggaacaagagttagagcaacacctaattaagctgaaatattcagaaagagtataaaatttctactttttaacttacaatttcatattatttttaggtatacatagaaaaagatatttaatgtgtttaaggacaataaaagaaaaataataaaataaaagaaaagttgaggtagcaaatccaagaccttaaatattataagacaattcaagaagataaagcccattcaggaaaataccactggacattaccttcagccttcagagtcccaaaggcaattcttaacacttctttttatttgtctgtaaaaaaaggaatacttaaaattagaaatctgccaaggaaaacatttgcatttctataatatctttatgacccaggtagctgagtttgtgtatgccaactaatatctatagttttaaaaagaaaactgaaagctaacacattcatatgtgtacaagtactcagtaaaacgtggcccaaatatacaatctaaaccactgcatatacatttttgaggaggcatagcacggtgtttgctatagtatcataagaagttatcttaactcataaggatatttgcatttttatttcatgttttcttttaagaaaagcaaatcccaaattgcttttaacctatttacttgctcattcttattaacagagagttcgcaaagttctatgatgtataatgtactggtcatcactggtgagtttaaaagtatgcaaagataaaacacaagccctattctcaaaatagtaggtaaggttagagatatttgcataaactcagataaaccaaagaaaataaaaagaaaatgggtggaaagaaataaagatgcaaagggtaacatgttcagtacagcttagtacctaaggcattgacattaaaacatggcttaatatttcctgttttagcagaaaggctaatagtagggtcctacccatatttagatgcaaggatgccaaacaaatggatgggttgcttttaaatttctttagtaaagaattgaagctggatgggaacaggcaggatgttgagtttactttaaagccaatttggtgattttgactatagaaagatttaactaaaaacagctctcctattaaaaattgaatttgatgttgtgttcccattagaaaatgatctctctaaatttgctatgaaatctcaatgatgaccttgatgccacatttactaataatctccacagagatttaggcattcaaagtttcaaaagcagttttaataatggaaatgcaatacctaaacatatgcttgattatataatctagtacatctacagtaaaatgcccattaaaattttaaaaatctgaggattttaattgactatatcattaatatgcatgcacagtatttttgcaaacaacaaaccacactagtaaaccaaaacaaacctaaggattggttgcactaatagacaaatagggtccagaaaaggaatctgacactcctgttatatttggggtgcatcagcattattacagttattctgcatcagcaaactaggagggatgctaaaagttagtaactgctaggaggagtgagaccagaacaattaatgatgaagaaataggatgattaggaacagaaaagaaaaaatgttctgatcatagagataaagtggaggacacctttgagaaaattaatttggtaactacatgatatattacaaaagttacttttattaatttattacctgtctcttcctctagaatggaagtaacataagggcaggcactttctctttttcactgtaaccccattttcttgaatagtgcctgccatatactaggatatcaatgaatatgtactcagtgaatgaatgaacagcctaaccaataaaacaggcactaaatctgtatctatttacagatgagaaatttaggcttaaagaaattaaatcatgtacaccaaattaaattgtcattctgcaactacaaacttctacaatgcattctttattcttccattcaatattcattctagcaacaggagaaacagacaataaacaaataaactgttagacttataatgtcatataattagtactatgaagtcagataaaacaagataatgacactgagagttacctggcctgatattttagatagatttggacagggaaacttctcaaaggacgtaagaataataagaaacctgaatcaagtaaagaagacagtcaaaacaaaaaaatctgaaggactggctgggtgaggtggctcacacctgtaatcccagcagttcgggaggccgaggcaggcggatcacctgaggtcagaagttcaagaccagcctgctcaacatggcgaaaccccatctctactaaaatacaaaaaattagccgggcgtggtggcgggcacctgtaatcccagctactcaggaggctgaagcaggagaattgcttgatcctaagaggtggaggttgcagtgagccaagatcgcgccactgcccttcagcctgggtgataagagcaaaactccgcctcaaaaaaaaaaaaaaatctgaaggaccgtttgaattgttttaggattaaataatacatatttccttgcctagtataatggccagcatataccaaacagtgtactcaatactttttattatattgctaatatttttataaattatgtttccccactagattacattgtcaaaggcatttactgttattttccttaaggttccttaaatagtgcctagcaagagctcaataaacacttagagaacaaaaatagaaagacacaattttcagttcattaattagaaaataaacagactacatgaatatgaaaaagtcaccatctttcgtatacctgaatcaatcaaactctgttaaatcaatttcacataatatttcacctttcctaaattaaaaaaaaaagaaaaaggggaaaatatattaaatggctagggccaagaagtcatagataacaaaagaataagaaagaatcagaagaaaattaagttattaacatgaggccactctctttactatttacatgctgtctgactccatcagattaacacatttttccagtgaagggacattgctacacagatatctgattcatttatgtattcctaatgcaagcacaagccttgctatgtaacaaataatcaaaaaaatctttgttgtcctgaaatgaactaaaatgatgtttagtagttttgatgctttaaagctagctcaaaacaataacaacaaaccaggggactgacaaacttaaaaaacaaatttaaatgagaaaacatcaagcattaggtttgagtcctatagcaaagaagcagagaacaaggtaggttctttccaaagagttaaatataagtgacagtgtgatattggcattggaagagatagatcagtagaagaggccaggggaacttaggtatggggtaaatgttacaagtaacatttccatgaacaatgttgagatagctgactgattacctgtggcaaaataaattctgttctctaattcttatcagtactaaaatataaatcaggtcaataaaactcaatataatatataaaacaatcaaggacctctaagaaaatacatatgtataattttctgaactccaatgtgggaaggacttttaaagtacatacacagtggtatataatataagcataaagatttatgatgtttactacttaaaattaaaaattttagcctgggcaacatggtgaaaccctgtctccacaaaaaatacaaaaattagttggacatggtggtgcacaactgtagtcccagctactcaggaggctgaggtgggaggatcacctgagcctggagaggtcaaggctacagtgaaccatgatcctgccactgtactccagtatgggcaagagaacaagacccagtctcaaaaaaaaaaaaaaaaaaagtgtaaggcagaaaacatctttaacaaaattcaaacttaagaggccaataaaaaataaatatttttaaagtgtataatgttcattgggttaagagtctttataaataaataaacatattattctactttttaaaatgagcaaaatacatgaataggcaattcacaatagaattgtgagttctcttctaaaatatggaatgcatttataaatatatttaaacatatataaaatatattttaaactatatataaaatagtaatacttattactatttattattaaataatattattaattctaatacctataagtaataaggtgaaataagaagctaaaatacatatgaaataatattaatctgcaatagcaatgaaagaaatgcaaattaaataaactaaaatattttagaatagtgaactggttagataaattatatgtaataggatattaagtgttcattagacatggcaagtgaaaatatataatacatcattaagcttagaaaacaggttataaaatggtaataatgataacataccataccaatatttaataatttttctctatataatataaatacagactatgcacaacttttggttatgtgcatatgtaagtatagatctgtatgtaccaggtgtgtgtgtgtgtgtgtgcttgtgtgtgcattagaaaaagtatgtatgtgactgtaaaaaacttaaactacattattctttgaatttatcttaagattatgacagtttttttcttcttagaatttgtttccaaattttctgtaataaaaacaaattactttttataaacataaaaagcactaaagaaggcacctagtttatgtttcaggaaagaaaaatttaatttatattattagaattcctgaatgttaagaaagacatttgaaaatgtctatctgtcatttttggtgaaacctttttaactgcatagatttttttagagaaaaaaaaatgtaaggaaggaaaggagaaagggcaggtatcgtgaggaagggaagagaacaacaaagaaagaaaaataggatttataaagataacagcaactactcagaatggtatctattaggttcctagcaaccaaattttaactggtaacatctccaattaaactttcaaagaaaagcacagcctggaatgtagaaaacttaagttggaggttacatttatactgtgaacatacttttacaagagaaaatagatgaaatgttcatcgatttcaatgataggactactgtataaagagagacaaaatacaccatgagaacataagatgctccaaatcagttttggaaataggagtagtataaatttcaattaagtaaaagtttaaagtaagcaaattttaagtagctataaaatcatgctgttcattcccatataagaaattttcaatccatagtccttaacatgtcattcaaaacatatgaccctacaacatatgaactatgacttctggttaattgtttcaatggacattattttgtataaggccttcccaatgagtacaaaatgaatagaaactgttaaagaccattatctattaataattatagcaaacaagtcttcattaaataaaaatttaaacataaggtttaattgtattttattttaaaaggcaaatgaaagccaattgatcatcctgaaagatcataaagaacctgtacagttccatcgtcaagaagacaaggatacattccttcaaagactggaaaagctttaatttcagttcatccataatcatgcatcctaaggtggaggtattcattttggatttggatatattattagagtttttaaaacaccagggaaatctggtaagttctatggtatattctcaaagaacatttcataagattggtctggctaaaccccatactaaagccatctgaaataaagtcaaattccatggagctggagctcgagagcaacaacaaaagaccattcactgactcagttatacttgctcttaggtatttcaggttcgcttctaaatagggggaaaaagtacagaaagattaggtactaaatactgtttttaactctaaaatacaatcaatttttttctttacttgtctgtttaaaagtaacccgagcccttccttttattatgtgaagcttcattctgtttatttttatttcccaagagcagaatgccttaaataaattcttaaaaaccaacacatcaacaaataaataaattaaaactcagtgactataaaaagtacacaatctaacctgcttaattattaacaggtaaacacaatgaacttctaaattatttacttaatccccttcaactaaaaactttaaagtttttgggcttgaaatgtatatcctttctaagggtccataaaacaattatttaaaaatctatttagccattttagtaaaagcaattttaaaataccaaggtaaatatgcacttaaacatttacataagttcataaaaaatagaagactttttttaaatttcacaggtcagtaaaattatttttcttccagctttccctagtcttctgtcagatatttcactccaccatgagcagaaatattcagtactaaattatattagattgatataatagttttgaagtaagcatttatagaatactcttattcctgagtataccataagaaatgtataattatgaaactataaaaatattaataattttgaaacttcaagaaaaaaagaatgaataaattaaaaaatcaccattttctccagataagactggactattttcaccagcgtagctaatcactgaagaaagattgctgcttgatgcaagtaaccattgattacctgaaatgttggttagttaaatgttctggttagctaagggttctagggggaaaggtgtttttgtttttagatcattttaactaaaaatataagatgttctactagatttctctgctttagtaaatagggaattataattttatctttcacttaaaatgaaaaaattatgttgccttagaggatggctcttgaacttttgggaagtcagaagggcctctgggacgatgaaaaaaaaccaagaatcttttttctctagaaaagtgcatatgatcacgaaattttgtatgaaatttccagggatccagagacccaataaaaaccccttgctttctaattttacagaattctaaataactagacataggagattgcactcatacagtaacccccaggacaaaaggagaatgtttgaagttccttcagaagacaggcctaataatgagctattttgttatgatttgtaacctttcttctaaaaggggtgtgtaaaaacaattcttgttaatttagtcttggttaaaggttaaatatgtttcctttaaggacaattgcattacaaggtatttgagctttgaaacaaaatagtgctgctttaaaatcattccacattttagaagtgacagcaattttcttcctatatttttgtaacaatagaaggcagagtcaaagagaaatctatttaattttcatctttacttctaaagattaacagataatagcaaatacatgagcagtccccatattcaggttctgttcaaagcgcttttatttgtatttacttatttaaacctaacaaaaactctaggaggtaggtaatatcatcatacccactttatcaatgtgtaaactaaggaacagagggagtaagtaatttgccaaaggacacccttttactgagcggcagaaccaggatttatgcccccgtcaatctggttgcagagttcggattcctacagaccatgttccatttccagctttaatctttcatgagttcttcaatctttcatgagttgatggtttttcttgtgtgttattatatttaacacaagtctacttcttcactaccatgcaaggaactttcatactggttttcccagaaaaattcatttggtgaattgttcataagatgctgacaaaactggccccacctttgtgcagctggcagttttataccatagtaaatttcccagagtcaatgccaaaaattaaaaaactaaggtaccaccagctagtaagtgtggaattatacaatcaaagctgacctctcatttcctttttggaaatagttttcatgggataaatatgtgaatgattatattccaaaggcaaccaagacaacagtataaatgggcaatattatcataataacttctcaaaggcaggattgtctgctattcctaattcatctgatgagaggtacaccagtcgatacaacttttaatttctagtcctaaatcatttctatgaaataacatgtcaaagtaaaatgcatacttaatgagggccagcaaggggccaaatttgcagtatgactattttcttgaaatatcctcttggcagattgctaccaaagacagcaaccaatttgtaatgcaggatttgcttttagtgtaccaatctttacacattgagtaattccatgaagagaaaaggctgacttaaaaaataaataaaataaataaatcccatccttatggtttgcacagaacaggttttagttataaattcattccatttaatttttattgaattactccctaaaataaatgcaaacaggcaggtaccagtgagacacaagtataaaagggcacaataaagcagaatgttcaaagtcctgtgggtacatgtgcacaacacgcagtttagttacatatgtatacatgtgccttgttagtgtgctgcacccagtaactcgtcattttttaaaaatctttgtccttttctcaaatcctccctccaaagtccaaagtttttttttacattagacctatagacttttatgaagaaattcatttcaatgcagccaagctaggctgggaatgagaacctggtttaatataaaagtatgcctggaataaaatatcatcctttgcctctatctatctctatatcatcctacacaccataataaaacaaatatttggaaataatctagttatttcctataataattcctaatgatttacagtatcaagtcctatatacttggttttcaaattcctccataatctagttccattatatatcctaattccaaataatgcagaaattatactgtctcacccaatgaaataagattttaaataaatatacattgtttcagcaaacaattattgggtttacaatgtgtcatgcaatgttcatgtagctgaaatattttcacatatatatcaggcttttcctatgccctcaacatgtccttcacgatgtccttcctatatagttcagcatgaggtattcgtctctactctgtcaatttctgttaaattcatagtgaactcaaattaattttaactcgagaaatgccagttagagaaattaaagcatgatatataattacaccgaggaaccagatttagaaccggagaagcattgtttctcaaggccgttcttgtcttcatatttcatggtcaaaggtcaatgttgaaaaagctgatgaaagctaatagtaaaactctcaagtctgtacccaagcaaagcacctgatcagtatctgatccaagcaagtcaaaaaaggaaagaagtttgtgtgtaacttttggcttcagactgatatgaaaggcttcatcctttcaattaaggcatagacttttgcctatctgtgatataaaatatattaacagctatagactaggaatttttacatttaagccaaaatacagccaacagagtttaaattttaagtaatttgttaaactaaattaactgaattttcaattataggttttaaatgcttagaaattttccatacgtttgttatagacctcttgttattttctagtttcaaaaatgtgtctttgcataaactcacggttttcaggtttttcacaactgcttcaataagcattacagtaatgctttttaaaacgaaacgatttcctttgctatattattgcccagttgacgttcttatccaaagccagttttgctctctgaatttacttttttctttcttctccccaaaggtgtattgatatgatacacactccttccatttcctggtttaatttgaacatgtcatcctcccacatcataatccagtccatctaccaacaacttatttttcttctgtgagactggcattgatgatggagatcacagggtttaggatgtctcttttcagttattgagcctggcccattcccagtcctaatctttttcttgttaaaaatcaattatacatatatatatttttattatactttaagttttagggtacatgtgcacaatgcgcagtttagttacatatgtatacatgtgccttgttggtgtgctggacccagtaactagtcattttttaaaaatctttgtccttttctcaaatcctccctccaacaacaggagacagctttctttaaatgtccctgctccgtcaccattttctgtgaacaagtctctgctccatcaggatgcacaacaactacccagacccatgtagtgacattccaaataagcttctctttggtcttggagccaaagaaccaagtcctaattcccaatttctcccaaactttcactatctcagtgtattctctcttctcactcttatttctatcaagacacctatgaatggccttctctttcattgaacaacagttgattcagatacaatcaattcaataactctcattttagatcagaaacatacatttatgtttagaaaagactaatcaattgagtacctaagaaaacaaacaaggagctaatttaatgtcctgttcccaagagcactctcacacagacacagaaacaaacatacactcacacatccctacacaccaactgttttactaaaatccagccacactaccttttttgtcttccttcatcaggccatgcttgtttggggcttttgaacacgcttttctacaaggctcttctcccagatcatttcatgatggcttccccttctcatcattcagtcctcaactcaaatggcacgtggttactctttatcccactatccaccctatctgacccaagtcacttttgatcccactgcccagatttcttttcttcacaggatatcactatctgcaactattttacttatttataaactgactcattgtcgattttcctacattaaggaggctatctgtcttattctctgccaaatcacttgcccctaggtgtcatgcctggcacatagtaagcactgatagatctgagtaacgaataaatgaatttacagaaatcgttagccataaatagttttcaagtgcttacaatgtgcaaggtagttcttttttcagttgaatcctaggatgaaaaatgctctgtctctcagcattaatggggcacagtaagtccatttaagagataggtccaagatcaagtggatgaagcttattttgaaaaagttctaaacaaaatatattcctaccacattagacctaaaatgtattaatacataagattaacaacattgttcttctcagctattgtttccttcacacttccccattaaacttttgatatgtcattatgtccttttatgatgtcaaaaacaattgaatggaactgaatgaaagtagttacaacgacacatacccaatttgggacctttactgccaaaatagatgggtcaaaatgatgaaacatggtaagattcggggtgagaccaaaccctgaatctttacatgttcactccctcccacattcatacaatgtacaaatatcctgactatacctagccttgacaagcgttctaatgcctctacaggtgaaaacatccattcatttaaaccaggacctttatctataaagtgccaaataataaatattttagcctttgcaggtcataaagtttctgtttcaactactcaattctgctactatagtctgaaagcagccataagcaataaacatataaacaaatgaccatggctgtactccaataaaactttgtttacagaagggggtgggatgcatttggcaaaccctgatctaacccatcagtgaagcctccaaagtttatatatggggagatttagaaagaaaatttgatcagaaagtgtgttaggaggacttgtgttagaatctgcttttctgtgatacacattttgcttttatatgaaatatatgtgtatgggggggttggaaaagattacgggaaaactgaacccctcaggtcactcttatcactgccgcctaatcctgcaatccatttgagggtgttcttggcattacattttggccttctatagattcatcagctttctctgcatattttatccatcagattatttatatcgtaattctacaattatttttgaaaagctacaacaaacactcggttgaagttcaaaatatacattccccttaaccatgctaattctgcattctatttcaaacattattaattttgtcaggcaagatttgtttataataaactcatttttttcatcgctcatgattcctttgtcttcaagatgtttactgatttctcttacaatgttttatgagaatgttgtcagataccctgtaagccattcaacattacatttacatctattataacaattctttctccctcaaaatcttttaggtcttccaaatttcccaattggaatatacctttatccaaagtataataaatacacctttacctgtttctggttgatagctactttcaaaaggtattttaaacgcattatatgtttttcaaaattgtgttttaacaccaaaacagccacacaattaaactaaaatttagtaaagattctaaatgataacacactgtcataagatacattacatattaattagcaatgttatcattttctattctccatcttatagtttctgtaataaatcctactgccaatcagctttcattatcagcccgtctaatcatgataaccaataaattgtactctatgcttctgacatccaattctgctttatctattctagctatagtgtcaaaatatttttgtagcttcaactagggtttgacaaaaatgctaaaactataaaatctaaatgtaaagtttaccattaaattatatcagcatgtcatacaaccatgatttttaaaataaaatgagaaaatacataaagtaagattttagataacatgataaagtctgcttcagtttgattcagtattcaataaataaaaccacttgagaatcccagtaaaagtaaaccttgagatggttgaaatatccattttaaataacgggaacttttaggtaattgtctctatgaaacaagaatcaggcttttgaggtcataaaatgcttgaccttcccaggtacaatgaatgcagaaagcttactactaagttacacaataggggtaagactgttgaatctatctgaaaaattacattttcaaaagctccacaaagtaactgattcattaaagaaataattggaaagattctttctctttcctcatatgaaggagaaatcacaaaacgttgcaatattttcaaaagaggatgaagtgctcacatttcacttgtgaggtttcaatagctttattacctatgctcttgctgtttgttcagcatgctgaagaaaagtatttccaaaataacataggtttgctaatccttggttcctgataatatcacatgataggataggagctttcaaacacagtcaagctgacagtcacttgctctgtactcagagggaccaatttctccctgtagacatgaatacagcacaaataataaagtgccaaaagttgagtgtaagtgcaaacccttcaacatcactcaggtatcagcaaaaagtacctgtttagctacatgtagaagtcaggtacaacatgttgaaagggagggaagattagaattgaaataatttatctgcctctgctagtttatctgcatcactgaaaagaattaaaccaaccttgccaaaggtaagtcttgtctaggtacaaactgtcttatcaatgccatctcatctattccctatcgtcttctttttttttctttttttgaaagaaactttttatttattgtttttttcacattgcaagtgatggtatccagtttctttttttttttttttttaattatgctttaagttctagggtacatgtgcacaatgtgcaggtttgctacatatgtatacatgtaccatgttggtgtgctgcacccattaactcgtcatttacattaggtatatctcctaatgctacccctccctcccccctcccccaaccccatgacaggccccggggtgtgatgttccccttccggtgtccacgtgttctcattgttcaattccccacctaagagtgagaacatgcggtgtttggttttttgtccttgtgatagtttgctgagaatgatggtttccagcttcatccatgtccctacaaaggacatgaactcatcttttttatggctgcatagtattccatggtgtatatgtgccacattttcttaatccagtctatcattgatggacatttgggttgattccaagtctttgctattgtgaatagtgccgcaataagcatacgtgtgcatgtgtctttacagcagcatgatttataatcctttgggtatatactcagtaatgagatggctgggtcaaatggtatttctagttctagatccttgaggaattgccagactgtcttccacaatggttgaactagtttacagtcccaccaacagtgtaaaagtgttcctatttctccacatcctctccagcacctgttgtttcctgactttttaatgatcgccattctaactggtgtgagatggtgtctcattgtggttttgatttgcatttctctgatggccagtgatgatgagcattttttcatgtctctgttggctgcataaatgtcttcttttgagaagtgtctgttcacatccttcgcccagtttttgatggagttgtttgttttcttcttgtaaatttgtttgagttctttgtagattctggatattagccctttgtcagaagagtagattgtaaaaattttctcccattctgtaggttgcctgttcactctgatggtagtttcttttgctgtgcagaagctctttagtttaattagatcccatttgttaattttggcttttgttgccattgcttttggtgttttagacatgaagtccttgcccatgcctatgtcctgaatggtattgcctaggttttcttctaggatttttatggttttaggtctaacatttaagtctttaatccatcttgaattaatttttgtataaggcgtaaggaagggatccagtttcagctttctacagatggctagccagttttcccagcaccatttattaaatagggaatcctttccctatttcttgtttttgtcaggtttgtcaaatatcagatggttgtagatgtgtggtattatttctgagggctctgttctgttccattgctctatctctctgttttggtagcagcaccatgctgtttggttactgtagccttgtagtatagtttgaagtcagttagtgtgatgcctccagctttgttcttttggcttaagattgtcttggcaatgtgggctcttttttggttccatatgaattttaaactagttttttcccaattctgtgaagaaagtcattggtaacttgagggggatggcattgaatatataaattacgcaggacagtatggccattttcatgatattgattcttcctatccatgagcatggaatgttcttccatttgtttgtgtcctcttttatttcgttgagcagtggtttgtagttgtccttgaagaggtccttcacatcccttgtaagttggattcctaggtattttactctctttgaagcaattgtgaatgggagttcactcatgatctggctttctgtttgtctgttattggtgtataagaatgttcgtgatttttgcacattgattttgtatcctgagactttgctgaagttgcttatcagcttaaggagattttgggctgagatgatggggttttctaaatatacaatcatgtcatctgcaaacagggacaatttgacttcctcttttcctaattgaataccctgtatttatttctcctgcctgattgccctggccagaacttccaacactatgttgaataggagtggtgagagagggcatccctgtcttgtgcccgttttcaaagggaatgcttccagtttttgcccattcagtatgatattggctgtgggtttatcataaatagctctcattattttgagatacatcccatcaatacctaatttattgagagtttttagcatgaagggttgttgaattttgtcaaaggccttttctgcatctattgagataatcatgtggtttttgtctttggttctgtttatatgctggattacgtttattgatttgtgtatgttgaaccagccttgcatctcagggatgaagcccacttgatcatggtggataagctttttgatgtgctgctggattcggtttgccagtattttattgaggatttttgcatcgatgttttcatcagggatattggtctaaaattctctttttttgtggtgtctctgccaggctttggtatcaggatgatgctggcctcataaaatgagttagggaggattccctctttttctattgattggaatagtttcaggaggaatggtaccagctcctccttgtacctctggtagaattcggctgtggatccgtctggtcctggactttttttggttggtaggctattaattattgcctcaatttcagagcgtgttattggtctattcacggatttaacttcttcctagtttagtcttgggagagtgtgtgtgttcaggaatttatccatttctgctagattttctagtttatttgcatagaggtgtttatagtattctctgatggtagtttgtatttctgtggaatcgatggtgatatcccctttatcattttttattgcgtctatttgattcttttctcttttcttctttattactcttgctagcagtctaccaattttgttgatcttttcaaaaaaccagctcctggattcattgattttttgaagggttttttgtgtctctatctccttcagttctgctctgatcttagtgatttcttgccttctgctagcttttgaacgcttttgctcttgcttctctagttcttttaattgtgatgttcgggtgtcaattttggatctttcctgctttctcttgtgggcatttggtgctataaatttccctctacacacttctttgaatgtgtcccagagattctagtatgctgtgtctttgttctcattggtttcaaagaacatctttatttctgccttcatttcgttaggtacccagtagtcactcaggagcaggttattcagtttccgtagttgagtggttttgagtgagtttcttaatcccgagttctagtttgattgcactgtggtctgagagaaagtttgttataatttctgttcttttacatttgctgaggagtgctttacttccaactatgtggtcaattttggaataagtgcgatgtggtgctgagaagaatgtatattctgttgatttggggtggagagttctgtagatgtctattaggtctgcttggtgcagagctgagttcaaatcctggatatcctttttaactttctgtctcgttgatctgtctaatgttaacagtggggtgttaaagtctcccattattattatgtgggagtctaagtctctttgtaggtctctaaggacttgctttatgaatctgggtgctcctgtattgggtgcatatatatttaggatagttagctcttctttttgaattgatccctttaccatcatgtaatggccttctttgtctcttttgatctttgttggtttaaagtctgttttatcagagactaggattgcaaccactgcctttttttgttttccatttgctccgtagatcttcctccatccctttattttgagcctatgtgtctatgcacgttcttatctctctttctctcctaaactttttttttgtaataatctctctctccacctaaacttttcaacttctctctctttctgtcttttttactccctccactagacatacccactctctctcacaaataaatactcactgtatgatgctaactgctaacttaaaggagatgtaattttatcactcacatatgattattgatgtgaaagtgcaagagtaaatatgtcagcaactgaaaaattagggcaacatgatccaaatcaagtgctaaatatattaatcatatacatactatgcacttctatagaaaaattattaggctataagcaatcataaagattagcataaataacctaaaaaaactattaaaagtcaagacagggagattcagctgacagagttgtatctctctttcttttcatataaagagatattcagtatgatgttgctaattaagaagtgaaacaagttagaatgaaagctataaagggaaatctctgggtgtcagacaaaaagaaagaactcaaagccagagcagaaggtggggctgaactcttggtgtccccctagagcaccatagccacatatatccatatatttgtccgcagtgtggggaaacagacaaagcctgaagccaatgagaggagtggaacagaagctgagactcccacttattaatggatgtcccctcacgcatctgtaagatttagactagaaaagtctataggtctatagactagcccagagacagagtaataaaactagaaatcttcttagggttctgggggaaaaaaaaacatagaaaatgaaacccagatacgtgccatgagtgccttaggaatcagcattgcattatttgggacagaaaactcaaagctaaaaattaacacaaaaccaattaggttttctgtagaccagtacaggcacagatcatgggtcacagaatagaaggaaatactaaattactttggaaggacccaaggcactcacagagaaaacaactttcttcacctgagaatgagctaaccataggatcaaaaactgatactcttttgttcaattcaacatctacctattaaatgcttttttaggcagataatattttagaccctgaagatatattagtgaataaaacataattcctgtttatactctcatgaggaagacaatgaatacagaaatataaaatataatgttcagtactaacaaatgccacaagagaaaagcagtacaaaagaaaatagaagaagagatggagaaacagatatgtagaaaaaatatttatagaaagactctaagaaggtgatatttgagcagaaccctgaacaaagtaaaggagtgagtcatgaggcagaagatacatcaacaggaaagaatacaattagtaaagatatagaagatttaaattacatcattttgaactaactgatgtgtaaaaacttcaccttttgaaaattgcacattctttccaactaatgtgtaatatttataaaattcaaccattatgatctaaaaagaggtgttaacaaataccaaagaattggtattacaaaataaggtatctgaccacaatggaataaaataagaaattaagatgaaaagatagattaaaaagccctatatatttagaaactaaaaaaacattcataaatattccatgagtcaaagaagaaatcataattgaaatattaattatttaaaatgaacacaataaaggcactacatatcaaaacctgtgggatgcagctaaagtggttcttagtggaaaatttatggctttaaatgcatatattagattttttaaatacgtaaaattaattagtttaggatctcacttagcaagttaaaaaataatagcagaataatccatgtaaaagagaaggaaagaataatgattagaacaaaaattaataacatgaaacaaatgtacaatagagagtatcagcaaaaccaaaatttgttctttaagaagaggtgtaatatattaggctaaaccatattattttttcagtattcaacccatagtaaaacttatgctgatcaaaaaatattaatcattaaatatttaagaaagaaaatagaggcactgattagaaactttaggaataaagagaatgtatctcaaacaatataggaaagatttaaaataacctgagaatatactaaacaactaaatggcaatcaatttacaaactcaaatgaaataagcagtttcctagaaacatgaaatgtaagaaaaatatgtaattagaaatagaaaacctgaataaatttatgatcaataattgagagaaaaaataatctcctgacaagttacatctcacatggtttaacagttgaatcctgccaagcctttaaggaatggataatcgtagcctgatataaactattacagaaagaaaaataaatatccaaacttcactgtcttcttacttttttctcagagcacttagtgtcttagtaatattttcacaacaaacttagcttaaaagtatgtaacagatccattaatttagtacttaggtctaaacaattaaataagtatttttgtcccagcaatacagccatatagaaataataaacacaaatttttaaaaattatttttacttcattcttatatagccatctttaagtttattattattgggatgtgtgtgcctgtcaggcactgcacaacttttcaaaccttgaaatctgattggacactgccacacttatttcctgttctatattgattttcatgcagtacctgctttctatgacagcaaccacaaaaaccaagcttcacgaagacatgacaccatcaggatgaatttactgaaatcccacgctaaaactgaactattcagggtagtgtctgacctggtgtctgacagatgttgaatattgctacgtttctcttaaaaattttaaatagctcatggcccacctgtgagttcactgtggccctacaggagtgccttggaacatagattgcaaaccatggcattatggtgagaaatgacttatgtaaatttttaagtaaacaaaactgcaccgaatgttcatggataagtgtgtgcgcatgtgctgcatgaaatgaaatgaaaatataaaaatagtaaaaatatgaactgaaagcatatgcattaacttcagaagagtggttacctctagggacaaaaggtggaactgtaaacacaagggaacttcaactatttctgcaatgactaatttctgtaaaaacaaaattcaagcaaatatggcaaatgctaatgtttttaaaatatgggtgatgggtatttggtatttattacattaatttcgtgccttattatacttttgaaatagttcataaaagaaaataagaaatgacaagcattgtgagttttcaaaagcttcatataggttgctacttttagcatgccattctaaatcccaggacatctggttactgttagacctgcttttctagtttccatttagaatcattaaactatccattcagagtagtcttaacatttaaagacaaaaaatcatataaagacccctatttcataagcttcaccctaagtcacaaatgctgcttttatttagtaactttgaaaaaatctcagcagaaatcagatataagtgctttctattcacttcttcaaaatatacttattttctcatttcagttattgaaaataataccatagtatgatagaacataacatgtattcatttagtgctatcccaaaccccacaaatctctggtctattgcaagaaatatactcattttcaaacttagtattaatatatttattttgtaggatactaaccaagtcaaaaatgaaactacattgaattaactgatgattatgccagatgtacattaagtttgtgttagtcacgtatgccagttcctcacatccatctcccctttaccttctcccaaccccaacttttcaaaataaaattaatattattcattagaagcaggaaactatagagggaatgtcagcaaatgtcagaagttccatgtatcagtcaaggatcaaagaagttccacaataataacatgagctacaataataaagtaaataagatagcaattatcccaccttactctgaactggccagatcatggcacatgtcttttattatgaggacactgccttatcaaaaagcctaaagagaaaaacatgtagaatggtgagaaatcttatttttttcttttcttttttttattattatgctttaagctccggggtacatgtgtagaacatgcaggtttgttacataggtatacatatgccatggtggcttgctgcacccatcaacctgtcatctacatgaggtatttctcctaatgctatccctcccctagcctcccaccccccaaaaggccctggtgtgtgatgttcccctccctgtgtccatgtgttctcattgttcaaatcccacttatgagtgagaacacgtggtgtctggttttctgttcttgtgttagtttgctgagaatgatggtttccagcttcatccatgtccctgcaaagaacatgaactcatccatttttatggctgcatagtattccatggtgtatatgtgccacattttctttatccagtctatcattgatgggcatttgggttggttccaagtctttgttattgtgaacagtgccacaataaacatacgtgtattttttataacatacacatatgtctttatagtagaatgatttataatcctttgggtatatacccagtaatgggattcctagatcatgtggtatttctagttctagatacaagataaaaacaaacaaccccatcagagagtgggtgaaggatatgaacagacatttctcaaaagaagacatttatgcagccaataaacatggaaaaaaaagctcatcatcactggtcattagagaaatgcaaatcaaaaccacagtaagataccatctcatgccagttagaatggtgatcattaaaaagtcaggaaacaacagatgctgaagaggatgtggagaaataggaacgcttttaccctgttggtgggagtgtaaattagttcaaccattgtggaagacagtgtggcaattcctcaagaatggtgagaaatcttaaacagtaggggcagttgaggcaactagagaggtttaacttggaaaacagaagacaaagagagaaatctccagtatcaccatgtttttggtagagtattatgtggagagataatcaggtagttacaaatcactggaagacaagagcatggatctccaggaatgactgctagatccacagtgtagaacctttggggtgattaaaacgttctggaattagatagtggtgatgtttgtacaaccttgcgaatatgctaaactctattcttgaaatgtgtgaaattttatggtatgtgtaaaacaaatttttaagtgtccattagattcagtaacatgattagtataatccaaataatacatgaaaagtcaaaaagcaaacaataaaaacaatggtttccaaagaaataaagtaatttttcaagacagattgaaatgttaggaaagagttttctttttcttttctttaaaaaaaaaatagtgaagggcttgaacaagttcgaatgttgataacaaaggagtttacaaagagacaaagcatgaagacatagaaaagataaaattaatcaatactgcaaaatttctaaaaaagtagaattagtgttcaaaacataggtaaacagattagtctttttaagtggtaggttaatttctttttacaaaacttcatgaaaagaggataccactagctagtcccacccagctgacccaggatatttacagattttatcttgggatgttaagcatgtacttagatggatgtgtctacttttttttgactagatgataatgtagtctgctggggagaagaaggagcaaaggtagaaagggtaaataatttgttcaacattagccagctagaaatggatagatttcatttttgaaatcatttatttttttaggatatatttaaggtgctcagcatgttttgatataactataaatagtgaaatgattactacagtcaagcaaattaacttctttttattttgaagtgattatatacacacatgaagttgcaaattagtatagataggtcaaatttacccgttacccagctttccacattggtaccatcttacataaccatgtacattatgaaaatgaggaagttgacctagtacaataaaataaacaacaaattttatttggatttcatcaatttgtgcatgcactcattttttgtacgtctttgtatcacatgtattgatataaccaccaaaaaaatcaagatacaaagctgttgtgccatcacaaaagaatttgtgacctctttatatgcctgaccttctgaaacctctgaaaataactagacttaatcataagagtaatgggaaactactgaagagtattaagtgataaagtcacatggcagactgtttcatgtttccctttatctcaaataaaaacaggggtgcataactgaagaaagaagaggcattagaatattatttcaataactaaggtaaagcatgatgatgtagaatagaatagtgactctagatatgcagcagagtggataatttcaaagatgtagattcaaaagaatatggtagttaactgaatgtggtagtcaggaagggatcaagctgagcttacctgacttggatatctgggttggtggtaatatcattcacagagatgtgaatcatgagagaagtggcttggatgtgctaagtttatttctttatatgtcaagttacttatgggttattcaaatgaagatgtctagaaggtaatttggtattggagtctgaggttcaggaagaggatcttgtttaagataaagatgtggctgtaattgatccatatatagtaactgaagccagaaaattgggtaagatcaatcagaatatggtatcatcgaagtcaagagaaaagaatgaggatagtggagggaaaaggaggggaaaggaggggaggttggggaggggaggggagggaaaaggaggggaaaggagaggagaggagagcagaggagaggagaggagcagggaaatgaaaggaggaaggaaagggaagggaaggggaagaggaagggggaaagggagagggagagagaaagggaaagggagagggaaaggaaaggaggaaggaaaggaaaggaggagggaaatgaaaggaaaggaaagggggagggaaatgaaagcaggaaggaaaggaaaggaggagggaaatgaaaggaaaggaaagggggagggaaatgaaagggggagggaaattttcagggcaaaacagaaagaatggaaggacagaaagatggaagagaggaaggaaggaacttgcacaaattgagggcacatgtaaaaacttcaaatatcatgtactcattacatataatttgtgctatataaaacttaatgcaaacttatcagcttttctttctttaaacctactttttttttacttactgtttttccctcgaaaagttctttattcttagaaggaatttcctcaaatatttatattcgataccaatattttttctaaaatgaaacatctctattttcttggcccaagaactgtggtaactagcttgaaaacagtgctatatatttgttatgtcaggaaaaatatagttgaatgaagtgttctctttcccataaagaaaaaagagtttcaagctacatttaagttttctttatactaccacctctccaagcgtttcagctatcattgttttttaactgcctctataatatacaatatgcagccaaatatttggagatattttggtcaaaaggtatgttagcaacaacaatagaaataataaaacaattctcaatgataactgaagctattgcataatttaaataaaatggaaaaagtcagcatcaactttgaattcattggcctttgtcaatttatgttgcaatgttatatttgtttaaggcataactctgaattcatttaatgacctagactatttagtgttggactttcatttaaaaaaaaaatagcaaaataaaatgccatctcgtagagtgctatttaccatatgagatccatctggcaataccatctaatatttaactttgaaggcactgttatcaaatagttgctctaaagtgcttataagaggcaaattcttctggtttttcttctaaggcatattatattactgataattttaggataacagatctgaatgtagatgattttaaatgttgattacagcacattatttaatattttaaatattgactaattcatttttaaattatttgtaaattagcagactatttcttttataaaattaaatattttgtattctcccaccccaccgctagaagtctttaaggggaatattataattttaaaataaaggatttaaagtaacagtttcctgttagttttgtggactgttttcttttccagtaatattttgagtccagttcaccataacttaccaataccctttcacattgcccaacccctagaaacacttaacagatttttctctccataggttggctatattcaaaagaaacattggcctatcaggacctctcagtatccatgttgtggacaagaccaaagagaacttaacactttgaaaacagctactttaccttatgtgcgactcataaacatttaactcagtgttactcagtgatgtgctgccaaaagtaatttaccaggttccaaatgctatatatctggataaactggtctccaaaagcaaacaaacaaaaaacctcattatatatttttaaagaaaaatgtggcccccactactaggtcagcagagaattctgagaatatataacaagtcctatgacttcagtcccaaaagctctggcacaggaaaacactataaacttcttgcaacaagagaataccatcaatactagcagggacatgcttatgtctacatttaggtgaactagcaaaatctttcatctgatatgtactaaattcttgaccattacgaggaaaaaaattatatctgaagtggcatattctaaacctgatgaatttcccacaaatcaaaaaaaaaaaaaaacaaatttctcacaagttaaaaaaaggagcctatatttcaaactattacttgtattgtaggcttctgaacaattttattatactcttcagtgttttccaggtttgttaaaataagcactttaaaaacaggaaaaaataagtttgaaaagataaattctagcactctattcctacaagataaagaagtcagattactcttttatatccaatggaatacatgaattagacttataagatggttggaaacacaccacaccacatttaatacacattccagaataaacttcaaataaaaatatgagctgttgaccaatagcagtattataaatttaaaatggggagctttttttaaatcacatattaaaaaagaagaattgggaaccatgtggaagcaaagagcaatttaatatacatacacaagtttagggattttttttttaaagagaaattgagagtcaggcattaaaggtatacaaaatttgtgtctcaatatattaccaattaaatattgaaatgtaaaattgaaagcacaacacctacactaaaaccaaaaaattaaataaattcttcatataaaatctaacaaaatatgtataagatctattatgaagaaaactacaaaactctgatcaaaggtatcaaaaaagaactaaataaactgagagatattccatgttcatggatagtaagactcaatactatcaaaatattacttcttcccaatttaatttttagattcaacataatcccaatcaaaatcccacaaagttattttgtggatattcacaaactgattctaaagtttatatggagaggcaaaagatctagaataggaaacacaatattgaagaaagagtcagaatgctgacactacccaaccccaaggcttactatatagctacatgagtcaaggtactgtggtatttgcaaacatacaacttagatcaatggaacagaagagagaggccagaaattgacccacataagtacagtcaactgttctttgacaaagaagtaaaggcaatacaatagagcaaaagtcttttcaacaaatagtccaataactgaacatccacatgaaaaaaaatctagacactgacattaaattcacaaaatttaactcaaaataaatcatagacctaaatgtacaatgcaaaactgtaaaacttttagaagataaataggagaacatctagttgatcttgggtttggcaataaggtcttagatataacaccacaagccagatttatgaaagaaataattgacgttagagtttattaaaattaaaacttccatatttgtgaaagacaaatcacagactagaagaaaatatttgctaaacacatttctgatattcgaccgtcatccaaaatacaccaaaaactattaaaactcaagaagaaaaacaacttgattaaaatgtgagcaaaagatctgaacagacatctcaccaaagaaatgcagatgaaaaacctgcatagaaaatgatcaacataatatgccattagagaattgcaaattaaaacaatgagatatcactaaacatctattggaacggctaaaactcaaaatactggcaacaacaattgccgtcaaggatgtggagaaatacaaactctcactcattgctggtgggaatgcaaaatgctatttggcactttcttaaaaaattaaacatacacttaccatatgatctagcaatcatactcattggtatttcattgaaaattatgttccacaaaatcctacacataaatgtttatagcagcccaatttataattgcaaaaaaattggaggcaacgacgatgtctttaagtaggtgaatgcatgaacaaatttctacatccatacaatggaagattattcagcactaaagagaagtgagctattaatcatgaaactatacagggaaaccttaagtgcatactgctaaatgaaataaaccagtctaaacagctatatcccgtatgattccaactatatgacattctggaaatggcaaaactatagataccgtaaaaaagatgccagggtttggaaatggggagggataaacaggtagagtacagaggatttctatggcagtgaaagtaatttgtatgatattatgatggtgggcacataacatcatgcatttgtcaaaatccattaaatgtacacccagtgaaccctaatgtactatagttataataatgcatcaatattggttcattagttgtaacaaatgtaccaccatagttaataatggggaaaagtggggaggagaagggtgaatgggcatacaggaactctactttctccccaggttttttttttgtttgttttttgtttgtttgttttttgtaaacttaaaactgctacaataattaaaggctattgttttagttaaatccatttatttctaaaatttaaaacaggaaacataaaacaactaagtttaagaagctgagtgtggtgatatgagcctataatcccagcaacttgggaggctgaggtgggaaaattgcttgagctcagaagtttaaggttagcctgggaaacatagtgagcacgcccctactaaaaaacaaaacaaaacaaaacaacaacaaaaacactaagtttaacaaatattatgtttgcaagtgtcaggtgacaggcatgtttcatttttttcaatattacctgtctagtgaaatcaaagataaatatgtagctgaattttacttactgtgaacaatcaggtggtttgaatttctcttttcagcagtagaaacaaacgttttggaaatcaatatggatttttaaaaactccaaaaaacattaatttgtatttattaatattatgtcttcattattatattgtcagaacaaaaggattcaggttatttataaaatttttaaaatgtgtgtttttatctaggaatatagtcattttaaaattaatgctactgtcaggatgaaggcagggagctctgatacttttcaaaccacctattctagcacttgagatctctgcagaatttgggcctatactgtcatgagaacttgggatttcaatagatctgctcgtggtttcaatctctagttggtctgcaaagaaattaactctgtgctactgcccaaaactatcccccaactttcaaggtttcctgccttgaaaacatgcacattttgtcctcaaaagagtacagaaaggtacctataaaacctgcactgctatggtctaaaatgaccaaaaagatgccttgcctataatctccgtatatgcaagactgaacattacattacatggaagtattctgtaaccaagagtctttgcctttaaaacaaaatatttttttttccttagaggatagctatttggggacttagcaaaactggacaactctcagaaacaagtttttcttcagtagaacacacactagggtttgtgcctcttttctttgttcagttttatacatgtataaaggaaagacaaaaaacaagagggtctttcatttttccacagttccctttcttgggtgccattcctctcattgttcatagatgaatattcagcgtattcttctcacacagaacacttggccagttttttcttttgctctatattaaagggcataatatttctttaactgaggaagacatatttataatataattttggattaagatttttatttacaaatcatttcatagaaagtttctctaaatttttagcaagagatatttggctataattggtcagatttatctgtcttcatttcaaggatctctatggtactgaaatttctgtttaaagaattttaagtaagttcatttatatacagttcatgcaacttatttacttatcccccttcaacatgccagccatttctttccaaatgttaaacagagttactaaaagttatgtgtgtgtatgagtgtgtgtatgtgtgtgtgtgggcctgtttatgaaggagaagcagagacagagggaaagtgggtagtcattgtattcaagccaacaaccccatttcaaaggagagggattcttaccctgaaaatttgttttcaattcttcacttttaaattaatacatttagaaaaggtttaatagaatgtggctgaacctcaattaaataaaaatttccacctcttgattttatttttttgttgtaattaattggtcattgggtttatctgtatacattttatctgtatttgtatttattgtatgtgtatttgtatttatttgtataaatttatctgtataaatttttaatgaccccaaatatatcatgaaaacatttaaatgttttcctttatctaggaaattatacacatgtttgaaaaccaaacagtttatatctgactagatgtttagttgctattactattttgaacttggaatggacattattttaaaataagttatttgtaaagaactgagatttactgcatcctaccttatgtcaggtactcatgtcttgtctcaaatcatgttctgaacatctctttgcattaatataattaatcccagtttacagaagacaaaattaagaaccaaagagagagagtaggtaacaatcaaggtgattcaggacttaactgacaaatctatcaacttctctctacctctactgctgccttcttagttgaggtcactgtgatttccatcctggaccactgaaccactgtattcaccttctaactggattcctcactaactgccttgataattccaatccattctgcaccagaagcaggtttattatgggactgtgtcatacttccctggcttcccatttcatttagggcaaaattctatgaggtctgtctctccatttctctttaacttcatttcaatctactctctttttagctcacagcattctacccacgttaatgtcctttttgttcctagacattgccaaatgttttttttttcttttttcttttttgttattgctttctgatctactataaaatgcttttcttctatggaggcttcaaacatcctattccttgccctggatttctgcatcactggatccttcttatcatttgagtctcaacagaaacaccacctcttaaaatggtcaccctctgattcttgcccagacctttgttagttactgtcagaaaaaaataacttctttatgtacaatgaactagtttgcttgtttgtttgtttgtttatcatctattcctccactccctctccattccccctccatagtaggacaggaatattctattttatttactaccctcatatagtttctagcacttcgggtactgaataaatatttgctggatgaatgaagtctttgttttctccactctaaaatgtgctcatattaattaaatatagtcataaaatttatccagttggatatatatatatatatatataaccatttgtccttagtaaagcttgaaatatgtgaaatcatggcacttcttttttttcccctgaatattatttcttggtcagaacattatcttcctccttggcaaaaatatattgtgcctttatgttttagcaaagtatctcaaagaatcatataaccgtagcaaaatggagctgaagggcaccttagagcccacctacccctatcatgcacctggcacctgagcctcttctacagcatcaagtggccactgagacataccaggctggaggaactaagtaccttttaaggcaacacatctaattcttagtgttttaatagcctaatatttgtttagcgttttggtactaatacattccaagtttctgctgtctactgacttttcactatttgttcccttagatattcatttgaaatctttttagtttaacctgatttagctgtttctttttattaaaaaaaactcgaggtaacttcttttctgatttaatgtagcaataccagaaaatcccttttgagtttagtctttcagattgttagtaaacttaatgatgagaataggagtatttgttatttttctgcaaaatagttctatctatatttctttctacttctcattgtgcaaagtctgttctttcattaagacactgtaattacattatagtcagtatgttttaagtaaaattctgagattcctttactttttcttgagtcgtctaaaaaaatatgttttgataaaatcaagtgaaatatcctttatgacttcaacttcttctggaaatacttgtcctctatatattttatcacttaatttgccaattatgtctactccttttgaataaggaggaaataccattttctgaaataaaaaaaagagaaagagaaaaaacagaaattagagaatattttaaacaatgtgttttatgtgttttttaaatgtcatcaaactcattcttcaggactttactcataataagctgttcaatgaatacttatttaacaatcgctctgtgttctattacttatccctttttctcacttatatgctcaactttttattctttataagttctttcttcttagcatataaacatgcatgattatctcccatcaaatatacataaaaataagcatacaatagaaaagaaagaaaatccttttttgaagatttgctctgttaccactttcttctctattatttctagtcaaatctttgaagagagtttttacttctttacccctcatcctgtttacagtccactgaaaactgacttctgcccttataacataatttaattattcccaccaagatcgcaaatcacaagacggtcaaatccaattgaatatattttgacttgaccttactttatatctcagatgttttgacattcttgacaactcctttctttcaaaaacactgtcctctcactggcttcatactttttggctcttctcctgcccttttctcttcctttgcaggctcttctgcttcttcttgaccctatatatgggttcttcttctgctttccaacagtctcttgctctcacatcatccttttccttgagtgattatattcacatcttcaacttcaaacatcacctttattttgatgactctcaagtctgtagctcctgcccttatcacagctcttctatatctctccagttgtatacatactgctgactatggaatatctttagctgaatgccccatagatacttcaacttatgacatatcaaactgcagtttttaaatcttcactccaaaatgatatttttctgttattcccgtctcttttaatggcactgtcatccaccaaggggatttggaagaaccttgagttcaagccctttcctttgtttccctacagttgccctgtaatctgtatgctgagggttaaaggcagggctaggagaaaatatgtttctattagatgagatgtatcatcaatattcaactggtattagaaaaataaccataaaaatgctcctgataataagcagctaaaacataaagaacatctttttgtaagtaatcgtgaacaatgtttgagagatagaaggatcattcaataatctaaaaattctaaacataattttacatatgaaaaaacagtcctagagaggaaagataaatgtctaatataaaagtaacttaatgaaaaagtgtggactaaaatctagatccacttctgtaagttttgtatttccttggtattagaagtaacttactcctccctgtccctgatctatgtaatggcaaacattttttcttggtaggagataaatcaggtcattacaagcatagaaagcaagatttaaacaaagtatatctgtaatacaaatttctgctagtagaatgtacctacattttaaaaagtgagagttctttctcagctgctttctaagtaatttacactatttatgctcccaccaatcctgtatatttcctatatgctcacaaaccatgaatattatctaatttgtaaaaccttgtcaatctgataaggaaacttagtatgtgtgtatgtaagattgaatatttttatacgttattggacacatatttttatgaattatgtttttagatcctttgaacattatctactgggttatttatatttcttgttcttgaattttcttctgtttcttggataatgttttcttctggaatgtattcttcaaatttttttaatgctatatatttttgttctgtattatttttacagttatgtcatctcatttgaatgtacaatcactatatagcccttaatctatatggttaaaaattgtgtgagtaaaaactctttgccactctccccaccccatctgaattcagattgacttatcctgtaagcttttattccaggactaaaattttgctttaacaaagccaataagcccaggtgcttagtttctcctacatacctattctcccaacaatgctttctcatcccctttcaggcagtgagaataaatccagtaaaataattacgttctatcacattattagtccagagctggcaagtagaggttacatatgtgcatgttcatgtgcctctacaccagcttcctcttcctgagatgactaggtatttactgtgatttgaatgtatccctcaaagttcatgtgttggaaactcaatctccaatgcaacagtgttgaaaggtgggacttttgagagatgattaggtcatgagggctccacactcttgaatggattaatgttatcacagcagtagctttgttataaaagcaagtttggctctttcttgctccccatttgatgagctctttcaccatgtgatgccttctaccacgttgggatacagaaaaaaggccctcactagatgcccaacacccttttatagggcttcacagcctcgagaacagtgagcaataaatttttctttatacattacccagtctgtggtattctgttatggcaacacaaaataaactaagacagtattatgtattttttcttttgttttacattttactaagtgccgacttattcgaaaaggtaattagctttggttaattatcaaagttttgtctttcctttcctacttttgtcccactaagcaaaaaacaaaacaatgagcattgacctttacctttctctggtaagggagtatggaaggttttctactactttgtaaaaatactgctacagatggtacttctggacccatgtggaacctgggggtccttgctgtcctgaagagaagtacacaggcctggctggcttttccacttactgattgtagaatctcaggcattgagcaaatataggcagtagccagggagcagttacatcaggccttaggtgaaacccactgctgtgctggcttcaggtctgacccaacacagtcatagtggtgatggccacaagggagcttgggttactccaccctgcaaaggagcttgggtcactctgagctttgcatagcttagagcagagaaagaaggactctgtattcttgggagaaaacaaggaaagagaacaagagtctctgcctggtaatcaagagaattctcccagatcttagccaagaccataaagcttatacctctataaatcagcaagaaccacagtgttattaggcttgggatgcccctaaagtagatatttcttagatcacaacattcaggtcttttcaaatatctggaacatctttccaagaagggcggctacaaataaacccagaaggtgaagactacaataaacacataactcttcaatgcctggacaaacatctataagcatcaacaccatccagggaaatgacatgacatccccgtatgaactaaataaggcaccagggaccaatgctggagaagcagagatatgtgtgacctttcagacagagaattcaaaatacctgtgttgaggaaactcaattaatttcaagataacacagagaaggaattcagaattttatcagataaatttaacaaagagaataaagtaattaaaaagaggcaggcagaaattctggagctttaacatacaattggcctactaaagaatgtctcagagtcctttaacagcagaatggatcaagcggaagaaagaatcagtgagcttgaagacaggctatttgaaaatatacaatcagatgagacaaaagaaaaaagaataaaaaacaatgaagcacacctacaggatctaaaaaatagcttcaaacaggaaacctgattattggccttaaagaggaggaagagaaagagacaggggtagaaagtttatccgaaggaataataacagagaacttcccaaccctagagaaatatatcaatattccaagtacgagaaggttatagaatgccaagcagatttaacccaaagaagactacctcagggcatttaataatcaaactcccaaagatcaaggataaaaaaggatcctaaaagcaccaaaagaaatgtaacaaataacatacaatggatctccaacacatctggcagcagacttttcactggaaactttataggccagcagagagtggcaggtaatatttaaagtactgaaggaaaaaatcttttaccctagaatagcatatctggtgaaaatatccttcaaacatgaaggagaaatgaagactttcccagacaaacaaaagctgagggatttcatcaacaccagacctgttctacaagaaatgctaaagggagtacttcaatcaaataaaaaaggatgttaatgagcaataaaaaaatcatctaacagtacaaaactcactggtaatagtaaatacacagaacaacacagaacattttaatactgtaactgcagtgtataaactgctatctcttaagtacaaagagtaaatgatgaaccgataaaaaaaataaatacaactttttgagacatagtacagtaagatacaagtacaaataataaaaagtttaaaagctagtggacaaggttaatgtgtagagtttttcttagttttctatttgcctgtttgtttgttcatgcaaacagtgttaagttgttgtcaccttaaaataattgcttataagatagtagatgcaagctttgtggtaacttaaactttaaaaaaatacaatggatacacaaaaagtaaaaagcaagaaattaatcatatcaccagagaaaatcatcttcacgaaaagaaaagaggaagaaaggaaagaaggaagagaagaccacaaaacaaccaggaaacaaaaaacaaaatggcgggagtaagttcttacttatcaagaatacattgaatgtaaatgaactaaactctccaatcaaaagacacaaagtggatgaatgaacaaacaaacaaaaaagatccaatgatctgttgcctataagaacacacaatacctataaagacacatacagactgaaaataaaaggatgggaaaagatattccatgccaatggaaactaaaaaagagcaggagttgctacacttagaccaggcaaaatagattccaaggatgaaaactataagaagagacaaagaaggtcaccacataatgataaaggggttgattgagcacaaggatataacaattgtaatataggtacccaacactagagtatccagatttacaaagcaaacatttttatagctaaagatagagatagaccccaatactataatagttggagactttaacaccccactttcagcattggacagatcttccagacagaaaatccataaagaaacttcagatttaatctgtgctatagaccaaatggatctaatagatatttacagaacatttcatccaacagctgcagaataaacattcttttcctcagcacatagttcatactcaaggatagaccatacgtcgggtcacaaaacaagtcttaagacattcaaaaaattgaaatattatcaagcaccttttctgaccacaatggaataaagccagaaatgaataccaagaggaattctggaaactatacaaacacatggaaattaaacaatatgttccagaatgacaagtggtaaatgagtaaattaagaaggaaacttaaagatttattggaacaaatgatagtaaaaacacaacatgccaaaatctatgggatacagcaaaagcagtactaagagggaagtttatagctttaagtacttacatgaaaaaatagaaaaacttcaaataaacaacccagtgatgcatattaaagaacttcaaaagcaagagcaaatcaaacacaaaattagtggaagaaaataaataataaagattagagataaatgagtagaaaatgaagaaaataatacaaaagatcgctaaacaaaaagttgttttttaaaaaaaggtaaacaaaattgacaaacttttagacccaaataagtaaaatcagagatgtaaaaggagacatcacaactgataccgcagaatttaaaggatcgttagtggctgctataaatagctatatagaaagaaatagaaaaatttggaagaaatggataaattgctagacacatgcaagctactaaaattgaaccaggaacatatccaaaacctgagcagaccaataacaagtaatgagatcaaaaccataataggaagtctcttagcaaataaaagcccactacctgatggcttccctgctgaattttaccaaacctttaaagaacacccaatcctactcaaatactctgaaaaacagaggaggaggaaatacattctaactcattctatatttgacagtattaccctaatgttcaaatcagaaaaaggcacaacaaagacacatttcggatcaaatggctttgatccaaaagacagtaacaaatgctggcaaggacatggagaaaagggaacccttgtacactattggtggaaatgtatattagtacaaccactatggagaacagtttggaagttcctcaaaaaactaaaaacatctaccataagatccagcaatccctatatgtgtgtgtgtgtgtgtgtgtgtgtacactaaaaagaaaggaaatgagtatattgaagatatatctgcactcctatgtttattgcagtgatatttataatagcaacctaagtatccatcaacagatggataaagaaaatgcagtatttaaacagaatgcagtactattcagccataaacagaatgagatcctgtcatttaaaacaacattgataaactggaaattattaggttaagtgaaataagctaggcacagaaagacaaacttgatatgtttgaacttatttgtggaagctaaaattaaaataattgaaccatagagataaagagaaggatggctatcagaggttgggaaagatagttgtttggggtagggggagaagtggggatggttaatgggttaaaaatagttagaaagattaaataatacctagtatttgctagcacaatggaatggctatagtcaaaaataatttaattgtacattttaaaaaaactaaaagtgtacaattggattgtttgtactacaaaggataaatgcttgaagtggtggatactcgatactccatttactcttatgtgattattactcattgcatgcctctatcaaaatacctcatgtaccccataaatatatatacctactaagtatccacaaaaattaaaaataaaaataataaataaatatttttattgagtttttttctgtgaattatacaatctcctaggctcttagtctgctaggagatgtagcgatgaaccaaaaagtgctcttatggatcttagggtatactagttaacgtagaagggttgctctaaatttcaaagtgtctgtttatcaaagcatctatgattatcggtgtcttttttgttttttgtttccttattgtttgtttttcatttgagtacttttctcattaaaacactagcttaagcaacatgtcaaggagaaagacaagacaatacaaaagacaacaaaacaagctcttcactgcattgcctcacccataaacttataaagtggctgtcactttataaaaggctaagaaaagctatttcgctgaaaaccttattgactgttttaatgacatcacatttgtagttctgttatgaggaaataaatcatggaaggagtgaggagaagtttagcaatagttgtggtcttacttgctgtgtggtgggtctcagatgccctatatgctatgcaagtagaaatcattgcttatcattttaatgtaagtttgattggaatgtgactaattacataatagttatacaaaaaaacatattctagatcagctaattaagcaatataaaatatgttttgtgcacaaataaagaaacatattgtttcattcctataagatacataaataaagttattttggactgataaatatttttttcaactttcaaaagttccagggtacatgtgcaggatgtgcaagtttgttacgtgggtaaatgtgtgccatggtggtttgctgcacagatcaacccatcacctaggtattaaacccagcatccattaactattcttcctgatgctctcacttcccccaacccaaacccctgagaggccccagtatgtgttgtccccctccccatgtgtccatgtgttctcattgttcagctcccacttataagtgagaatatgtgttgtttggttctctgttcctctatcagtttgctgaggataatggcttccagctccatccatgtccctgaaaaggacatgatctcatttctttttatggctgcatagtattccatgatatatatttactacattttctttatccagtttatcactgatgggcttttgggttgattccatgtctctgttattgtgaatactgctgcaattggcataaacgtgcatgtatctttataataaaatgatttatattcctttgggtatatacccagtaatgggattgctgggtcaaatggtatttctgcctctagatctctgaagaatctccacactgtcttccacaatggttgaactaatttacactccccccaacagtgcaaaagcattcctttttctccgcaacctcaccagcatctgttgtttctggactgtttaataattgccattctgactggcatgagatggtatctcactgtggttctgatttgcatttctctaatgatcattgatgttgagcttttttcacgtttgttggctgcataaatgtcttccttgagaagtgtctgttcatgtgctctgcccactttttaatgggattgtttgttttttcttgtaaatttgtttaagttccttgtagactctggatattagacctttgtcagatgggtagaatgcaaaaattttctctcattctgtaggttgtctgttcactctgatgatagtttcttttgctgagcagaagctctttagtttaattagatcccatttgtcattttgcttttgttgcaattgcttttagcgtttttgtcatgaaatccttccccatggctacatcctgactggtattgtcagattttcttctagggtttttatagtttggggttttacatttaagtccttaatccatcttgggttaatttttgtataaggtgtaaagaaggggttcagtttcaattttctgcatatggctagccagttctcccagtaccatttattagagggaatcctttccccattgcttgtttttgtcaggtttgtcgaagatcagatggttgtaggcatgtggtctcatttctgagttctctattctgttccatgggtctatgtgtctgtttttgtaccagtgccatgctgttttggttactgtagccttgtagtgtagtttgaagtccagtagtatgatgcctgcagctttgttatttttgcttaggattgtctttgctttttgggtgctttttgggttccatatgaattttaaaattcaacatcccttcacgttaaaaactctcaataaactaggtattgaaagaacatacctcaaaatagtaagagccatatatgacaaacccacagccaatatcatacagaatggacaaaagctgggagcattcccctttaaaaccagcacaagacaaggatgccctctctcaccactcctactcaacatagtattggaagttctggccagggcaatcaagcaagagaaagaaataaacatattcaaatagggagagaggaagttaaattatctttgtttgcagataacaggatcctatgtctagaaaagcacatcatctcagcccaaaaccttcttaagctgataagcaacttcagcagtctcaggatacataatcaatgtgcaaaagtcgctagcgttcctatacaccaacaacaggcaagcagaaagccaaatcatgaatgaactcccattcacaactgctacaaaaacaatgagatacctaggaatacagctgacaagggaagtgaaggacctcttcaaggacagctacaaaccactcctcatggaaaactagaaaggacacaaacaaaaggaaaaacattccatgttcatggatagaaagaattcatatcacaaaaatgaccatagtgcccaaagtaatttatagattcaatgctatttccattaaactatcattggtaaatctttttaagaaaaatttatagtataaattaatagtttaaagatggcaatttttatttagatagatcaaaaaaaatgctgtcacagagagatgtgaattgaactacctattgaggaagtatgttatcattaatgctttctcacaatttctttcatattaaggattttaaaaagttaaattatatacaatttcatttgtatcatcactatagtttctttatcaaatatgtgttgagtaaatgctgtgtttcagacattgtgctggaattggagatataatggtaatgaaatgaaggatgcctcatggatcttacagtctaattgaggtagaaatacaaatacacatacatatatacaacacatatgcacatactaaataatcacacaaatatatgaatatttactttcagataatgttactaaattgtggttatttctgtgctggcaagaaacacccagtttcttgaaatttacttttcaatgacttcttccaaatttaatcctgtttatgcctaaggatttttgttgttgtttttttaatctcttaaagttgcacattgaatcactgctgatttgtatgcatgaagttaccaggacttctaattttgtaccaagtttatatgtgctaatattttccattagtaaagaagactgaaagatgcctcagttgcctggaatttatgccaccaaggaaaaacagtgattagtgtgtttaaagagttagatcattgggttaatcatgctttgccatagtatcattgctatcctttaaataaaaaaaaaaggtttagttagaaaattttttaacaagataaaattaaccacagactataacgaaaagtaatttcagcaggattatttattctcccaaagttgaaaaaacaacaaaccaaaaaaggtgtatatgtgacatctacttaattttttaaatatgattatttccatcttttgttctttgatctccacatgagcagagacacataaagtggcaatggggccaagggtgctagatggcttggcattcattaactatggcaattagcaccatttagattgatatgttcccaagatgaaagtaagaattggactagacaaaaaaaatgatgatcgcatttgtgaaagtggaacaacactgaccaacaagaaacaaagaaacagagctcaccttaaaagacttggaatatttgaaaaattgattatgagataagataatttcaacataactacaattccttgaagagttattaatgcttcggtagcattaaagtaaaatgaaaagacaccagggcagtctgctttaatagcttgctggcttgaaccctaatacataatgttcttgtaatagtttatgggtgactgcagtaaattggtagtgaatgtttttcatttttttggctcttcatatcagatctgctcttggagaacattttgttctgagaatattatgaaggcagttcatctactttagaagttgcttgacaattttaatacagtgttaacttttctcccctccagattgtgtgatttttttgtcctttgtacccgacatcaatttatggtttgaaattcagcaatttgctcagttatactttacctaccctgactaaatattttaagtgctgccacaagaaaagaaaaaatctaatttttcccaatgttgttgttacccctctctgtttatatagcagtttaaatctgcccttcatcttgacagagaaaaaattttagatggattaattttgaacctaaataatttgttgacaaataatttatgatcatattcaggggttgttttgaggtaaaaagaaaactgcattgaatgaattataccaagtgaaatcatggtattttaaacaaaatgaggtttataattacctgggatttagtgaacaaaagtatgtgatgcagggctccctgaagaatttagtgcatgtcctatgttttagtgcttcaagcagcaaatattatgtatatacaataaaaaaggaagttgcagacttaatacatactgaaatggtctcaatgttaacattagactcatgaaaaattagcggacatctaagtactttattcgttcttttagtctttgctgtacctaggaacatttgtttcatataaaagttatattacaaaattaatggactgagggtggaaagagaatttgaaagaatgtgaaataaagtctggatatatactgaatgcaggtggaagatgtctgaggaacattaatgacaataaagagaagtctcttcctaagttacagacatccaaaaccaaaataagagccaatgtggttacataaaactgcaaagaaaatcttggttggacagagaactccgaagaggtagtaaaaggaaaaactgagcaaactagggaagacaaatgcagagaaaagttagaaataattagagaagaaataaaatgcttccacaaaaataagaacaacaaaaattcaggagataaatgcagaacagtccagctaacagaaaaggatttttgaactgtgtatgcaagaagcagacagcatgattggaaatgaagtatttgctctttcctctaagagtggaagaacaagacattcctgggcagcacaactctgcgtaggattagttgcacttcctcaaatgtattttcaagcaaaaagctgaaacccaaatgtcttgagccaccagaagtacccaggctcttatgtaatacaggctttagtgttttattgcttattcaaaaagacaaattatattttaaaattgatatatgtgtgagcatggttatgctacacctataaattaccaaacgtaataccaatagcagccaaccaacagtttagcctcagtattttcacaacagttcaaaatgttttgttaaatcccatgaaagtagcttcagtgacaaaggtttcagatctttgcaaatgataattaattcagaggcatataatgggaaacactacagtcaggtctagacaggtttagataaactaatggcccaactagttatggcagctacagtttttaacttcaagtaaaggaatcttaaagcagttcaaggaagaaacattttctttcttttcctttttaaaacatttaattgtcttttttgaggatgataaaagataaaatctagagactttattgtactgtactcattatagtctctcccctgcctcatatgtaaatctagtttgcttcttcatgtttattcatctctactttaaataaacatattgtacatatactctatacacacacacatataatacctattctcttccatttatgcttacattgtaagtcttttaaacatttattgaaacatttttgttggattgactctacattgaatagctttattataaatgaaagacttcccttctattaaacagaaatttcttttaataccactatgaggcagaacattattgctatggtataactttgtacgatcgaatgtcctactggttagatctgtgagttaatttaaatttttacaggctgttagatggagtaaaaggcaggatacagccatggactgtaggttttttatcctttagttacttctttaacttttaatttacattaatggacaagtttcatctagtctaattttatgtattacttgagtctttcctcatatttttggaatgccatttttaatttagagtgttttctaagttaaagtcttaattgttcttttcctgaataatagcttgcatgaatacaaagaactttatgtttgaattttggatttagtcagcttgatttttcactgaaatcaggcctaaacatatgaagttcagcagcaaaaacaaaagcaagcttacttactgaaaacgcattgtctttctataacaagcttactgtaaagactggggtagtatgtatatttccatagatacatatatatagtatctgtgtgtacacatatacacgtaaagttaagaaagtttgtaaaaaaactacacatacgcaacattagaaatactgttaaatatttatgtgtaatgaagctgttcttttcaatgatgtcctacattgtaaaggttttatttaaaaatttttatataatgaatgcaaacttgagtcactgttcaaacatgaatattttctcaaatgaacatatttgcatgtgttatgctatataaactgagttctgtaaaaaggatcctttttcttctgctaccaagaaattctacttttataattcaaacaatctactctctcccacactcaaaataagtcatcattacttaaaatatgtgtagtgtaacaatggaaatgtttgtatatttgtcaaactaaatattatgttaaaatattttatacatttccactgagaatgctcttcttagttaaaaataaataaaatttaaaaaaatttgaatggagacattttgaaagtggctattccaggtaggataaatatttaatttactccatagcataataattttaggaatcacttcattttgaaaaattattctgaatactagcaacattttggcctttaagacactttattaacagttttgaagaaaaagttgagacatttgttcaaaagatttgaatctattcacataatagttcagacaatctccatttttaaattcctaaattttgaaaatttaggatacgtaaaaaagataaattaaggaatgatggtttaccacatggaaaaagtattatttataaaaattttaaaagtataatttatttacaaaatttagttatttaataacatatataaaaagactcaagttgatattctaaaacatacttttaaacaaaaggaactgtctattacataatgaaaatttatgcaaccaaaatgagtattattctttgcaaagtagttgccttgggagacagttctttaaacagtatagctattgctctaaatattgcacaatgtgcgaacaatgttgaccttcagtgccaacaacatatcattttgaatattttcactgacaactgctctttaattttcgttgctttttagaaatagtcaagagtaacttagagccatgtttacctgacagagccaagtttattgccatagcaaaacctggcctgtatagttatagaaatcccttatcttcatttcttcacctccaactctacaatctactccaatttgttgtcctttgcctcctctactcccttcaaactaatctttctaaggctgtaactatctgttttcagtcaccaaatgggcaatcatttaaaaaatattatggaaatgataaaagccatttatcttgggtggttttgtgcagtttctaaaggcagtttcaaaagaggtaagtaactttgatagtgatagaatcattggaataaatatattaccttcactatgacaaggatatttggatgtttaacttttggatatctgatatgtattttccattcagtgcagtatttattgagcacctatattatgcaaaacactgtgcgagatgctgagacaaaatatgaagatgaagaaacaatgagaccagccctgactcatgaacaaatagtgaggtaaggagataaccttcaatgactctactgtgagacagatttaagtgttctcttggagttagaatgcactatataaatagagagggaagaattcattttaactgaagcatgacagttaaattgtgcctagaaggacagagattgaaaccttaacaggtagaaatggaagaaagaactaggaagaggaagtaagttgttcaatgtagaatagggtttctatctttttttaaaaaatggacagtttactttctattcatagcttacacagtaaaactgtgcttgtttcaactttgctggcactacacaatatgcctagattcaattctgttgaatcccataaactctctttttttgttttgtttttcattccatctttctatgcctgtgccccatgtgttctttctcagctctcatgtctgtgtctttttcagttctgcatcaccttcttttcttctacatctgtttctcacctttccctgtctctgctatcccctctcgtagtcatctttccgtcttgattgccataaggaattgaaatatgctatacttctctttgacaaatccaaacttgaataaactcttacactatggagttttcaacaaatccttactctttgtacttttttccttttttaaattgttccttcccttcacttaattccttgtaatctgtccaaattttatattctcctcccccacttttctcccttttctttctctcctttttgattcttacactacactactggtgtactcagaggaaaaaatgatgctaaaataaagaaaatgttctttacaatcagaatattattaaccagtacttccaagcataactagttcaatcataaaagttcatttaagatttcaatgattccaacttatatctctttatctctttttgagtcaagtattaaatgactagtacttcaaagttaaatgtattttactgtataatttttgagactgatcatttatatttgatatctatatctcatttcataactatactacatggtctaatgtatagcatatggaaagtttttgtagcttacctcttcttgcaagactaaatgagaggactactgttggcagaaagcaaagttggtcaaggccaaaaataggactgactgttttctttagaccctccctttttcttccttgtaataatcttgaactcctagattccagtttttcctttatttagccaataaatatttactgaatcctaactattttccaggaactatggtaagtgctattgatagatgtattaggccttctttgacacggaagagcttacaacctaggtggagagggagaaacataactgcaatataaattgataaggcccataatgggacgaagaacaggctactatcctcattatacatctggtactcagagacctctacgttattccttggattttccccatacttgcaacccacctttttatcctcctcattaaaacttacctgttattgaatcccattttcccttaaggcaccccttttggataggtgctttgggaaaacaatcccacaaattaactcacactggatattaaaagagtaaagcatatacctcacatccctcttgcattttaacaagtcagtccatttgaaaagaactggttgctagtgatgggaatttcaagaactgtacagtaggccattagaaaagtaaaactttcctcatacacttcaatcacaacagagaggggttgaccgtacaacataaaacttccttttagatgccctaacactattattatttaaacaacatagcagctacatattcactaagaaaatacaattgaatttaattgttgttagtagtagtagttaccgctagtaactactgttactaaaatagaaattatatatcgatttaaaattataaaatttgccttattctttctttaacttttattttaagttcaggggtacaagtacatgtttgttacataggtaaatttgtgtcatgggggtctgttgtacagattatttcatcaaccaggtattaagccaagtatccattagttatttttcctgatcctttccctcctcccaccttccatcctctgatgggcccagtgtgtgttgttcccctctatgtgttcatgtgttctcatcatttagctcccacttataaatgagaacatatggtatttggttttttgttcctttgttagttcgctaaggctaacggcttacagccctatccatccatgtccctgagaagaacacgatcgcattctttttatggctgcctagtattccatggtgtatatgtactacattttctttaaccagtctatcattgatgggcatttaggttgaatccatgactttgctattgtgaatagtgctgcaatgaacatacacatgcatgtgtctttataatagaatgatttatattcctttaggtatattctttgatattattatgaagattcacatgaaatagcaaggaatggttttctagttggaaaagtatgattcccacaataaaagtaataaaatataataagaaatatttacatatatcaagaaaaaatgattcatgggatcacaaaataaaaattatacaaattgaggaaagccttatttaatataatgtctttaggaaaaaaattagtatctgtggacctgggattcctcccctgtaaaatgaagggtttaaataagaaaaactccactttcttgcttccaggcttaacacatatgtgaatcatttgcataaatatttctcaattttcctactacatgaaattttagttgctacaatatcacaattaggcagtctgcataaataaaggagtttctcttatatttctaaatataagagaaatatataaaatatactaaaatactaaatatataaaatatttaaaaatactaaatatactaaaatacagtactaaaataatgcctaacacaaagtaactgccttagcataatttaggtggctgattggatggattaaagcttggattaatagaaaaacacaatgatgcaaatgtgaagtcaggtatatgtctacacatctaacaacatttaatgagagacactgaagacccagaaatgagtatttttacaggcttacaaataaccgatgttcaatttgggggtcaaaacaagaaatagagaaaactgaagtaagttaggtaaggtccattttgactaggattatttctggcaatttcccctcatctactttctgcaaattcatgcatgttcactgtactgtgcttactgacaatctgtaccaaataactcctggcagtttgaaatcatttcatctataacatataaataccttatttgcttcaactgtacaaatgctggaccccatctcaccaaagttttctagaatttaattgttcttcacctaacatctttaaaactcaatttattggtctgtaaaacagtaagacctacattatagagttattgtgacaatcagacggactcaaagcatgtcatagtttcacttacgtatctaccaacccactatcattagccttctacttgagaccaacccctttacctaagtactaaatgtggtaatccttgaagtctctgggacttttctatacaattatcatttttctctgcttgacttcaatgtcttctctgctggctctttatttttcaaaacatgtaaatcatttgtattctaacattaccttgactctgtgcctctttttaccaacaattctccctcctttcatcacctgtgtatattgattaaataaacaaaaaacaattcaaagtaattttatatgaaaaacattgcgggaggaaaatagaataaaaagcaacagtaacaatataaaaaaaaaatcacctgttgtcaaccacaggcatttcttcccaggtgtaatatagttatataaaataaacttgtcatcagaagttttgaatctcagtatttttgcttaatattaaattttatatagcattaccttttctaaaaaaagtgttaaaatagtattttaatgactgcataatatcctatagtaagaatgaaatataattcatttattcattcctacatttagacatttaggtactgtcaaaaatttttgctactataaatggttctgataaacatgcttgcagataaatctttgcatacgtctctgaatatttctacaaaataatcttcaagattggaaattattgactaaagtaaaataaacaatgtgaatagcttttacctttctgacacaagcttaaagtctttgttctttcattaagggaaatttttccatttaaatttatactaaaaatattgtgttattgacaaggcaagtaaagaaaagaaatcaatgctactgaatcaggcactctgatggatattctgtctcttcctattcaacacattttcctttggcaatctcttttcatgagcttatcaactaccaatgtattgatggcttccaaatttctcttcaggtatgaattctcctttgagcttgaaactcccatgtccaaaggcttcttgactatatcctatggtgtgtcatgcagtcctttggattctgcattaataaaagtaaagtattcttacttcacaaaatattctgtaaataattacccaattttgttaatcaagtcatatggaagacaatgcataaatatacaaaataaagaataagaaatgtactacaaatattcagaaagcattaaaatatgtcaaaatactgttacagatatatactaataaaattgaaaatctcaggacataatcttctaagaaaatatacattttcaaaattgactctataaatggaaaattttaacaggccaataaatttaaaaattaattaagaaaggttccagaaacaggtggttcaagagcaaattctatttaatttcctttttcaaaaattgatagataaaattctatgtattttccatgtataacatgtttttaagtatacataccttgtagaacaactaaatttagctaattaacacatgtattacctcacagttatttctgagtaaacatccattcattatttttcaagaatacatgtattattaactatagtcatcatgttgtacaacagatctcttaaacttattccacctaattgaaatgtcatatcatttgaccaatatctccttaaaccccagttttaatagaaaattgaatttcattaagttttcaaggatcaaaataaacccataacatagtaacaaaaacaaaatatttccaaattcattttctgaagctagcaaaagcctaaaacagtacagcaaaggaggctactgagcactgttacttcactccattgaattaggactggatgcaagtgtaaagcatcagatttatagaacttactataaaaaactctaaaatatctcattaacattttcatattacatattaaaatggtaatatcttggctatattgttttaaataaaatacattattaaaattaacttcatctgtttctttttactttttaaaaatgtagtcacaagaaaattttaaattgcatatatggctcacattgtattcctattagtattaatatagataattttgcttataaggatacaaaacttctcagcgagttaaatataacaatatattaaaaataatttgtgatgaccaagaaagttgaaagttttccattagaatatctactaatatatatgataaatttatataagtatgattttaaaaacaataattttgatagtgctgaaaatgcatgcaataaaaatcaaccacaattcttaattttaaaactcttaataaactatgatgaaactctttaatgtaatgaagaatatctacctataaaatggttgacactacacctaatggtgaaaacattagtggtattcccagtgaagccaagagaaaaacaaactcttgctagcacttattattataatttggaagctccagcaataccacctaacatgaactataaacatgagaaaggagtagaataaaaaaattaagaaataattagaacttataaatcagtaacctgcttgtttactatacacacacacatacacacacacacacaccaaaaacagccatttaaaaatgcaaaggaaagaacaatctcttattaccaatgataaaaaataaaaactacatagaaactaacactacaagaaaaatgtcagacttatatggaaaaaatgtttttctaagtaatgttaaaaaattttgaataaattaagacatcttccagatgagaaacctctatgtcaattctccctaaaacagttcataaatttaatgcaaccactctcagaagtccaataaaattgaagggggggggcagtggtagagagaccttgattaaataattctaaatctcttataaaaaattggttaagaatagccagtaaccttttaaaatgaaaaatactaaaaagaaacttttattagcaggtttaaactgtattgtaaaagccacaataaatagtgtagtcctagtaaaccatatagaaactgatagaactgaagagaaaaaataggctggaaatcaaatagaaagacaagaaacaagcctatttgtaaattaagtatttagcatatgataaataatgcattttaaatcagtgggaaaaacatagattttttttcaattgatggtgctgagacaactggttaaatatttagaacagagtaaatttagagcctatctcacactgtatatcaaaataaaattccagatggtttgaagagttatatgtaaacaataaaaccataaaagaaatagaagcaaatacagaagaatttttaatcttatcttgggttggagaaggtcttcctaagcataaaagcaaaggcagaagccataaaaaatgtaatatggtttttaaaaatagaatatttgaacacataaaaatgaaaggtcagtatagcaaaaacaaatgaaactaaaaggcaaacaataaatttagaaaaaactatttgcaacatatgacagagtatcatatagcagctgaaaacaatgtcctatgaaaaataattaaggacctgggaaaaacaactagcacatagtgttaaacggagaaattgttataaaacagtacatacattattataggaactttgtaaaatacacttacatttgggtataatggtttcccacatataccatgtttataatttccatgcttttatacatatagtcccctttgactgaagagatcctccttccttccctgtctatacatctcctattcatctttcaagcatcatttctgacatccctttagacaacaagaagtcttctttgaattatcaggctggaatatgtgcccttcctttgtttgcccatagtacattgttgtacaccatcaaattaatgctatttaatattatctgtttacatgtattactccacccctatgattaaagttccttaagagaaagggtaatattttacctctttctgcatgctcatttcctagtattatatctgtcaattagtacacattcgaaaatattggtttgaattattgctaaaatgtcttctaattaagattattccaaaatgaagctaacatcaatagggagacaaacaacacaagaggcatcaaactgtataagaagtctgaaagaaaaaaaagacttaacgtcatgagagatgattctgtcctcattttcacgttaaaccagaagcttccttcagggtacagctcaatgagtcaccctagagtattctaggtatatattgatattcctaaaaatctaaacatatgtaccatatacaaaccgtgtcccacaatttatcacttaaagtttattgtttttaaatgatttctcatttatgagtcttttctctcattagacgttaatctctgttatgtgaagaggtcatgccttatctaggcagatatcctacaaagtgtttggctaagtaccctagtactttaataaaaattcaatatgcacaaattttctatacagctttaagtaattttctgtttttatttacatacatcccttcataattttctaagaaaatcaggatctactccaatttcctcattacccatcatcatccagaatgatgaagagatgtatagattattaagaaaatatttgcgtttgctgagtaaacccgatattatctaatcaaaagaacagcttcggctgtgctgctcctagctgtgctagtccacacagctttcccagttttcatgaattagtggaggtaatgttaaaccacttttctagtaagagtgcataaggatatttaagtgagctcatccctctaacaaaggaaagaataattttcattaatcattattcaacagtacatcttcttgaactaaatcatgagaggaggaacttatgatgttttttattagtcaaaacattttctatatatagcttagtatatgcaacgtgccaaattacagaattctatttactgctaatgtcaatttaccaccacattgcttgatataattcaaagttttccaaggagctatttgacctcctatagactgaaaataaaatcatgagatttaaattacttaatgccaaaaaggaaagtcatctttttctccttcttatgtctttgtttcataaaactattatcagacagtccatgcaaacaactaaaaacaaaaaattatatggtgtagttaattgaaaaaatgcttttgctacacacagaaattgacactaagtgctgtattagaaggaaatcagtgattttcaattgacattgcacaggaaatcatttagtgtcaattgatattaaatgggtaaaattgtactgaattagtacaaaatgatttggtggaaaaaaatgtgcttccattaggtgacttgatattaagtgggcttaaatgtaataagttttagaggtcactagtcaacaaaaattggggcatgctattcaaccctgagtacatcagactgcttgctcttaataccctcatcaaaagataagttagtgtcatactatcatgacaaaattgtcttcctttgggctttcaagggaagtgggaaaattcaaattgtttaaatgagctaaattagccagtggtaaggaccatgacttcttagatttatctggtggtcctaatcctttaaaaatatttttttttctagaatttttggcatgaaatgaaaggcaacataacagcacgtattttatgtaatatggtccagattgcgctttctttataaaatggctttgacagtaagcacacaataaattatattgtgttagggagtgatatgattatatataatgaagtaaccactttattgatcttttaagaaacctatgtttttaaacctgagtaatgaggaaagagaagtgtgtggctgcaggagacacaaggaaggagaagaaacaggaaaagttacattacacagtcactacaagaacaaattgaataaaatattatagatattttctgggaagagaaatgggggtttgtgaggtacagaaaattgtaaaactcatttgttacttagtaatacaagaaacaataacaataaaacagacatactgggaacactccacccaacaaaaacagaatacgcaatcttctcaagtgtatgtaaggcaattaccagtgtccaggatagaccacatattaggccacaaattaagtctccatagatttaaatagacaaatatcatacaaagtatcctttctgaccacaaagggataaagttagaaatcagtaacaaaatgaaaacagttaggcaacatactcttaaacaaaggatcaaaaaagaaatcacaagagaaattagaaaacacccagagatgaatgaaaaagtattatcccaaatcaaaacttaagaaacacagcaaaaggagtgctaaggggaaagtttataattataaatgcttacattaaacaacaaaaaagacctcaaatcagaacctaactttacaacctaaggaactaaaaaaaaaaaaaaaaaaacaaactaaacccacagctagcagaaggaaagaaatacgtattagagcagatgtaaaatacagaatagaaaaataagataaaaccaataaaaccaaaagttggttcttcaaaaatattaataagattgacaaacctttggatatatatactaagaaaaaaagagaagactcaaattacaaaaatcagaagtgagagaggaaacactactactattctacagaaataaaaatgattataaaagagtacgatgagcaattgctaggccaacgaattggataacctagttgaaatgtagaaattcctagaaaaacaaaacctaccataactaaaccacaaaggaatagaaaatctgaatagacctatataacttgtaaggagattgaatcaatattcaaaaatctcccaataaagaaaagtcctggacctgatgacttcactggtgagttctaccaattatttttaaaaagaataatatcaactaaagtttcctcaaaaaacaaaaaattgagctaccacatgatccagcaatcccactgctgggtatgtatatacccaaaagaaaggaaatcagtatatcaaagaggtatctgcactcttatatttgttgcagcactgtttacaatagctaagatttggaagtgtccatcaacagatgaatagataaagaagatgtggcatatatacataatgaagtactattcagcaataaaaaagaatccctctcaaacttttccaaaaaaatcagagaaggaaacactccctgattgattacatgaggcctgtattaccctgatgccaaaaccagacaaaaacacaataaataaaaacaacagaccaatatctcttatgagcattgacaaggattgaaaatccttaacaaattatagcaaaccaaattcagtagcatattaaaaggattttaccctatgaccaagtaggatttgtcgttgaaatgcaaggatttttaacagatgtaaacccatcaacataatacaccacattaacaaaataaagggaaaaaacaataatcttgattaatgcagaaaaactacttgacaaaatctgacatccttttataataaaaatcctcaaaaactaagaataaaagtaaaaaaccctaacataataaaatccatgtattaaaaactcacagctaaaataatactcaagggtaaaatactgaaagctcttcctctgagatcagcaacaaggcaagtactattccacataatactgaaagtcctagtcagagcagttaattaggaaaaaaagaaatgaaaggcacccaaatcagaaagaaataagtaaaattatctctgttcacatatcatatgatctcatatgtaaaaaacatattccacaatttccaccaaaaaaaaaccctgttagaactaataaataaatacaacaaagcagcaggataaaaaaaatcatcacgcaaaaatcagtcacattgctacacactaacactgaacaatctaaaaagaaaactaagaaaacaattccatatacagtagtatcacaaagaataatactatttagaaattaaccaaagaaataaaatttttaccaataaaatctataaaacttttctgaaagaaattaaagaagacataaatgaaaagaattgtgttcacgaattggaaggcttaacattgtcaagatatcagttctgcccaaagtaagatataatgtattccctataaaaatccaaattatgttttcacagaaatagaaaaactcatcccaaaattcacacgaagtatcagagaacccccaaacagccaaaacaaaactaaaaatgaagaataaaaccaaagcactcaaacttcctggtttcaaaacgtactacaaagctacagtaatcaaaacagcacggtactggcgtaaagacaaactaagaaataaaatagagtccagaaataaaccctcaccagtgtggttaaatgatccttgaaaagggtgctaaaattattcaatggggaacagacagtcttttcaataaatagtgattgggaaaagtgggtatccacatgcaaaagaataaacttcaatccttacctaacaccatatataaaattaattcaaaatagattctaaatataagctttaaatataagatctaaaactataaaactcttggaagaaagcatgaggcaaaagcttcatcatactggatttggcaattatttgagtatgacaacaggccataggcaatgacaacaaaaaagacaaattgagcttcataaaaattaaaaattaaatgcacctcaaaagtcaccatcaacagagtaaaaagccaaaccactgaataagggaacatgtttgcaagtctcatattggataaggggttaacatccaaaatatacagagaactcctaaaaacacaacaacaaaaatctgaatcaaaactgtgcaaagaacttgaatagacatatttccaagaaagatatacagatggcaaacaagcacatgaaaagatgttcaacatgactaatcatttgggaaatgtaaatcaaagctacaatgaaatggaatctcacaccaattagaattgctactatcaaacacacacacacacacacacacacacaaaacaagttttagtgaggatatggagaagttggaaccattttacacctttgatagaaatgtgaaaaacagcatggcagtttctcaaaaagttaaaaaatagaactaccatatgacagagcaattccacctctgggtatatattcaaaagaactgacagcagggtcttgaagagatatttgttaatatgttcatagcagccatattcacaacacccatattcacaattactaaaatatggaagcaattcaagtgtctattggatggataaatggatacacaaattgtgatatatatacacaatggaatattattcagtcttaaaaagtaaggaaattgtgacatatgctacaacatcagtgaactttgaggacactatgctaaatgaaataaagccaaacacaaaaagacaaatattgtatgatccaatttatatgaagtacttagggaaattaaatcataaagacagaaagtacaacggtggttgccaggttgctggtgggaaggaaaaatgaggagttgttcttttatgtgtataggctttaagtttgcaagatgaaaataattctggagatacttggtggtaatgggttcacaataatatgaatgtacttaatgccaccaaactgtacagttaaaattgaataaggtggtgtattttatgttatgtgtattttactacaataaaaaagttgaaaaaaaaatgaaagaaaagctttgtgatttttttttctttcttttttttttccgagacggagtctcgctctgtcgccaggctgaagtgtagtgtcgcgatctcggctcactgtaacctccgcttcccgggttcaagtgattctcctgcatcagcctcccgactagctgggactacagtcttgctctgtcaccaggctggagtgcagtggtgcgatctcggctcactgcaacctccgcctcccaggttcgagcgattctcctgcctcagcctcccgagtagctgggactacaggtgcgtgccatcacgcccagctaacttttgtatttttagtagagacggcgtttcaccatgttggccaggatggtctcgatctcttgacctcatgatctgcctgcctcggcctcccaaagtgctgggattacaggtgtgcaccgcagcgcccggccactttgtgattttttaaatgtgacctgccccaccccaaaaatacatagatagggaactcttcatggtaatcactgggcttgaagagatagcattaaccttttttctaatttggccctgagactgaaaaatatatatatccataggaacccatacagaacttacgatgaatgtccacgaagtaaaccaagaacattccccctagcattagcagagagcattctaaaatataatttagtttcatcacagaggaagcttacaatgaaactggagctacattcaggacagtctttaaggttcaggagaatgatttgctgattcaaatggacaacagagaaatctgattaaataataatatatttatgatcattactgtttattaagcttttactaatagtgaggataatcttcagcattcttcattaactatcaatcgttttgcttaacaatctgataaggtccacctatttcagaaacaaagatcatgagattaagaaaactgaccaaagtaacaagcacagtaaggtgttaaacccacatctatctgaatccaaagtaaagaaatttttggggggggcggagtgaggaggtggaaacagagtctcactccgtcacccaagctagagtgcagtggtgcaatctcagctcactgcaacctccgtctcccaggttcaagcaattctcctgcctcagcctcctgagcagctgggattacaggcttgcacaccatgcccagctcaatttttggatttttagtagaggcagggtttcaaaacgttggccaggctggtctcaaactcctgacctcaaatgatccgccagcctcgacctcccaaagtgctgggattacaggcgtggccaccatggtgggccccaagtaaagaatttttaactaggtaatttggactttcaaaactgggacatagttggtgatttaaaataaaaatcctcttgcaagaatctgaagctaaaatgttccaaagcacaacaggagctgtgaacaagttagtagtctataaggagaagtataaatacattggaagaattaatctagggggaggaatgtggtttaagcagtaattgataggtgaagatgagcacaaaaatcagaaaacacataactgtacctgtaagttgctattcctttaaatcttgccttatttttaaataaataaatatgctagaaaacatttattctttgtggttttagtacatagaataatattttaatttccaaataccacaaatgaggtctaaaacatgattaaataattaactccattatccttacaatagaaaacttagctattcaaacaatgaagtttcacatgggtgatgccacctcctacattgtcacacattaaaaagttatagtcacaggtttttaaagaaataacagcttttccgggttaaacttccaatctcaagcctattcatgatgataaatgtcacagggtcaaagacctacagggaaaatctacgttagctctaaggtgggttaaccagtacacactgattaatccaaaatccatttgttaggaacaaggcaagtactacacacccttcattttgaagatactcataaacccaattaacaattttcaatgacaaagcttgtccctttgtatgtatgtataataacatcatagaactctatacaagcacatacaaaacaaggtgaaaactgacttggccatacaggtttgcaatctaactagaaagcataaatatcacaaataaatagatgtaaatacaattagtacattgataaacatacttcatactcttatgcagtaaatactcaaaaaaataagcaatgaaaataacatagaatacttgttgaactgactaaactcatcccagtgaagtttcctgaatacattttccttgaatttttattataaaactgcagctaaattttgcctaaacaagtttatccctaaatgtaaacaatgcatccaacattatagaaatcatcaatttttaaaaatctgttgttggtaaactattaacgtcattatattcaaaggaaatgttaaaattattaaaattttaatattttaattctaaaaactatatactactatcaacatttgcttcacacatctgcaatatgaaagtggtaacgtctaaaggtttaacattttaaaataatattttcaccttttagccattgcattatatcaaagttatgcaattttttacctttttattattattttttgcattctctccctttactggagattattgccttcttctctgacatcataactagataatatctcaatgacctgttactgtatccttggataagaggagatagcatctccagtaaggtcaaatatgagtcaaccatgtgatatgggtactgaaaaattccaattaaatcttaaactgacctgacagaataacagtatctagaatgagggagatgacattcccactctcatcagcaatggtcagatggcatgatcaatactgtgatacatgacccagaagcacaataatatcctaagaagggggaagaggaagggtgaaagactagaatcataacatatttggaatggtagaaagaatcaagggtattacatgttgactatgcgattaggaaaacaatcgggatagaaaacgtttcaaatgtttgaaaacttcaaatgagattactctgtatgttcccaaggcatatactattaataaaatgatgggttgagaatactagatacaggtttcaactcaaagtaaataagaacctcttaacatcagaattgctcacagatgacgtgttgcttgaaatattagtgaacatatttcaagcagagactggaggtgtttaaagcagttttacaatatgattctattagtcttctcaaagctcagaattaaaatatttaataatgctgagtggtggatgtttttacagtgtggcctggaatctgcagttatcaacctacaagtgtctgatttttattagcaaagtattaaaaagttgttcattttcccaatttaagaagaagtttatgcactggacattgcttttcaaaagttattttttgaatagtggtaaccaaaggttggggcttgcgtagtggggagaatggggacatgttggtcaaagggtacaaaatttcagttaggagatataaattatggccatctattttacagcatgaaaacacatagttggtaacaaataatgcactacacacctgaaaattgctgaggatagattttaaatgttatcaccatacacacacatatacatacacacaaatgataagtatgtgagatgatagatatgttaagtagcttgatttattatttcacactgagtatatatatgttaaaacatcctttgctcaccataaatatatacaatttcatttgtcaattaaaaataataacaaagttacatatataattttttttatttcaagtggtatggctttatataatgctgaatgactcactgactgattgaatcactgtcattcattcaacagacatttattcagagcctggtatgtgccaaagactgcaaagtggcatacaaaaagaaagaataagacaaagcctatgcttataatatgtcagggtaagtagacacccaaaaataatcattttcaaagtttaagatcttattctagaagcctgtgctctgggagcacactggaatggcatttaactttccagaagaatcaaggaagacttcactgaggaggtgatatttgagctgggctttaaaagattaataggatttaactagatagcaagggaatggaatgatatttcaggcagaagaagcattatgtactcagaggcatgaaagtacatggtgtggttagtgaaaaaggcaagaaatttggtaaagctgaaatgtgaggtataaagtatggaaagagtgaaaataagactgacaaagtagatcatgactaaatatttggggtcaatataagccatgctaaggtgtttgggtttaatcttgggcacaaagaaatgttttcaagtagaaaggtaacatggttacatttgcattttagacaatatatgtgcatcatgtgtgagaaactcatttctataaatactagtttttgccttgaaacatttcagggggagtggaatcctcgagttactggcaccagcaagggtaaattaatgggcactagatggcggcatagagtgcccaattcttcataatatcagttactatttctgagcctgtatttttgacttaaataattcctttattcaaaaatcccattaaatgaatatgcactatttagactgattggcatgaagtaatagactactgtaaggggaacacgcattttttaaaagaggtaaagcccatgttggtgcatgatggaaaaggcagttgaggattataaaaatatttggataaaattaaaaatacaactttgagttcaatggaatcttaaatttctcttgcagaagttgccattcgtctttaaataataatacatatatgtgtaaaacacctaaacttcataaagtcatgttatattcaccatctgtcctcttcttcaattaccaccattaccacatggacaaacattacaattcacattttacaaggaacgaaactgaggctcatgtaaatgtttttcccagtttatatggtacagttaataaataatagtaccaaaaccaaaactctagtttttttattacaaatccagtctttggttcactttgtcatgtttcacaactgaaaaacaattgggaactaggacaagattaagacaaggaaatgatagaaccaaatgattctaatgccattctgtgataaacagagagcaaatactgtaaattggattgtatattcattaagcccatggtttctgacaattattttggaagaatttacatgtcaaagaaaattatgaccaatatttagttataccaaggaatttacattggagaagctctatatatttttaatgtttggttgataatatgttaacaagatgattagtaagaaacacaaaaatagtttgtaacttaagatgtaaaagattccaaataactataaattccctatggagaagccatctctgccccatgtcatcatgcctttaaaattagacgcaaaagtttgaatactcaacagtagaattgtttatttagtagtgtggaaggtctacctctgtctatttcctgagggaaagcggctataatgagcctgcctgaattatgagaataaagttttccttttttaaagagtttattctaacagataggaggtaacttttatttctgccttcctctcttgccactccatccccagctaagaatccaatccctcaagagctgtcatcgtttttgttgttgttgatactctccaccaagacaaactaaaccagactgagaccatgccattttagcattatgaaacaagaaagaaagcaaaagtcaccaacagagcaatacaggaatttgagatgtacagaggaactgaaaaaagaggagctgataggagcattctctttcaaagctcaatttagtgttccaactacttaaaaccctatcacaatatactctatgccatcagggaagaaaaatgccaattttaaaacattattttcacttttttataaaaggtaaaacatgttaaggtccatacgtaaaatctttccaacacatcagttcatctgcaaattagtagctgaagtctgctcaaacgcagaggaaacttccatttaggtcttgaaaaagaatagagctcattttaaaacatctttatttatttgtgcaacagtgagtttagaaacaaagtatccagtgtattttcctagagttaaaaaaagaaatatttttattgagtacattccaaaacaattaaatattctcttaccccacccttttcaccaactgaatagttttcgtttgactttgaattaccacccacttactgatttacaaactggtcaaattcagcatatatacccacactcatacaaaatgcatttcaggtttccctttttggattaaaaactaaaattttattttacagtgagagctaatttgttaggtaagacacaattaaaccaagaaagataaatctaaacttacttacttcttccaaatttgaaaattgtccatgagatcttcaccaataagctacatcttttccatgctttatgatcataccccattttttgtatgcaaagaagaaaggggactaatatctttgatcataagtgttgagatcctaaattaaatctaagatttggggccttattaatacaaagggagaaaatagttaactgaagatgtcattagtaaaaattttcattaacttctatctctataatttctggcctttccagttttcggttgcatctttctagaaatgcatgtccttttcctagccttagctctgaaaatattgcttctacccataaaatgtcatgttgataatgctttaaatattgaactataaaatttctatatcagaattaatgagcctatttcatgttttaacactgaaaatacattctaagagtttagaacttctttaataatttgtttaaaaagtagttgaaggccaggcatggtggctcacacctgtaatcccagcactctgggaggccaaggtgggcggatcacttgaggtcaggagtttgaaaccagcctggccaacatggtgaaaccccatctctactaaaaactaaaaaaaaaaaaaaaattagccaggtgtggtggcagccgcctgtaatcccagctactcgggaggctgaggcaagagactcgcttgaaaccaggaggcagaggttgcactgagccgagattgtaccactacactccagcctgggcaacactcagcaagactctggtctcaaaaagaaataaaataaaataaaataaaataaaataaaataaaataaaataaaataaaataataaaataaataaaagtagttgaaaccagaaaaaaagagatcatctaacatataggagtagaattttgagatataaagttttactccacattttctttgtcactaatatttccccactattccttgcactcataagcccttattttcagaatttattgtctattatggttttaatatgtgtcccctccaaatctcatgatgaaatgtggtctccggtgttggaggagggcctggtgggaggtgtttggatcatgggggttgatacctaatgaatggcttggcaccatctccttggtaataagtgagctctcactctaagttcacatgagatctggttgcttaaatgcatgtggcacctcctcacctccttgctcctgcttttgccatgtgaagtacctgctcctcctttgccttctgccattactgtaagattccttaggcctccccagaaaccaagcagattccagcaccatgcttcctgtacagcctgcagaactatgagccaattaaacctcttttctttataaattaacttgcttcaggtatttctttatagcaatacaagaatggcctactacactctccaggaagtttcaaatcacgtaagactaaatgttagtattcttactgcaagccaaccagcgtaggttcaccctcttttattttgcagcgagaaaaacaaaacaaaacaaaactaaatccatagagctgattttgatttacagatacattcattttatttataggtatcaggcatacttttttccaagcttcagacctccaatgagaaggcaaagcctaatgtggttcagtcttattacctggctaatttgaaaggcaaaataaatgacagtgaagaaataaaagacagctaaaccagatgatgttggtttgtaaactttaatgactacttattaaaattttgcaaaaaatgaaattggttattatctatatcagtgatttccaatggtggctaccagaagaattgcttgggaaccttttaaaacataccaatgccagagccctgccttacaccaattaaatcatatttggcagtgccaagtttaaaacatacctgaggtagcattttgttaagactgtttaacaaagttatcgagaacacaagctactttcaatctgaacttcatttgcctcatccccaaaatgggcagaataactacactatgtggatattgtgagaattaaatgaaataatgcttaagaagaatccagaacaatgactggctcacagtatgtactcatttgtaggtggtattgctattagagctcctgttgatctgcactggtaaaacctgtaggtgttacagaaaggaaatggtatgcctatgaataaggaaaaggaagaacactctttaaacatcaatcgcagccagcaatgtgctatacccatgagacataggaaatacagcagcaaatcatacttagcattcctgtgatagatgttagccttaatgaagtatcttcatgccatacacaggaccacaaaagcctctgtgggacccaacatacaatttcctataataactcgtgaatcccattcattaaattagtcatattgaacattcttattcaatttctctatatctaatgccaataaactaaaaaacatgtagtatatgttcctatttatatctgcatataaacataaatacatatttttacatatatatgaaacattaaaaaacagaggtaatttttttgtctatataattttcccgtagtggccgaatttcctaaaataagcatacatcatttttataagtaagatgctgatttcattttaattaaacaaataaaaagtcatatatatttaaaaatacaaagaaactacacctttctacaattaatttattagaagtttgtttactggtattgttattgtctgcactgaccttaagcctccttaaagaaaaaaaaaaggcaaacaactaaaatgcaatcaatccagtcaaattcatggtgttataaagttcttcagaacagcactaacatggaagacttttataataggaaaggaaaaaccaaataagagagaaagagaatataaataaattattcagccctccctttcaaaaagtaaagaaaatattttcagaatagattatttctttcattatactactgacatattctttccctaaattctaattctgatcctaatctttttctctacttcttttttctcctcatattttaagattctaagattgttctcaaactgttggcaactgctagatcacttgatgagggttcaacaagcatgtggaccaccagttttagttggaagaatgccattgtttacaatctttcatcaaggtatctcttactggctcaatgataaattgtgtgagccatagatcaggtgaaatttttatccagaaaaataattttaaaacatcttcatttgtactgaatcagaaaatcatgacatacttagaggtcactgggattaatactgaattcgagatggctctgtcaggtagttctagataatttgcaataagcatcaacccagaggttacgaaaaggtttctcactgaagactaccttcaatatgtaacagatgctaagtcaaaaattatattacacacaaacctaaaacgttgaaggttttaactcggaagatggagaaaaaaggattcttaatccatcttttgacagcactcagtcctataaagttgttagaaaaaaaaagtcttcatgttttgcacctggaaattatttttaaatgggcttaataatgtggcatcaattcctttcccccaaaatgagtaaacacatcaaatgttgggtaaaagtcatgttctcagtgatcgttgagccatatgtaccaaaattaatattctaaagaaattctgctatcttgtcctcaactaaaaatcttgttgaccttaaattaataggtcaaggctacttaagaattgatatgtatgacttaataagactacttgaaattataggaatagtttttataggatttacaagtattatgaagaaatagtttttcattttttcattcatagttgcaaaatgtaggttatgaaataactttaaaaaacaacatttccattcatgtaaaaacctccctctccttgctatgggcaagtctggttctccataccgtcacaatgacactttcgcagtcaacatcacagctcaggaaataattattaaaaacaaacaaacaaacacaaatatctattatagagtatgggtttttagtgataagaaaaacaaaagtcatcaagcatttcttcacatattcacagaacaaatgccaagagctgatttagaccttccaacttaaaatttaattatctgctaccacatacgttagatggtatctgtttttccacagtacagtaatatgttgatataatgcagaatccaacaatttggtatgataaaggaattttatcaatactttcttctgctttctctctgaacatatttgtcatcatctttgaggctgatttaccagttttgaagcaatcctgcgcattacttgtaactgtttttgctatgaggagtacaattctgaatgaagtctttgtagttttgatcttttcacctttagtaataaaagtcatctattttgtaccagaaaacagtaaaatggcaaaaacaaaaagtttcaatagcttcctttgattatttgacaaagtttgagaaaagacaacatacttggaaccagaggaatcaggaagaaaaaggactgctggtatttgtcagtgggctttctatttgtgcttcttaagctgattgtacgaaatcctcacacctccatgttcactttacccagcacttattaaatgtacattttattgctccagaaaactattcactatttatacttataatcattattgtacattattgttagaattttcatatttttatattttaatgaatctcctttaaactactgatgtatttttgtgaattggaaatacaacagaaaagtaacaatgaataatgcaaaatttaataaatgtaaacaatctgcaagttatgtaaaacatattaacccggacatattatatactgtatcctgttaaatgcctgttggttgagataaacacaagcaaatcagtttcaggatctaattggtggtgaacagctttcactatagtaaagttaactttatgtataacgaaattgtttacaaggcctgcattccacacaatgacctggaattgtgacagttcctcagtcccagagatgctatattcatgattttgcaataaacaaaactaatacttattaagagctaagaaaattttctggccgggcgcggtggctcacgtctgtaatcccagcactttgggaggctgaggcaggcagaacacgaggtcaggagatcgagaccatcctggctaacacggtgaaaccccagtctctactaaaaatacaaaaaaaaaattggccgggcgtggtggcgggcgcctgtggtcccagctacttgggaggctgaggcaggagaatggcgtgaacccgggaggcggagcttgcagtgagctgagttcgcgccactgcactccagcctgggcgacagagcgagactctgtctcaaaaaataaaaataaaaaaagagctagcaaaattttctaaattaaatcctaaatcttttcttaattgtatcacatcttcacatacacacaaatctactatttctatctcaattcagttagctttatattcctgaattggtttgactcagatagaaaagttcccacaacaactcattttgagaccatttcaaggtctgcctatttaatgtagtttaaatcctatgtcaaagtcagggccttgggtttatataatttatactgataaatcataatgataatcataataatatctcaacagaaatgtctgtcatttcaggtaagataaataatcttgactaaattaaaacaaatgttgaggtaattattactatgtacatttgaaagcaaccataagcttcacaaaatgaatcaaattcacaatcgctactctcacaaagtttatgtattaaggactattgcaaaagtcatccattagtcttttcttacacaaataggaagtgaaaccaatgatttaccctttgtttacaaagatgtgactatttttaaattgttatttacatttaaattgagcatttatttagcacttgtcttaaaacagtaatttttggatgatatataaaagagtatttattaaagacttctatctaaaaaaaaggatttataccaatccatgcacatattagcttacttctacaacctcacctttcacaggtacacatacttgaacctccaaacttactccattcatactgaactatgtgaactatatgcaaacccatgaacgggtcatatactttttttttaatgctaaactttttaataagctgtttctcttcttataaaacccttaatacttgtaactggctaattcctactcaccttttcagtgctctcttagccatcatgtcctgtaggaagtcttccctgacttgggttaagtgccccttcttgtgactctatacctctctggtatatagagagaggaattatcactcaacagcaattattataagatattgaaaatgtccagtgcccagcctgtctctcccactataccatacattctcaaagaaaaggagtatctggtggttacttttttatttctagcatctagacaaataacaagtattgactaaataaagtatatttcagaatacaagttgggtattccttgtccaaagtgtttcgtatttcagattttttcagattttagaatatttgcatacacataatgaaatattcttacaatagaacccaagtctaaacacaaaatttatgtttcacatataccttatatacgtagccttaaggtaattttgtacaatattttataataattttgtgcacctctcaagtgaagttaggtgtgaaattttccacttctggcatcatggcagtgctcaaaaagttttggactttggaatattttacttcagattttcagattatggatgttcaactggtataaggcaaactgtttagtcaatgttatttctcagaagaaagactctcatattatgggccacacttccaattactttcttataaacaacaaagtagtatttaggaaagatttattagcaaggaattacctcagttggtactggtttgtcatggctttagaggtcaatctgctagaatagttaaaaatagaggcaaaataaaatgtaatacaagtttagtttttatttctggaatttttttcacaattgcaaatgttagctgctgatttaaatatgcctttcaaacatcatataaaacagccaaaagattatatcattacatagtacagatcgtaaatatatgcttaaggaacaagtgttgaaaaaaattcccctagtgttatggaaatggtatttgtgtcttctgatgaaattttaagtgacagtatcaaagatgaatttaaaacatgttataactaaaataacttaggtaaaaccaaaaatgatgtggttcggaaaacattgaaaaggtacgaattttataaatgtatgtgacgaatatgaataaaacgttcataaagttaggattgaaaattaacattagtaaattaaaatattattttatatgactttagttataattatgtatatgctatgaaattataagtaaatatttgtctctcatatctaaagctcccttcaaaagagtttttttatgataaaatataaaattcattagcttagagttatttgggggcatgtatgacatttgataaatacatgattaagtgaatgaattaagctctcttcatcttagaaatcaaaactagaattatattatcaaacacctttatgtttgtttatataaaaataattttaatacattttataaattatgatactttaaagaatgtatgcattcctaggggtcctctgaatctctcaatgatttattaacttttatttcactttctataatccctaccataaatattcagtcacataccatctcacgcatacaggcataactggcatgtaaacttaggtaacttttcaccgaaacttttatgtgcagatgacagttctgattaaaggctatgatcaatatgtcctctgatatggacatatggttaaaatatcactgtgtagttttccctacagaaaagggtaataataaaaggatggtaataagatgaaaggtactctacaactctattagaaacaatagaaaaacaaagtcaatccaaaatcataggaggacaaaattacaaactattgtttttaaaataatgatctatcattttttagcacaatcttcaatttcaggtataagcttcaattcctatactcagaaattccaaaacgctgttatttaaattattaatgatttaacggaaattttataatactaaaacttaaagcttaaggtatcttggctaaatttttttgctaggtacattcattcaataattcattcagacatttaggtaataattaaatgactattaaagtcctactatattttgggtagtatgttagttcctatggtgacaatgagaagaaaaaagcagacacaattccgttttcatattactaatgccttgtgggaaccagacattaatcaataatcataaaattattatataactataaatagattttggagagaaaaatgagattccatgatagcatctgaggaaaaaaaattgacatgcttaagaagatttcactgagaaagtgatgtttaagctgatatgatagatgggtaggagtttagagactagcaaattaaagctaatagggaccaggattaatattaagaggttcttttttaaatgaatacataggtattcataggtagtaagagctgttgattagtaaattgttgggacaggaattaacgttgttacagtaataccttcaaaatagtttgttttcctaaattggcgagaaatcattctagaaatgctggccataggatctttgtgtttgacaaacccgtgttttgtaagacaaatttcagcaagttctttttccaattatcataaatttagaattatattttctgtcttcatccagtttcacactgctctaaagaactacctctgattgggtagtttatgaagaaaagaggattaattgacttaatagttccacaggctgtacaggaagcatgcctggggggcctcagaaaacttaaaggtgaaggggaagcaagcatggcttactatggaggagcaggagagagaaaatgaagagggaagtgctacacacttttaaccaaccagatctcggtgagaactcactcactatcatgagaacagcaagcgggaaatttgcacccatgatctgatcacctcccatcaagtccctcccccaacattggggattaaaatacaacatgagatttgggtggggacacagagcccaaccatatcagtgaaatcctaattgatgagactttagccacaatttaatgatataataaaactttctaaagataaaagtgtggttaggcatggtggctcatgcctgtaatcccagcactttaggaggtggaggcgggcagatcacaaggtcaggagatccagacaatcctggacaacatggtgaaaccctgtctctactaaaaatacaaaaattagctgggcatggtggtgcatgcctgtaatcccagctactcgggaggctgaggcaggagaatcgctagaaccaggtagttggaggttgcagtgagccaaaattgcaccggtgcactccaacctaggtaatggagtgagacgctttctcatggaaaaaaaaaaagtgactagaccacagtactatcttgtatactaaagaaatacagagttaaagagatgagattataattatattgcactaataaatggaaattcgtcatctttcctcctgcaaagtttaactaaaagacaaatatcttgttcaggaagaagcttgtcaagttttcattcctatcactgattatcctacaaacacacacacagacacaaaagtgagctaatttaagaaatcataaatttaaattactgagagttttgttataatgtttgaggtatatctaattttcactataaactgtaaatgctattataggagactcagaaaatgcaaaaagctagaaatttcagaagataaaattattcagaatcccatcactgcaaaatgagcactgtaaaaattttcatgtttgaattgtttttagtaataataattttcattctttaattgaatttttaattaatttcaaaaaacgtttatagctaatcaaactctctggtcattcagttttttgtactcttcagtaaagtccacagtaaaggctaatctgaatgctgacatcactgcctataactctctctgttgtggtttagccattttagctcccctttcaagaacagtaattccccctgaactaaatattgttaaccacagataaagaagtacaaaacaaagcctatgttgttttcctgtgaatccaaatgagaaataacgactttaaagcatttgatctatccctttaaaagatgtaacacattggagactataaatcttctccctataaatccaacagagcttttcttatccttcatcgttggaacagtttcttgtttgtttgttttgctttgttttgtttttatttcagttcagaaccatataaagtaactgaattggttttaggtcaaagctatgtattttttggtgtcatcaaatattagaatcactcagaatggcaagatgctcacatcctgagaagtaaacagggatggaagccaaccataactccaatctcactcagggtggtgagttcactaatcagcaagagcttatttaagtggaatagtgagagtacttgctcaataatttgataaaaatttcttttttaaatgaatgcatatggttaaatttgtgtaaattaagtatgtgtatattaactcacatttattgatgagattctactgtatttcatcccaactttcattagaatacatattctttctataatttaagaatttccatattgaaacctgcaaataatttgttctctgcttatattatccgaatgccctataaacctgtctgatacttaaattctgaatgaaacttctaggagatgtaagatgataatatccagaaaaataaagaggaaaaaggatgaaaacaacagaatgtgtcggtataaggacatgttacaaagtttttactgggtttagtctgtggttggtttatcattatattgcaaaaaactctcccataaactactaatgattgtaattcctattaaattgggctttcatattaaattgtttaaattagttctttactctgtaagcataatcataatccattgtcccccattagtcaatttctgctttgtaaaattaaatattctgaattttaacatgtgaggcattgaaatatacaatgcttttcacatacccaagacagaaagcctatgactaaacttatgaagaaacaaactatagagaaatagctgtgaaaaaatacttcttattgtgataaaaatatcaaatgatctgtttacagggagcaataaaaggcaccatttcaactttcaacataggttgttccttttcatttgtatttccaggaaagcgctgaaataaccaatagtcatccagtttaattattctttaaacttttttaatttaagctcaactatttgaatcatagcaagtttgtaagtttcacaaccaacgtcttaatattaaaaatgaagaacttaggcttagagagattgtatgaattatctcacatttttgcacttactcagtagcagcattagaacccaaactcaaatcttttccccgtcaagtattccattagaacactacagcatgttctattttgagtctctctaggctaagactacatagttcaagtgaaaattaataatgcataattaattatttgccaaacaggaggaatatttaaggttaacctttatcatgcaagcaacaattacttagataatacaaaatcaactgatttgacactttgattattataaatcacaaaacaaataaaaaactaggaatggctcccaggttggcccatagagggattattaagatccctacatgtattcataaaagtaatgcaataattttgatttttcttagctctttatgcttttcacactcaatattttactcttatagtgacttacaggcatcaggaaaatgcagaaattaattataagaagtgttaggacttgcctcaattctcctgctaatccatgtagaaggtcttcaacctcaggtctgagttcttatagaaatcaaaacttttataggagtccatgctttcctgacaacagacaaacattccaggggttccttgagacaaagccatgtacacaatgcaggtcccagtttcttggacttctttctattatcactaatatatatagccatagagtaattttaacttacaaacttttgctccctccaacttacaatcttttgctccctcctggtaatctctctctctctctctctctctctctctctctctctcactgtccactagccttggaagaaaccaactgtcatgtcataaggacactcaagcagccctacagacaggactttgtggtcagaaactgagacttcctaccaagaaccataggattaatccattttggaaacagattattctttagatgaccactgacctggtcaatatcttcactgcaacctacaagaggctctgaactagaagcacccagtaaagcaggtcccaaattcctgacccacagaaatagtgagataaatgtttgttgttttaagctgctaagtctgtggtaatttgttatatgacaatagatagcaaacacccactatgagaaatccaggttaactactgaatctgtttcttcaccgttacaatgagataatagagatataaatatctaacatatcgcattgttgtaaagataaagaatataaaaaacactgtccctagaagacagtaaaagctcaatgaatgtcattttttatttttctattaatattataactatcattatcaatctcagaagtttgccatgtttcataatcttttgctggctcatgtttacttcattagctgagcaagtgaaattcatacactaaaataaatacagataattgaaattaattatagagaacagtacaataaacgtattataagaaaacactaagaatattttcatagctttggggtagaaaaatgttccttggcataatccaaggtaaagaccctcaaaaagttgagagatatgactacataaaaattgaaaacatctttagagtaaataattccatataaaagttagaagtcaaatgccaaaagggtgaaaatattttatatatgtcaaaaagtgagtatctttaaaatacagtcttacaaaataatgagagatacatataagcatgtatgggagtgtgtaaaacattttttacagcagaataaaacaaaaacatgcaagtaagtgaatggaaatttcacagtagttcaaatgactagtaaacatataaagagatgctcaaaaaataaaggaaatacaaaatgaaaaagtcatgggtatcactttttaccttggcttagactgaaaatgtttattatcgatgagagggtagagaaactagcacaaccctgtgagaggtaaagaattcttgaagagtattctggcaatatgtatcataaccttatatgtgctccctcatgcccctgcaacctggcaatgattttatcctaaagaaataatcataaaagtcacacatgatttgcaaagagtcatggacactgatacacataaatacttgaaaaacaagcatctttcatatttttgcattttaacaagttagcttatagaataatatgtattatatgttgccatttttgtattttaaaaagtgtcttctcttcaaaagttattttaaaaataccgaactatactaatgattgcgtgagggtatgtggatagcatcaggaggatcttctgtttatatccagaaaataataaaccataaagctacctagttgtttaatagtcaaatcttaccatctcaattttatggtacaccatttatgtaagtggttatccatatttcattatagggtgtttgggcttaatatgagaaaaggaagagcaaagaagtagaataaggaataatgtactctctttatttaaccagaaaatatggattgagatgtagctacttaacaataacaggtttgtgtctaatgagagcctcaaggagttggagtcattctgttgtagcacatatctattccagaatatatgtgcttgtataaattctgttgagaataaaaataatctacatactctaattacttaaacataattttcaaaattattatagagtcaaaacagttaaccccttttcattatccttctgtcttctctaacacctctggtggatgagctgctattgcaactgtcattgcaattattgattgcaatttttgtcattgcatttattgatataagaaagtttaaatccattaactttaacttcgtatttcttttctgtcccatgtgttctttatttttttttctctttgtctgcctttttttgaaatagttgagtattcaatgttccattttatctctattttggccttactgttatatctctttattttgtaatgattattgtagggtttacaatatgtaacttttaacttatcaaggctaccttgaaataataatataccacttcatatataatatcaaaccatttcaacaacacacttctatttccctgctccaattatttatgtaatttatgtcaaacatcttactactatataacccacaatacattgttaattattttgctgcaaagtgttaccttttaaataaaattttaaaagaaaaaagtgtgttatatttactcatatatttaccatttctggtactcctctttactttgtgttattacaaatttccatcttatttggtatcattttccttcttcctgaagaacctccattaacacatcttgtagtgcttgtctgtgggtgatgatttctctttcagcttttatgtccccaaaagtctttattttatagaattctaggttgactctttttatctttcagcattttaaagatgtctatattagtccgttctcatgctgctaataaagatatactcaagactgggtaatttataaaagaaaaaatttaattgactcacagttcagcacagctggggtggcctcaggaaacttacaatcatgatggaagaggaggcaaacacatccttcttcacatggcagcagcaagaagtgctgagcaaaagggggaaaagccccttataaaaccatcagatcttgtgagaactcactcattatcatgagaacagcatgaggtaaccactcccgtgattaaattacctcccaccgggtccctcccacaacacggggattatgggaactacaattcccgatgagatttgggtggggacatagccaaacatatcaatgaaattctaagtcttctagtttatattgtttctgacaagaagtatttaatatttgtgtcttcctcctgtacataatgcctccatttcctgtctctttctgggattttcttgttatcaattgttttcaacaattttagtatcatgtgtcttgatgccatttccttcatttttctcctcttacttatagttgaaatctctagatctttgtaaatacagttttagtcaaatttgaaatattttcagtggccaggcatggtgggtcatgcctctaatcacagcactttgggaggctgaggcaggcagatcacttgaggtcaggagtttgagaccagcctggccaacatggcaaaaccctgtctctactagaaatacaaaaattagccgggcaaggtgggggttgcttgtagtcccagctactcaggaggttgaggcaggagaatcacttgaacccaggaggcagaggttgcagtaagccacgatgtgccactgcactccagcctgggcaacagagcaagactccatatatatatatttcagcctttgattgtccaagtaatttttcttccttccttccccacctcctttttaggactaacatacaggttaaactgcttcatagtgtcccataaatctctgaggttatatttgtgtgtctgtttcaatcttttttctcagattgtgtgtgtgcttcagattggatagtttctattgctatgtcttcacattcactaatcctttttctgtagtatctaatatcctgttataccataccaatgtagtaaattttttcattccaaatatatttttcatctctaaaagttccatttagttcccttttatgccactcatttctctcctgatcatagtcaagctttcctttaaatccttgatcacatttataataatggttacaaaatatttttcttctaattccgtcatctctgccatttctgaacgttttttcattggtaatttttttcccagttacatgtcacattttccagctttttcatgtaacataaattttattttgatgtcattcatcataaactttttgttgttgactgctgaattttgttgaacttcacaaagtattagacatttttctggcaggctggttaatagcttgcagatcagtttggtccttttgagtcttattcttaagctctattagggcaggcttgttaggccctactgaaaaagaattatcctttttgggatctcatttccctggctattaacaaagtgtctccactttggctgaacaaaactcaaacacttccaatccgcgaaagctccaggagtggttcaccttttcagctctctggttgttctttgccggccttctggaggtttacccaaagtatgcacagtttaatattcagcattcaataggctcaaggcaatccttttgcagatttccaaagttccttgtctgcatatctcccttcctccggtattctacctgcaaattctactgcctcatctccctgaatttcaatttctatctcctaatctcagtgtgatcactgtgctctgtttaggtttcccttctgtacattatgatcaggaaagtacatccaagcataaaattttttctatgcaacagaagaagatattatttttaagtgtatacctctccctattatgtcatacaaatttcagggcttattttcaagaaccatgtcttttatatggtatctggttatgttgttactattttgaaataaaatacaggaattgaatttattcagtgtttcatctttgaataacctgaaaattgtatagtaattccttatcttctcacccaaaccactgatatataaaatactatttaagacgacaagatcaaacaaggtcacttactatcttcctttgggcatacctatattttagccatgcttaactttgtatcattactcaaacaacctcttttaacacccatcttcttgattctatttttaagagaatgagatctatggtaaactgtctaagttcaaatcctgacccaactagtttataaagcaagttatacttaaagcatctttgacttcatattatcatgtccatgtagaaataataatatagtctacctcaaaatgattatgaagaataaaagaaacaatatacagtcaatgaatgtgagctaatgttatcacttgcaaaccttttccctatttctttatatgcaaaccctatccgtaattccatttcagttaaaatgccatctctacaggaaggctttcccgggatccatgctgagaggattctttcttaagatactcatcacagggcatttatgtgatttatatttttcttcttagcttctatactaagcaattaagttcttgaaaggagcttccatgttttactctctcttttttcaaaaagatatcccacagtggacagtaaattgctttgtatttagtaggctattcacaaatacttgcctcagaaaagaaaattaaacatgactatatgggggaagtttttcaaataacttatgaatctccctaaatctactgccatcattttatcaaatcccttgtttacaccaagatacatatgtttgcaaaattttcttagctaacaacccagttaactttatcagaaaaggagaaatgagattagtatgacatgacttgttcttggtaaaataacaccttggtttctacatggtcacaaataatctattcaatatttcagaattttgcaggagataaagttaactctgtaggttagagaattcacctttatttcatctttaatattttatatgtttgcttgtatccattattttatatcttccgattctccaaatatgatcatttctggaagttatgatgttcagtcaaagaaagtttagactttggagcaaaagtccttaggtttggattccagttgttctgatagacagcagtgtggcttgaaaaagatatatttactttcagttaacacatctataaatggagataataaaattttcttggagcatggtgattattaaatgagaataagtgaaaaggtatgacctactgcctactgctaaaaactttttatttgcttccttttggtttcctcacctgcaaaatgcaaatagtcatccctgtttacttttcaggattcccttaaggattcagtgaatacatacattgtgatactttgaaaaacacacattatataaatatgcaagtttttaaaaaaattatggtcattattattcttgaataaaagttaccaaactctgtggacttagattgtaaatttgccaaaatagtctcctattaaccaatttattgatttccattcatttcttctaatttgaagattattcttcttggaaagaaaaatataggcaaaatatttgttcatcatctctgccttctctgtgtcatctctgaaaattatgtcatattctcccaagtaatgcctctatctattcagtctgaggtgacttttcaaatctcttctaaaagtttacgattttacaagagtaaattagagtgttcttgtacacacacacaagagaccaaaaaaaatcagaacacattttcacaaacagctgaaactatttaatatgggtatccttaaaaacaataaaatattatgaacagtaaaagtcaattatttattttatgacagaaatatttcagtgtgattatatctgagtatatcttcaattttttttgttcaggcagcaagcattggtcctttttaccaaccactacaaattatgcaccctaaacattatgcactctatgctataaaatgacaatataaaaatataatccaatctacattaattgaacataaagtacattctgatactcagcttagactaaccataacacagaatttgtcattaaacgttcagttcacacacatacactcaaaactgatccaacaactcctattatgccagttaccagcattgccagcccctttgcccttcactgcctggagaacgtccatcagaaacagggaagcagagcaaactgccacaatgcaccattgatgtttgagcaaggctgcctaagcagctgcaataacagggcaactcttcaaagtgtcagcattgaaacttacaattctctctcccatacactatcaatgaaaacctttataagctacaatcaattataaaataaatctttgagacaaatcatgttctttcttcatttcttctctccttcttttcctcccaaaaccaaatgtccttggttaaaagaaaaattcaaggagaaatatcccccctttctatcttggtctctgcctctgcctctcttatgtctaaaaattctctcaaggaggtttaaggatatctgctaaacacttttgtttacaagacaagttctggggttttttgtttgtttgctgttgggtttttattgttggaatgtttttattttaaaaattcaaaaggcacttgatattttgagcacactcatactagatttttggcaaagcatgtttttgattattaaaagacaatctaaattctgaaatgcatgcaccaaatcacataacctccatatttttgtaaaccacaacaaaagtgcctcatattagctacagatgaatagctaatgagtcagcaaacagttaaaaacattccatgagaatagatgcactagccatgcaaagtttttgagggaaaaatatattaagtatttaaaaactacttagaatgaagggaaactattctttctttaacaaagcaactatgtttaatttgtcttatgattatacctaccaaaccaaatgaaagtttatctgtctttttctatttctccttagccatcaatagttaatgcctttttaaattttgtaacatatatttaaggtctcagaattgtagcaacaacttttagattcttcatcattgtttttatcattcaaacagcatgcgaaaaccccttcaaatataatgtcaaggtataactctaattcctgcagataacaaaaatatatacacttcatcatgagttaatctactacctgaacaatcaaagtccaaaatacttggtatctgagttcagggtgcaataataataaattgccatagacttggttaaacaacagaatttaacaacaaaaatgtatttctcacagttctgagggctgagaagtctgagattagaatgccagcatgaccaggttttgatgaatgcctttgtcctggtttgcatatagtagtcttctcactgcgtcctcacatgatggagggccaagagacagagtggaagcaagcttctataagggcactattcccatcttgagggccccaccttcatggcctaattacctaccaaaggccccatgtacaaatgccatcacattaaagattaggttttcaatatatgaattttgaggtgacacaaacattcagctcatagcatttagaaatctgtaagaatttttagttatcatttctcattattgtcaaagcaacacacacacacacacacacacacacacacaaacacacacacacagtttaccagttaaatagtaccacaaagtttatacaaaatacagcatcccgtatccaaaactttgaccctctgccaaaactcattctagtgtttgcctgatttctaaataatatgcttctattgttatttttatttataaattttagacataatatattaacttcctatcatggcagaagacttagttctttgatactacctcatttccctttcttccatccttccagtaatcagtgaagtaatatttttgaatacatttggtaccttgagtagtaacaatatttccttcctattgttaatattgtcactttgccccccacattcccaaggtttgcaacagaaatgtaaaacctctataaatataatatttcacactcttacacatgaagaatcctattctaattctttcccctgaagacatccctttcgggagttctccatcttctagctcaagtaaagactgcttatttttaagatcaatgcacagaagttatccagtaacttcccttcacctttctcacctcattttaatcacctgtttcctgaaccctctatcttggtcttttctcctcagtttttcctcacttggacgtagcatacccttgaaacaattccggagaaagcaagtgtgggggtacatttggagaaccatgtgtctaaaaataaaaatgttttttctacccttatacgtaattggtagtttgggtgtagaattcaaagttaaaagtaattttctctcataattctttttttttttttttttttttttttgagacggaatttcgctctcgtttcccaggctggagtgcaatggcaaaatcttggctcactgcaacctccgcctcccgggttcaagtgattctcctgcctcagcctcccaagtagctaggattacaggcatgtgccaacacacccagctagttttaaattttttagagatgaggtttcaccatgttggtcaggctggtctcgagctcctgacctcaggtgatccacctgcctcagcctcccaaagtgttgggattacttacaggcgtgagccaccgtgcccggccttctctctgaattttaaagccacatcttctagctttgaatgttgtcattaagaaatcagataccattctggttcttgagccaatgtatgaggcctatatttctctcgggaactttctattatcatctatttattactgttattttgaaattttccaattatgcatcttggtgtggaattgctttcacatttttatgggcactcagaagatccttccaaactggaacctttggggctgaaaaattttaccatatacttttataacagtttcctccctatcattttctttgctctcgcctgccttctgaacttcccattaatcagatgttcagcttgttggatcgtttgtttgatttttatctcttctctcctattttccatttatttgacttttttttgctctattttcaggaaaatttctatcatataaaagcttatttcagttattataaaagtgcttattctctggttatttcttctttttatataatcttgtcatgtttcatagtagcagtatcttctgctatctctctgagtatattaattatactttatttctacttcagctactgttttctacaggacatactgcctctaattcttaaacaggttctggagtatgaactgtcttgtttctcattgacacaacactctccagtcacatgtattcggctttcccatttctgccagttcctcctttacatcttccaaaagttgtgtctctttaatatgttgcttcctcttccttatgcctgtggatttatatattttttagtcttttgctcaaaatttttagtcccttactaggaaggaacatggaaaaacatgtgttcaatcacgaagtttaactggaagtctgctgttaaatttcctgaagatgttaatcctagagctataatcatgctattcacagggtcataaaatcatagggctcttactataaaaaggttatcagagatcatccgattcaaccctcttattttataaaagtgagaaaatggaaacccaaagaggttaagtggtttgtgcaaggttatttaaatagcaatccatacatttggtatttgacttgctttcattaccatagtgcctcctcaaatagatatccccttaaagtagtgactcagaagactcccagacacatcctagggttaacacatttgaataagccaatctagcttttggatataaaatggaggagagctgtcattaaagaaaatctgggaaaaaatgtctccaagaataaatatttgactctggacatcctgttttctactagtagaaattccctaatcaatactctcccatgaaactcattccccttattcagcttcagcataacacacttatcctaacttttactctttcaggttacagaatcacatcatattttctcaaagcaaggtaaatctgtgtttgaaattcaaatgaatcttttatatctttcctaagtttctaccctcaattccttcctgacctctggctggccaccaacctcctactcctaaaatagtccttttttttttctgcaaatggcaccacccaggtactcgagaaaaacatcttgagagtcatcctaaacttctctttttctttaacagcatccaacttccaccccttcaccgatacagtacccaaatcttatcaattctacttcctaaaaatcccttgaatccattcctcttaggttcctcatagcttcacagtcactgtttcagttcatgccctcactatacttcaccctgatttccattaattgtcttctaacagtctcacagactctggtctgctttcttcataccccttcttccacactcaattgctgaagtgctttttctcaatagaactaagaagtcatttcctcacttaaaacccttcagaggatcccacctcatttctgacttcttagtatagcatatataaggcacttcatgataggcacctacttatccctccatcttcatctcctgtggctcttcaccttgcatgttatggaactagaaatcagaaaatcaaaagtctcctctcgggtttctattcacactggattttcaacaccaaatgccaaatgtcccttcccctgtcttctcccaaataaaggaatccaacaaaagagagtgaaaagattaaaaaccagttaaaaccatttaaaattattaaagtgcttttaccataatattttacatttatatttataatattttatctttatcttttagggattatagtctgtttaaatatgttggtagtacattaaattattattcagaacactgaagatgtaaattaaatatgaccataacaataataattagactcttatcatgtgaaataattaaggaattaacacattattatagtaagggccaaatctaagaaatgtactataccataccaccagactgcacacttttagtagacaggactgtgtcttaatcatctttacattccctactatgccaaatactatccccaacataatagatgcacagtgaattagtaaatgattaaataaaattagaaataatatcacacccacaaacccgggaagcaattatttgcctactacttgatgaggccaataattcaatgatatttattattatagttgatcgagttagtcaaatgtcatgagtgcctcttaaaaaatttatatatatacacacatttttctgcagatctttatacggaacatcaatctaatctttatttgggcatataaatcattcaatggataacacagtgaaaattttcaacataacagaaagacatatgctatttgaaaaatcagtaaaaaaaaaaaaaaagatgattctattgttggtattcttatcttcagattgtcctccacagcacatccctctgatacagagaaataaaaactttcttacctagaactctgatcaagttactgccttttataccactataatgatattcaaactggcttctaagcaaaatagaacagaaacattgcacatgcacatgcacttgaattgtacacttcttctatcgtatcaacttcatgtaccatgatatgctcgccattaatatgcactaaagctaacttgctagcctgccgcaattttattgttgcagcaaaacaatagtggtggattaacccatcacctcaagtttagcaatacatcctggaccagttatagatatgcattaatccacaacttaaaatgtaaaatatcaaggagctgggccaatccaggcatatgagtcaagaacacagcacttcaaacatatccaaactgaaactggttcttttctctgcctagaaaggtacttaacaatgggttctgaatatcatgttgactgacaggtatgtcatataaagaaggaaatcctcttaaatcttacctccttaaaaatatcaggtttaacagaagagtatgatgtgtagatccctactagatagaagcctgaatacctaacccattatataaatagtatgtattgtatagtatataaaggctgcgattttctgggctgctgcctactttttatgttttactgttgtcttcatgtaaaataactgtatggaaatggtatacctaaagagacaaaacgggtgaaatttaaatcaaccaactaaagaataaacagtataggttaaaaaggatacatgttaacaaaatgatgacacacagcagaataaagaaaatatatgaagaatacacatctgagggcaaaaggctgaggacagttgaaattgatagaatttgtaatgactgaaataaaagcacaagaaagagtagagaagaaacttgaataatattcatagataggaatgaactgtggaaattccaatgccatgataaggcacgatatagaatgattgtatttcttttatccaaaagcttcacgacaggtaaagatagactataatctgaagaacaaatagacctaatttccattataggccccgaaagtgaccaatagtgatacttataatatttaagaaagcaactgggcacttaactttagattataccatttaaatttttttcaacttgggaaaatgtttcaaattccactttgctacctacttgctttattttttaaaaaattagaaaaatgccatgtaaatcactgtagatagtattgcattgcttgtttgaaaaaaaaaaaagttgacagtttgatagtgcattcattcttatgcctccagcactgaatcaaccactataacattcaaaccaagaggaaactttcagcagtcttgatgctgtctcctactctgaagtgtgagtctcttttctacaaagagcacatgcttagggaggaaaacaggatatgaaattacacaaaaatatgtgccccagcattcagaaagaaagcaggtaaaagcttaattctcctccaaaaaaagcagtttctaaatgtggattcattaatgaaaacttacaacctagcagtcagcagaagcatttaggaatggaaggcatacagtacaatgccaactattagaatcagtgttctactaccacacaactattctagcttagctaacagtcttttttgtcacgacttttgtttctttttcctttgtttcctctgttttcaatcgggagagaactgtgtgaagctgagtgttcgtttaagtcagaaacacgttggctagatctaggttcagtgtgggtgagtactgtgtaagcattccacacacctccactaatatgccacgaactctccatatcccaagctttctgataggattcagttgagactacacatagcgcttttacttatgtcacacatgtgatctcaggtctcagcacgtactgacataggtagttaccatcaaacttgctcttctcataaatcctgagaaaaaaaggtaggttggaggtagaaaatggacagaatgtctctgctaacctaaacagaactagtatgtgttgctgctaaaatattccaatagctggcagcaatgatccataacattatatttgtaatataagtatacataaacactacaacagatgatctcagattgtcattgataatgatgatggctaactttttttagtatgttacttgtaccaagcattgctctatgtactatacatctcatttaatcctcatatacaaaaaaaaaaaaatattcttgggtaaagttattttcattttcattttacacaaaaggacattgagatacagaaagaaactgaataaattgattttaacatatttaacttatttaaagttaaaacatgaaattatttactaaccctttgatgtaggaccaatggctgtcactgactcttgatctgctatataaagtttcatgttttccttcttgcttaaactacaccatgatgtatcacctatgatttcctgttttggtttatttaaactcaatgacagcttaaaggtacttggaaagcaaactgaatgagggatccttccagctttttacattttttcacccctacctcaggcaatctttcacagttgtctagcccacacctttttaaactgcaatttgttttagcaactcacctttaaaaagtctttccaaagcaccaacttaaatttcataaaatcaacaactctttatatttttgaactcatattttatcagtttgcataattaaattacaattgcacattcatttggcataaacaaattcaaaaacaaacacaaatgactgtagataagcatggcagcaggtaaacagatgaacagaaacacaccattttttcagagtattctgttggccagaagcaggaataacctaagagggagtctactgtatacctaccatttcctaattataaacaatactatttaataggtatattagctttctggaagaatggatttaccatggaaaaatacaaacaaatttagcagggaggttcacaatgataccaaaattctacactagaaaagtaatacattccttcttatctttctttaattagaaattgtaggagacttcttcactgacaaaaactaagagcacaaaattccaccccaaactcaattcagcataagaagactcctacccaaagcataaacatatatactcacataaaaaataaaaaaaacttttaaaattaataaagaaattaaggttttaagaaagaaactttctccctactagagaaaaccatcacctcttggtggggaaaactgaatttaaagttcaggttcgggcagttactacttatgtgatggagtaaatcaattcacctcactgagctatagtatccttttctgaaaaaaaaaagataataataatggttctctcctcacaaaactgtagtcagaattatataaaataaaatatataaagacactctgcaaactatcaatcatcttatacatataaattgttattactggaaatcctagcttatattttggacagagaatttcagagtcaagggaagtcatttcacaaatgacaaggctgtgattcaaaagcctaaattactttcctacttacagtggcatggatgacggagcagaaatagagaattcttgattaaccaggagaagaatatcataggcatgggtgtgagatcaactggagattcaaggaagctaaagtgcccagaatgaactaatgttgtaatgtagactgtgagcagagataaaattccagaagccaaggagtgttgtacggtaagtcctggcagtgc

SEQ ID NO: 2210 - DNA, 809181 bp, Homo sapiens
  source 1..809181: mol_type = genomic DNA
tttttttgcaaagattgttggaaataatccttctcttgtacctagaaacataggtgcaaatttctgatatctttgttttatctgcattcctgcctttcatgaaagtccctcttgattgtgctgaggctgtggctcagcgaagacactgaataaatacgatagccactgttgcttgttgcttgtccaagtcttcctggcttctgctgcaagagggggatatggagaaggtgggccagggtgtgtggacccgggcagaatctggggaagaagcctgccattcgtctttctttcccacaccaccgaacccactgcccttcccacccccacagcccttttatgaaatcagacaacgtggtaggtggaaaacagcagggcctttcctctgggttttcaaccagaagtgatattccacagttttaactggttactgtgaagtccaagcggccagaattgtgaaaatgtccactgaaacactgcaagcggtgtacttaaagacagtaggccttttagattttgttatatattttttgtagtgctcttcacaagtggaaattttttttttttttttacttttttttaaaagatttttttgtaaagaagggttgtatttagaggccagtagctagagatccaaccagtggacctcttgaagcactaccaggccttaaggccaccatccgagggagactgggaaaactattattcacccaagcctccggaaatgtaatgtaccagcaggcaaaaaacagttcttcatgtagtacaaaatgaaacgaaacaaaaacaaaaacagaaagtaaaaatgaaaccaaaacatttcttaaattctagtgccatagcttttttgtttgtttgttttttgttgttgttttgttttgttcataagaaagagagaaagatactacttatccgtcagacacatgcatcctcatgtggtcgttgaactgctcgatttggtcaaactttgctgggcagacggagcagacgtaagtggtcccctccgtgcaggccaccacgcctggggggccagcgcgggcacctgggggtgtgcctgcagggggggtcccattgctggcactgtgcagggccacgtgtcgctccaggagggtcttgtgagagaacttctttttgcagatgtagcactcgtaggacttctctccccggtggaggcgcatgtgcacgttgagggagctcttctgggtgaagcgcttgttgcagatactacactggtatgccctcactcctgtgtgtgtcaccatgtgcttgataaggtaatcctttaaggagaaggagcgccaacagatgctgcattggtggggcttctcacctgttgatgtaggaagagacagcaagcaggacagagcgagacatagcaagggatagagaatgaaggacaggaaaaacaagacaacaaaaaagaaaaataaaacaattaaaaaataaaatttgattgcttaatggatcatcctcgtttggaaaaatccaggccctcctagcctctcatgtgcagagaaattttgctttatggtgatgccaggacagttttgttttccatttccctgtgccataaaacggctttcttggaaagctaccagatattccccactaaaagtcttcaaggtcactccgtggaaaagggagggctacttttgaagggggtcactttcagtgtcctgattaggggatttagtgtttcccattaacattatcaaacaaatagaagaaataagagagaagaaagatcgttggagacatggggtgctctagaatccttgagaactaaggatattggtcactatagcttggttccttggggtaagtccccacttctagtagtctaagaaatacacctatgtgttgattgtgagtttggaaaatatttgccaacacaggaatacgttattttgaagagctatactttcaagtttatctattttagacagaaatctttctaaaatataacttaagggttaattgcctgttctctattgactgtagtgagctgcagattggcctcatcgggtgtagaggctgagtaggcggtgggcaacatgatgatatcagactcaaatgatcctattcaaatctgggcaccaacacactacactccactctgacaaatcaccaaatgcctctgaggtatacagtcctacttacctcattgtgctggtgttgacataaaatacatatgaaatcactttgcagaccaccaagagcagtgtgggaatacatgcatggtattcttattacaaggatacctcccacccccattaaatgcttccatatgccttttgaactcttgggtcaatttttaaaatagttttcctgcgtcctcctttgctctcagcctgttggcggaaacccttgtttttcctcagtttactgctttggtttggcttagaaaccaaatgatcaagtttgttacaaacagtaaggtaaataataatactcagtgcatgaggtattcttaaagtccatgggtccgtgacatctctttaagatgattacttaaagacttgttttctttgtgctgtttgttctcagctctgctcctgacaggtgagatgaactgcgtgtttggtccatctctaccacctcattcctgactgcccagtgtaggccctcacctcagagaaaaaagtccttccatgatccaaactaaaactgaaagcctctgaaactccttaggataatatttcaacatttggactatgcatcaaggtaagaagtcttttaaaatttgagctaacttccacttaaaatatatgccttgactgtttttcattttttcccattatgaaataggagagctttgatgtattatggtaatagcagcaatgaaaacaatcaccatgtattgagtgcttactatgaagcaaggttggtattaagtgctgactatgtagcagggttggtattaagtgctgtatgttcatgatccattttattaaactttctctcatcaggaatttgttgttattgtgttttcaaacataaacagatatgttttgaagcacactgaccagacagtatgctgcgtaagatcacatggttagaagataattttacttttagattaaaacaggaaaggttagggaagcctcattgctaataatctcaatttgctgaagacttcagtctatgcatagtgtttacattggtaccttttttttttttgaagtaagagattccctaagagagacagtcatgcatgtttttagctgaaacatttctgtcagctgtaaacatgcctggaagtcagctggtctttgctatcctcatgctttcagacgatttatagaggctatgataggctggccaactatcatttaaaacatgtccacctgtcaccttttatgggaagcgtgccttaaattccagatggtattttggctgctaagaagttgaaacttcacctatgttaaaatgctctgctgtttgaaactttcaccttctgtgtgtttttcctcgaggcaaggtcactgatgaagactttattttcacactcttctaatctgtctataaattgattcctcatagttgtcatgtttctctctatagcatatataggtatgttgtttgtgtgcatgtagtattggttctaccattaattatccatgtgaccctgggctttttaagtgttttcatttctctgggtttatttcattttctgtatgtgaagagttggaccaggcagttgcacatggtcctttgtggatttagtggtcctgagtccgtggtggactgcaacccctgaggactctagtcctggccttgtcagtgaatgacccaagggcaacctacttagtcactgaatgcattaacagtctcacattttaaataagacaaagtatcctgttcccttccctgccacagaacaatggtatgttacttaataaagagaaatgtttgcaaagaacttgggagctccttaaaggaaggtgctctctataattattaaggtgctgtgatggtgaagtgtaggtatttcagaaactgtcttactaaatggggtatattttcagattagtgaggtgctcacaactttcatttctgtatgaatttgaaacgcagtcactcagcaggaatgaatgattgtgttttaagaaaattttttttcccactattttcttgcatattacttacagcaatcccaaaatggttttagacattatgcataaaatggatgaggtctgtcgattgttgctctccaagtaaagaaacaaaaagtgaagataaatggtcagagatggttttccaggtttaagcctatggtcaggaatggcaagtctgatttgtcagaaggggacacaaagtaaaaagtggataattgaattataacatcaaggggaaggtcatataagttccttcactttaaatgatccattttgggcctatacagatgtaggagtcagatatgaattccatttccttggctgagtgacttgggcatgtcatttaacctctataagcctcagtttccttatctataacttgagaataatatagtaagtacctgtctcgtgaaggcgttttgaaaattgaagagataaagcacttagtacagagcatgtggtcattttaagaaaaattaaactgttccattcatcacaaaggaaccaaggataaatgaaaccaactgcaaaatgacttgcatggcatatggaagtcaatcctgaatttttaaaaaattatttcagataatcagtaaaacaagtgattatattgcagctatgtaattcagagttaaaggtatcgtctactctctcaattacatatgcgaatggcaagaagtggtatatggataaaatgtcagcacagagcacagacagaggatttcctaggaaacccgtgactgagcactggaggcacagaaaccaaacagcaagggaagaaactgagggggaggcagtgccctttactgccttgccaagggtgttgggcgtggtaaaagtatacgtttttctcaatttttcaatgcctgctcatcaccttcttctcaaggaccagctctgacacttaactctaccatgactgaaaagtgaaaaaaaaaaaaaaaggaagaaagatcctgcttaggttagaagatgcagagggttctgcctgaagctcacaaagttcaagtaaaagccatcctaatgggtaaagacaccccaattttgaataggaacctcttgcactgggggctcagcaagaacccacttattctactgatttttttcccctcattttaaccaaggcttctcctgagctgtgaaaaagacaatgaatgctgttatcaggagatttttcagaagcactgttcctacctgactctcctgttctctctgcctccccatcatctgccctagtacaatgccctcctctttcgtgagtacagtgatgggtcaaaaaaccaagacagggtgcttgatgagacagcaggcagcaaggaaggaggagaaagaggagaaggtgggtagcagaaggtggccactggtgaggaaagcagaaggaacacttgaaagtccaggtcctctgaatggggaacatcaagacacgaccagaaaatggggaaggttccatattaacaatggaagtacattcagatggaatcatatggagcttttactggctgcagagtctagtctccgtcaagagacgtctgtttaaaagggggcccacacggctgggcaccgtggctcacgcctgtaatccctgtaacttgggaggctgaggcaggtggatcacctgaggtcaggaggccgagaccggcctgaccaacatggtgaaaccacatctctactaaaaatacaaaaaattagctgggcatggtggtgggcgcctgtaatcccagctactcaggaggctgaggcaggagaatcacttgaacccgggaggtggaggttgaagtgagcagagatggcaccactgcactccagcctgggcaacagagtgagactccatctcaaaaaaaaaatggggggcccacacacctgagatatcagcggtgtgattgcctgccagcctttctgttcattccctgggatgtgatcctgttgccagcttggactgtgaggctaagagggactgcctattgggaacatgctgcattcacaaaatatctgtggcttcagtgacaactaagatattttagttttaagcagaactttggagagtttcatccatgctacttgacttttcttaaaattttgtgaatagagtggatattaacatccccagaaaatagcatctccaagtagagagttgtactaacatcttgaaggtcatctaagaagtcagtagcacctgagagtataatactagcccaaccagattatcttcctctcccttgttaacaactccttgttctctggattatgctgcaaaatgtatgatgctactataacacatattaatggctttgatagttttacagcattcataattaagtgttttcacataaattatgttattcaattcaaagagcaatcatgtaaagtaagtactacagatctgaaaaactgaggcttaggtcagttacagaacttagccaaagtgactcagccagaaagtggtaatatcatggccttctcactccaagccttatacttgttactttacacccactggcttgatataattaatagtccaagctccatatgaggattaacacattatcttcatatgactattatggcccaatcaccaacattgttatgctactattgttactatgtctatttacactgaattcatggctgaaatagctgaacttctcaaagtaataagcaaaattaccgtatgtgcagaggataccaatgggctaaaaacagtcaccagtgaacgggctgttgataatatgattcagaaaacgccaaaatatttatctcttgtgggtaaaaaaaaaacacgaaagtgtgaacacagatatgtgtacaatatattctatagcaaataaaaaaagagaaaaaacaaagaaatttaaaactcttgctgtgaaaagaatgtatctgtgtataagtcccttgaattaaattctcctggaaagcgtgttcacattttaaaattttcttttatttattttatttcaatagtttttggagatcaggtggttttcggtgaatgtgcacattgaccaaatgaatgggcatgtgaaagtgtgatatacatgtatatatacgtgtgtgaaatgtatgtctctgtgtgtgtgtgtttccgctctcacagagtttacattctaaagggaaggtgtaaagataatacatgatgatatgaataatacaagtcagtcctgctaaataccagaagggatacatttgccatgtgacctatgtaatttggaagactcaacttacctcatatgtgagtgattagtttctgtgatataatttatccactacaaaatcaagctttgatccataattttgatttactttttctaaacagattcttattagtggaattttaaaaaatgttatgtaacaaaagcaacctgatgccattcttctaattacccaggctcacctctctagggaattgattctcaacttcagcatgaaccagggcttgttacacagatttctaggctccattgcctgagtttctgatttaggatgtctggggtgggggtgaagggtgggggaacataatttgcatgctgctagtgtagggatcacactgctccagggttatctttgaatttgccctattgcttgccttccacatccatgttgacaccaaggcttatccttcttgtattctctgtctttccctttcatttccattcctttatttgacttctgcttttttctcttgatgaagggggtagaggggagcactgctttcttccctgacaggatggtttgtattatctttgtttttttctctctaattctgttgctttcaaacatgcccttaactcttagtttcctttctcacaacttttatgaagctgcagtaagtgaatgaaagaaactcctagagataaggaagtcctccgtggtttgtttagcagtggataaagagtggttaggtgagcaattttcttttactgttataaaaattgttaagaaataaaaaaattcttgttatgaagaatattcaagagcaatctaaggagtataaaggagtttcagagtttaaattccaaagaggaaggacacatgtcaagcatgtattattcagagacaggaaatagagcaaagaaactaagtgtctcctgggtagtaggggcgaaaagtaataatgatgaggatttttaatttttctaattaagtaacactttgcctcttctgaaaagctctcacatgcatcatacgtttacatcaaaaggcagaaaaaatcatttttattttaaactcaaagaaatagacagttgtgaaattaactgatttgttgaaggacacacaggcatttagaggaaacaaaactggatccaaatcatctaattacagtacaatcgtctttcatttatgcctctactttaaatttttgggttataatcactatgaaatatgctttacaactaaagcttccttgattcttaaaggtagagcttagctccaaagccaatatgatggactacttctttgtctcaaacagattttttttttttttttttttgatacagagtcctgctatgttgcccggggtggagtgcagtggtgtgatctccgctcactgtaacctctgccttctgggctcaagtgatcttcccatttcagcgtcccaagtagctggaactataggcatgcagcaccatgcctggttaatttttatagtttttgtagagctggggtcttgccaagttgtccaggctggtctcaaactcctcggctcaagtgatccacccacctttacctcccaaagtcctgggattacaggcgtgagccaccatgcctggccccaaacactttctttcatgaatgtggatcattaacatagagcagtacaagattttaattggaatatgaatcttataatttattctcttcaggtttttttttttttttttttttttttttttttttaagagataggtacccaggttggcctcgaaactcctgggctcaagtgatcttcccgcctcagcctcctgagtatctgggactattggtgtgtaccatcacacacaatttatatctgcagttgttgaaagcaactaccatctatattaaactttggagttactgaattgctaagacagttactctgcaggtctattggtttgcatagcagctgtaatggagagaactcaaatttctttttaactttgtcaagctattctttttttttaggactctttttggttagagtatgggtgggaacacagagtccaactctactcttacaagtatccccgtgctttctagaatctttttatactaacatttggactttttgctttgaatttttatcacttccactgggctcttggaaagttttgaggctccatttttttatgttttccctagaaattgaaaagaactttgtttggaaatgcgagctacaatgaacccaggtcttgaattatttccacatgttccggctgtcttgctttttgaaatctagaccaattgttctaaaactttgttaggttaggggatccttcagttagacaatagtcttgaaagactgataggatttccaaactgccactgccaaataattctggaatgaaagggaagagcattacttcttttaaattaggtgcctgattgatatatgcacattattattttcagatggggctatattatacacaccattacaataacattcataatttactgaggatgttcataatttactagaaaactgaagtccacattttaagcataactcagatttataaaatgactctacctatagcttttgcatctgtgtctgagtgcacaaatcctttgctggttttcttatgtccaaatctagttatctcggttaaccacagaatccttcagtgaatccattggagaaatgtatttatacatcacgaagatactttttggtagtacattgaaaattttatgttgcaaatttaaagacttattttattatgtgatctaacagaatgtgtgaattttacatctgataggtctacttgaagagatgtacagaggggagagcagatatgtttatggatccaagaccagcaaagtcaactttggttaaggagatactttcacagatggtccttcctgcacccctcccccatgttccttaatttaatggcttataaatcagctatccaggggaggaaaggatataaactatgtgacagcactctataaatcataagatgctacaaaataaaaacattactatttgattaattcacctaataatggtgatatccataccatatggaaaatttcttgtgatttacctctggttattagtacattcacatttatcccaagtaaacaaagcaactcaccactacccaagtttcttcataaattcagtagtgagtcactctgtttatttggaagtgtgaatactgtgatctttaaaaactgattctcataaaagtacatacattaatttacataatgtcctgacttacattaccctgcaaagaaggcaaagttcatcttaagcaacgttctgtttcagttgtacaattccatgtttgatgccttgcctctatctctgttgctttccttcccttcagtccccaatctaaacttcactgttttatgtcttctctcttggattcctactagctgatctgagaaacaaggttgttttgagaaactaatttgttttcatgtatcagaattcgagtatgtaacttttccctggtaaattatttgtcatttaataagggtattctgaggccaggcacagtggctcatgcctgtaatctcataactttgggaggctgaggcaggcagatggcttgagctcaggagtttgagaccatcttaggcaacatggtaagaccctgtctctacaaaaaataaaaaagttaaatgagcgtggtggcatgtgcctgtagacccagctacttgggaggctgaagtgggaggattgcttcagtccgggaggttgaggctgcagtgagccgagatcatgctactgcactccagcctgggcgacagagtgagaccctgtctcaaaaaaaaaaaaaaaaaaaagaatttcaaatataatgatcatcactgttataggtattcttaggtccaagagaatctaggtgacatcacaatcgcttatgtgctcacttatatggaggcacatccatggaatgcccaattctatgggaattccatatctctgtaccactatggagctatgaaaaaggattggctgagagatcagaagatcttagctctggaatcatagaatccagggatgaaacatgatcttgcccatcttgatgactgaatcctgtgtacaaaatccctaaaaatgttcatccattctctccttgaatgcgtctaattacagaaactcactccatttaaaggcagtctatctgatattagagcagatctgattgttaacaaaatttttcttttattttgtggaaaggatctcctgatagcatccaatcattggtctagttccaccttttggagccaaactatacaaactgaatgtctcctcctcttaaccatcttaataatagctaccacttatagagcacttattatatgcttggaagtactctaaagacttcacatgtattaatttattctcaaaacagcactataaggaaggcgtatcacgattattctcattttatacacaaggaaactgaagtatagacaagttaagtaatttttccaaggcgacaaggtttagtagtagctaagcctgaatttacacccaggccatctggctgggtgtaagagctcaagctcttcctgactacagtatgctgcctctgaaacacaaatacttgaatatggcttatataatgacctgagtcttctcttctgcagtctggacatccctaggacatcccttctccataaagggttcctgtgacggtgtctcttggtggcagggtgctttgttcttatgatgggaggaacacagttggggtttctagaagaggcttgtggtggggtctgtttaaaatctgaaagatgatcccaaaccttcccttctacctgctctcttaccttgccttcccacagccccctcagcccctgctgccaggcctccaggtggggtgacactcacctgtgtgtacgaacatgtgcttgacgtagttctgtttggcggtgaaagtcttgttgcagagagtgcactcataaggctttttttcgccttgcccactggctgtgctgtggcctgcggatgaggccaggggctgtggcgctggcagctgtgcagtaaaggtcgacagaccgggctgggacactgtcacaaactgggtctgctggcctgccaggggctgtggcaggctgaagaggaaaggcttggggccactgcccgcgggctgggtagtgaagagggctggcaggtaggtgttgccagctgtgccaatgacctgcgtgttgctggtcaaggtcagaggcatcctcaggttgctggtgagggtttctgtctggcgtaagtagagctgggtacttggcaatggctgcccgatggacgtgttgaccgaaggctgttgtaggacgctcttgtcggagctgttgctgacagtgataacagtgctgtccatctccacttcattgcttctctccggagaggaagcacctgtttctagctggtttgtctgcggaccaccctcagcgggggcttctgcagcctgctcgggttgggtgggttcagcctggctgtcccgcgccgccccaggcccaaactgctgctccaccgagtcaggctcggtgcctatggaggagctgacgcccgagtcgaagctttcacctttgggctcactctcggtgccctcggcctggtctgtgtcttccgtgcactcctcggattcgttgcgttccaggatctgcaccctttgctgcccgtagtagtcgtaatcgtcctccatctcctgcttgatgtggatgttgcccactagggtctggatgcgcacaggccggggctgcttgcggcagtgcgtggtctcgggggtggtggacaggtagcgctccatctgctgcgagcgctcatggatgcgtgtgatccagctggggtcttccatgtggtggtcgcggggcaggccgagcgcagtctcgtggtggctgaccactgcgccgctgtaaaaagagcgctcgccgctgccattctgcatggagcacgcgtagagtgccgagtagatcctgtccacgctgtgctgtgggtggctctgcaggtagcccgactccgtgtcgctgctctggcctgacgtgcctgactcgggagtgccccgcggcgtgtcctggcccgagtcctggatccccgggaacacatcgcccacgttctgtgacacgatgcgcgtgcactcgtcgatgactgttttgatctgcaggatgctggcggccgtgaggatctgcagagcttccgactgcgagacccgtagcacgccgctgtacatgaagtcaatgagcttttgcactgactgcactgacaccaccgacgggatctcgatgtcgctgtagccaagcagcagtttgtcctggaagaaggggctgccggctgccagcacgcagcggtgtgcgcgcagcatgctcccgtggatgcgcaccgttacgtcacagaagtggccacggttgcgctgctcgttgagggtctcgagcacggaattgctgaagttgtgaaggttgatgctgtgaatgcgctcggtcatccccttgcaactgatgtcacctgcagcatgtcaacgcagacacaaaacagggcatgggtcagatctagctggttgcattcctaacacctaggtttcaggtgagtaatgctcatggctcctagaagcactgcccttacatacgcaagtggggagatggacaggctgcggcatacaagctgtaggtacgatgacctgagggaaaaggaccttgaattttgctccaattccggcctttagtgccgcagccattttgggtatccatattaactccccagagcttcggctgaggtagagtggcctaataaccagatgatttgtttgcctgctattcctacagcttcagcaaagaactgaaaggcaaatggaagacttgttcttatggaacactaaacctccactttatttttatttatgtatttatttactttgccttcactttagacaggcctaagcccagattctttgggaaagtttacatttcccccaacttatcaaagtcccttattttattcatacacagtgaccatattcatagttaacaaataaacccccttcctattaagtcatatggcatattatcaaaacccacaccatgtatgcaaaaattattggaaaattcaacccagactaagatatctaccaaacagtcatgatcatgctttccggatgatggatgggctacagaaagcaatctgctagctaaaggggcactccatggctgctttctgtatctactcattcttcttgtcatctctgacaacctgtttgagcactttctagggtggttgcatgtgatatggaaggttttctgaattttctgaggcttaatgaaggaggaatgttaaaaaggtcagagatggcagttctgacccaggagactacagtacattggtgatcatatttattatgcaaacagggcactttcaagagtgaaagagagcattgttaataattaggccaggatagcaggagtaagccagaagtgggatatatgatctccttgggtaatagggtgctttatgtacttgccacagggaagtattaaacagctcccaggaggaaggcaacagctatgtggaggctgcggatagcctgacccagcgccaccctataacgtaggctgttatggcaagggatactattgataagatttggattcagaatgagaaagaaaacaggtggctacagcagtagatcttagggcttttctatttttctagctcatctctcagatggctctagagaatccccctccaaataattcttcaatcagattccccattcttgcctttacaactgaacaatcagcttgggaaagtgaaataagtgggctttcaaaaccaaatggcccaagcactgattgttggcctggacccaaatctctctgtcttgtgagaagccacctgagaggtaacagcctgcagataggaagaaggcctacctcctcaaactctttccgctctaccttgcgatagaagacttgttcaggaaactctgagttcaatgagcgtttctaccttgcttcactcaatcaccctcacatggtatgagcttaacttaataaatgttcaataatacaatttgcactaatttgtataagagcattctttctcgttctgactctatcaggtctgttatgtgcctaaaatattgtattaggctacagattccatcgtttttacttatataagacaagttctctttgccagattaaagaattaaggtaaatcccctgtaaccatgtgaacacaaaatatggccccaaaagaaggcacaaataacccaggaagggctgttcaggagctcaatcagcagcagaccaaatttcaagttcttgctgagttcgccatacatacataccatgatagtaatcacaagataacattttttaggggttacagttctaactgctttctgtatatgatttcatttaatcttacagcaaccatgggaagtagatgatattattcccattttacagatgaggaaactgaggccagagaaactaagaaacttgctcaagtacacacaggcaattgctggtagactggcatttaaacccaggcagtctggctctagagttcaccctcttaactgcttcattatattgcatagtttgccctttactgaggtctggcccttagggatccacggctctgttgtaaagctgtgtgaaaggctttgtccactactacctccagctacttctatacctatccgtgatttagtgtggcttttatgtttttaggctgtgatgctttgacatagcctcagttgtgtaacttaaaggacttatttttttagatgtcacagtgcaagaagtaagacaactaactggcactatggtttaggattttctatatacaattttactataaccaaggtctctttcatttaagtaaaacaataagcagtaaaactggttgtgtctgtgatcatctctgtgtaggatggatttattacaacatttttttctacacaagtgaaaacactctttaaacatacatttgctcataacattagttacaacaataacactagagatgtcatatatgacagttttctttcagataattctgggaagtagccctatcacaattatcacaataattagtatccatgtagtgtttgactgtgtatacaacttttttacatgtaacatctcatttattccttacaacaatcctatgtgtgttctgaacaggtttttttttgttttgttttgtttgttttttttttttttgacagagtcttgctctgttgcccaggctggagtgcagtggcacaatctcagctcactgcaaccttcaactcctgggtttaagcgattcttgtgcctcagcctctcgagtagctgggattacaggcatgcaccaccacacctggctaatttttgtatttttagtagatgagttttcaccatgttggccaggctggtctcaaactcctgacctcaggtgatctgcccgcctcggcctcccaaagtgctgggattacaggcatgagccactgtgcccagcccttcaggacaagtcttattattgctatttcatataagagaaagtcgaggctctcaaaatgtctaaatgacttgcccaaagttttgcacagtagcacatggcagtgttgggattagaaactatgcctcttaaagctttttccactgcataacagtggatcactgaggaatggaacttgaagtgcccaaagatcgagagttatcttaattctcagcagagaaaaaagaaagacactgaaagtaatgatgaaggttgctttagagataagaaatgaacacagataatcacacacacacacacaattccatgagaaaaatccaaactgtttgaccagattggattgcaaattttgttcatctaaacaatcaagttatctactgaatagtctgagttaagactcttgcgataatattgccaccaacttcattaaaaaccacagagacaaacctaaacctgcacacgtacacaacctgatctgacatgcctggttgaattttatacacacaattcttaaatatctccctgagtacactggccccacactgcagtgaacagccatgaaaagctgaatcgtttttgctgatatgagtacagatgcgaagggggaccctgcctccccattcaagcatgcctcattcctccagcacacaatgctgaggcaattcctttcccaggctttcttttatttttaacactaatacagtgggaaaaagtttctgccacagcaaggcaaagtccaggcttttgtgagcatgtccttttcatccaatgggcattaatgtatagattccaatggaataaatctgaaatactctactgtagaagatttgtcccccattgaaaacaaatcttgattagatggttattcagggagtgtataggaaggaatggtgtgaaaatgctaactctattctttcttagattggcactgaataggcatttgggctattcaagaaaaaaaaaacacacacacacacacccaaaccccaaccctatcaactgtacaaaaccacaaaactttacatagattatgtgatcatgtgtatttggggattcttccccacccaaaataaaaaatgcacagtgttatgaacacaaaactgatggcaaaatgaaatagtgataaaaatagttctctgtgttttaaaataataacttacctcctttttactagagtaaaaatacagagtcagcttgtgatggcattccctcaaaacatggaaggaattgcagtaatgaaagtcatcatgtattctaagagactgttctgcgagagcacaacacagacggggctaaagcaggggtgagtaccgaagggaaaatctgcctgtggggaattggggatagagggcctgactctctgttttgcaggaacgttgctcctgcctgtcccttaagctgcaggggtccagggataggacttagcatgagaataaaaagctgcctgctcacaagagaaaatgagcaagaaaggaaacagcaggcaatacaatctcttttaattaggtgtgaaatccagttctttctcaatcaggagagcaaaaggatatataaaatgagactagtgcaagggtaagatgctacagagggggatggggatttgaagtctctggacttggaaggaaacatcagctctcaaatgaaaaccaatataaatttcggtccagttaataagcctaagtcaagtggcagggccagaaagcccttgagctttcaatttggggcaccagatgaggttagtgggtcttgcacatgaaacagggtgcagcttgccaagttagtcacactaggaaagagccagtcatctctggagaaaggggggatgtattttggtgactgagcccccttattctccaaaccccctgcctggggtaagacttcagttacatgtactttacctcctcatatatgccaagggagtcctgctgaatccctgcactataggaggtatagtagtttcttgctaacaggttccatccacagcaaatgactctgcaccaccccactctctctttctatctcattagtatcatcacagtcttgggaggtggctgggagcactggagaaatcacacatgcaagtggaaggcagcaagcagacaagatctctttctcctatcttggctctatatacctagcatatcccagctgctattacctctgtagtgagactagggagggtcatcagcctatgggagggcgagctgtacagttttacttacccattcttgggtgaaaaggggggtgttttgggccatctcccaataaaggttctcctctatcttccagattgtctaagcccagtgtggaggaaccatcaaggatttcagcacgtttttttagccattggtaacagaattcttcacataaaacatatatcaattgttgaaatttgcagaaatttgacttcgaacttgcagaaatttgactttcaaacatgtttgcaggaatggctacctatgaaagttggggactagctggatgtgcttttttagtcactacttattattttatctagacaaagattaaaaattactaacttgtttacagtatttacaacaccattctatttatgatcccaatactgtaattgggtatgcctttaatattacctgaatttttattcattcatagaacatttctagagaatacttaaaagtatttaaaggtccttggttttatgtttgggttttggggggtatgtatagtttttataaatggacatgtttatacttttataggaataaggtcagtggctttcatcaaaatctcaaaggggtctgtgttttccccaaattaagagctgtggattgagattcaggcatccctctttaaaatacttgtaactactttccataatcaaagcttctaaaactgatgcaaactttgtgattgcattactctgatgcataaggtctgttgaactgatattttccatttacttaagttgagctgatactattttgtatgagaaagcaaacaatcttggccaaaatgagaaaagttacttttcagaagagaaatattttttaaaaagattgaaagggaagagagaaatgtaggtaactactaatattagcagaaatctggattatgacagacatatagtttacaactgttgaagctaactattatttagcaaactttgttttactcagagtaagtcccttttgacagttaagacaaatccacagaagaattagaaaacaccctttaacatcttttgactgttaaaaattagatattgtggtataatttgaataaaaaataaatataaactcaatatacacatctaatcagccaaaaaaatagtttacttgcaagatctatagcacttgtaatggggagactgcctttctttctattttcctccttccctttcttcctttttgctgtcataccacgaagttttactaagtttgaagtatggggaacaaagaggcaaaattgagaactagaaaaacatttgctctgtgattttcaggcccatccccaaatcttgacttatcttccattcctgacttctttttcctctcttcactccaccaaaaaataagagctttatactttatctaaggctgagaatagatttacagtactagtgggattttacaggtccaaaggagaaagtaattccagaaaagtctttttacttggccttagaggtctcacagtctcccttggttagcccaggcctttggcttgcctgattttatgttaagtctgctgttctctctaagaaaggatgagggcatgcctatccatattgtaaaactgtaaatacaactgacttatgaatgaagctgctttgggggtcacttgaattttcaccaattcattagtgaaacatttactgagaataccccagtataaatggaaccataaggatacaaaggatcttaaatctaaatcaatagaagaaatttatccataaggatctttgatattggaaacatatattaatcaatcaacttctcccagacctcagtgctcaggaaaagctgtgttttgcttttctttgtggagcctgtgaatatcataactgatcatgtttccctcttggctctgttcactagggagctcagaataaaaatttaggcccccttttagcaactatgtaggacctcatggtatgcttttctatgtaaaattttcaccagcctcattatattatccattctttattttacctctactctgatttctttttttttgtagttatatagaaatacatttcctacatatttattaacaattgaatattaatttaagctacctcaaatcccttacttatgaggtgagggcataatcaatcaatcaacaagtaattgagcatccactttatgaaaccaattccaaccataagttaaaacttcagtcttgagtattatcacactatatgctttatgaattttttatactttgagcatctgattccaatgaggtaaactgttgaaatttactttacagtacagtttgtgaaaattaagttttactctgtgaataaagaattggatagataattccagacaacattctgaaagacacttacgccgtcattccaaagttgaaatgaaatgagggggagaagacttgctgggactaaggaaaaaagtcaatgaaatctgaggttgatgcctttaaatcctcttatattgtaaaccttttgagacaccttttaggagtttcattttttctctctctaaagcgctttccttacaaatttagctactgccctattgtaaccttttcctttgttcactaaatctggggaacaaaaatacagagatgctacatccgtgggtggtatacaaaaatgaaccaaaggatctacttaaattcacaaatttgtgctgtttgaacttggctttgaatagaccttaaagaaggatctgtatattcaattgtacagttaataagttaggtcttttgttttgcttaagaagcaatcacaaatttaaaaattgagtatatgaaaaccagcatcttcttacttgataatctgttcttgtggtctctacataatcatatacttattttatagaaaaaacagatttataaattcagtgagttcaaagattcagtataactctcaggtatggcatttctttaaagaatatcatcacacactgatgaattatagttaggtaagaaactgattttttgactttgggaaaacttttctctggacttaaacgagtgagaaaacagaactcaatagtgtcattaaaaaaaaaaaaagctttctggcaaaaaatatcattgagttcccaattcatagaacttcctttagtcctctgttgctgtgctgttctgaaactgcttttgaagcaggtcttcaaattcatgctcaaatgttctcttcccttgggtctttctaacaaataaaaaaaagttgcttccaatgagaccgctgtttttcaagagtatctctgtttgttggtaggaggggaatgcaagattttctttttttttttttttttgagacggagtcttgttctgtcccctaggctggagtgcagtggcgcgatctccagctcactgcaacctctgcctcctgggttcaagtgattctcctgcctcagcctcctgagtagctgggattacaagcgtgctaccaaactcggctaatttttttttttttttggtatttttagtagagacggttttcactaagttggtcaggctggtctcgaactccttaccttgtgatctgcccaccttggcctcccaaagtgctgggattacaggcgtgagccactgtgcccggccaatttctctatggacttgagccatgatagataagttcactgaggagtaaagaccttctatcccaaagcaacagggaaaagccaaggaaaaaagtaaatctgttttgttggatgactggttaaaatggaagcactgagatgatttgtgtgggctaggttaagagagtagctgaaattcatctgcgcacctagggtatagaaccaggcacgggaaatcattaaaaaaaagaataggacctaagttcctttttggctcatactgagatgaagaataagtgctgtcagatagaactcaaaaccttgggaggttctggtaaataagtaaagtagaaggcatactttataattattttaatcacaagtaggcattttatctttatgatattctttatatagtcttttgtataatatttattatattatttacatattgtcaaaaaagacattgagctatagaagtctcctatagctatagctaacattcaaattatctgatttcacttcactgatttggttggatttgattttctctaaaataaaatctctgtgctaatccaaaaggttggccattttgctttcctgtgtgtggattacattcatttttacttctcttctgctgaattttccgcagttctgaagttattgtggtttctctcctcaccaattcttatcatccccatgaaccttattcaaactttttccttttctgtgaagccttctgtgattactagagttcacttttcttggtttccactggttggtgaggtaataaactaagacattcatttttggcttgttctcactgaattagaaaactttcttaatgagaaggtatctcccctttcctccacctgtaggaatgaatggccaggtttttgtatactttataggctcctttgcctcagggagttgtggtttcagagcccattaagccctaaagaataaaccataaaacaaagagttttctttcctaatgtctgttctctaaaatgaattattaacccagaatgggtaaggagagtgaggctgattgatgctttggagttagagaattggatagcattactggagagaaaaacaatccactttccctcaaatgcagaaggtagcaaggtctctacttgcatacagctccagttggggtaattgcttggcacacttctggaggctggacataaaaaggcaccactttgagaggaacagtgatcatctgggggctgggccaatggtcaacagcaaggaccactgtggagggcatctgtaaacccagctagtgcagtagtgctggcagtcagaaggacgaggctcaatggcatctttgtggggtggtcaagcaatgtcaatgttggagaccatcatggactaaggacttagatttaatgagtcttgtaccaatctagggatgagaagggagccccaaaacttgtctgtatttcttgcgaatttggtgacaggggcctcaggtttaattttctttagaaaaatacgggaatttttttgtacctgaatgttgaggagtgttggggaagttcacctgaacttcctatacatgtagcacctaagttagttcttaccaatatattattgtttcttttttcatttgtgtctgtcttatctctctaagactcaaagcctcccaaaggctagtatcttgtcttgttataaccacaactacaatgacaactacaaatatgtaactggatccctcattgtgcccagcatgtttctttataatgtgtgggttctatgtgagtgcttgtttggtcagctcttcgctacacttcacaaacaagtgggaacctcagggcgcacatttactctgagatatgtctatgtgatatggtcctgacagggcttttttgcccctgaagttctgtgtaatgctcttcttcttgtcctttatttccctacctacccacagttctattttcaatagaatttaaagtccaagcaattgttttatgtgttcactgagttgcccacaaactctgctcattcatttatgatttctgatacatgccatgctgtctctgtctccctgattccatttccccagagagacagctcactgggtccccctgtcaacagaggattcagtggaacccaaagctaagccatactttgtaataaaaaataagaagagatgaccaatctatgatgtgatagaaaaatgatcaggccaaactccgatcacttttgcctatgttagggaagctaacctgcttggtaacagatgttacagaaatatctatcaatcagcattgataacagggtatttatatgtacattaacagtagtgtcaaggattgtttagaatattttctcttggtggccactgggtgtcctcatttacaaagtaaatatgcaatatttagtgaaggtcactggagagaataaaagacactagttttctctttggcccttcacatactggggataaatttattgctgaactcacaagcaggttatatattagtacagtttaaaaaccttcaggtcaaactgttaaaagtttataaccaagagtaacttattcagggtccagacatgaattttaaaggctgtttcctcaacagaggggactgtgatcagctattagaatgatcccttattcatttgaaaattggcatgggattttgactatctgccgagagagccagcagagaggagcagagaaggtcttaatttattcttgaaagaaaagagaacaccaaatatctctatgggatatttgttagattctgtttttatctcaccttttctgaaaactaattaaaaataataatgagaagataaaatatgtcctttgcctaggaaacctgaaataatgtgaaaaacattacaatgagctgggtcagtatactgattatcaatcatttcacatttgaagacaaagaattaaactattcctttatggacctgttatcccacctgtaaaacaaaggtgtgtatgcttcacagggatgttgtagggacaaatagaatatgaggcacacaaggttcctaggaagagaaactgtacatgagatagatttagggcattactagtattctaattgaggctgagtcacagttgtatatgacttgttcctgctggaagacagtagtcaaggccagagctcacacagccaacaaatatgttctgatttgctgctctcagacactgagtctgacacactgctcagcaatcacttactgctccctaaagtggtattttgcatttctaggattgtcattgtctctaaatttatacttatatacatcgctgatgaggttcttcccttgcaaaaagaaatttcagccttcctccaattcaagatacaggcctactattgaatacataacagtacatggccttcaaatgtcatgcctagccaattagctaatcctttcccaaaataaacttcactgtaatattttttttttcactagcatacatccccagcttaattactattctctggcatgttatttcagtacataaattatcaatatgattttgtgtcaaaaccaacaatttgaccaggcatgttggctcacacctgcaatcccagcactttgggaggctgaggtaggtggatcacttgagtttaggagtttgagaccagcctagccaacatggtgaaacctcgtctcttctaaaaatacaaaattagctgggcatggtggcgcatgcctataattcgagctactcaggaggctaaggcaggagaataatttgaaccctggaggcggaggttgcagtgagctgagatcatgccactgcactccagcctaggcaacagagtgagactctgtctcaaacaaacaaacaaacatcccccaacaatttatgcaaacaacatcagggaagctaggaagctctatgagctattctctgccgttcagatatgttcgattgtcttactagctgagcttaacagccttttctgtttttaaaggaccaccatgcatgcctctagtacagcaatctctaacacttaatcaacagttacgtctacagcaatacacaatagccaggtcactttcaccctgagattatactaaaggctcacaatatgctcagagtgtatggaaaagtgtctcatttcttctaaagatccttaaattccttgcttttatagtattatccaactgattaattagtagattcatttttcaactactgtagccccaaagatacatatcggcagagccctcctgattgtattttacccttggccttttctccttttagtttcctcagtttgcacctgtaatttcacttttagaacttctctaggctcggtggctaaacaccacacagcacaggctttatctgatgtgccggcgcctggtgtggtctaagacacactggtgttttgttcttgaagtacaggattgatgttctgaaacctaggctctaacacaaaggagatcattagctcattttaagtgtctcttttcttccctcccagcctcctcctacccaccccaatacttccttagtcctaagcactggcagcagatggcaaccatattccaaagctgagtatacataaaatagtgccatggagaacagagtggcttcaaagttagcctttctattcaagtgggatggcggggacttctggaggagtgaactcatctctcattcatttaatcctctattcattcagccaggaatttgttttcctacacatccatctactgtccagccagttgagggagggtgggcatgaagcatctctcttgagggcccttccagcaggagggcactaagatttctatgccaagctcttgtttccctgggccagctctgcctgctgctgatcaaatcatgccattcctgtaagaggagcttgggaacacagtgtgtagggggtggatttctcaagaactatctccttgctagactgacagtcacatgctgtattccctagacaaagattagacccaggaaaaagatgaaacaaggaggaggatgtggggttgcagaaaactgtgcaggatgttacagtaacgggaggtgggagtgggaaaacctttcctttttgttgtttcaaggtttgctagagcttttgcctaatcatctgtttgagcatcttgaaaataagtatctatttccatggtatctatcaaaaacaggcaccagattatactacaaagttgacctgccatattgctattagaattaaaacatgtagcagcttacattcaaaagaaagcttttctgtttccccagcatgaaaagcagagggtatttgtgatacactttgttttgtaggtctgctgaatgaaaaaaataatcgggtaaaaaattagtacctatattttcacaaatgggcataatgcttacaaatgcactacatcattattttagcttcattctccccacaacattcatttattcattcaacaaacatttgctgagcacctactcctaatttgtgtaagcactttgctgggtgctagggattcagcagtggacaaggtaaacaagattccgccctcctgaattctgtcacctggccaaaataaacatttaacaagtacgctgctagaattttacttgagaaaaaggaataattcatcttacctagtatttcttctgaatctttcttaaacatatttcttgaaggtccagactcctttaactaagaagttctatcttaaatctctctctttccattgttatattcattcctttcttggttacaatgtggagagttcagattgcaactgctatcatttctggggggaatgggggtgggactgtaaccctgagaatccttgcttttcaaactacacatatattttctctgtaaatattgtaccatctaatttgcgtctttggattttgttgattagccatcaacatgtgatttaaggaatactgcatatgagatgcagaaatcatgactcagtaagttattattttaaagctctattttgggatttatacagacttgtgtacagtctagtttggctttcaatctaatctgcaactattactaggaggcttttagatcaagttccatacccatgtgtctctggaattctacagtgagaagcaaaagtgctcaggagttaagagaagcagacgtccgaaattatctccatgcattaccaaaaaccgtgggcaccacggcacggggaaaacttaccaggtacaatgagccagtgactgttactgaatttcttaagattacacttttcccaactactgcagactgcttcagaatagaagaaggtaagtaagcagggtgattacaagcaatcctcctcggaagtgaaactcactcttctaagtttacctctgttttgaattatttcagacaactctcatgccatcaagccgacggactttcaaaaaaataaaagatgcatttctttacttgtaagtatttgtctttgcaaagggctctctgatatggtagcacagaagtttgcacattctaaggatctgatgttttgccctcttcgggtatcccggctggaaggagctacggtgaaagggcacctaaggtgaatggacagattgtagatgggtgcacacaggaaaatgtacagctcctacaatgtattctgaggtaagagagcacacaagtccattccctataatttgaaaatctctcttctttttttattttttagagacaggatctcactctgtcacccagggtggaatgcagtgggatgatcatggctcactgaagccttaacttcctgggctcaggtgatcctcccacctcaaattcccaagtagctggactacaagtgcacaccactatgccccgctaactgttttgtagagatggggtttcactatgttgctgaggctggtctcaaactcctgggctcaagtgataaatccacactggcctcccaaagtgttgggattacaggcgtgagccaccatgcccagcgtgaaaatctcttattgactagaatgcacttgaagacaaaaaggaacttaacaggttaacactagaatgtaatgctataatattaataacactctaacccttccctataccaagaagacaacattcagagagatttgaaacttctttcagccccagtttccttatctgtaaatggggtgttttgtaataagattatgcatattagtcctctttcatttttaggaaaaaaaaacatacaaatgggggaataaaagaaggcaaagagataatggagaaacttcccagtctattcaggcctgaatccaagaagggacaagaagaagggcactggcttttcctcgaagtgaaggatgtaactgtcttacacacaatctcctcccatagatctagggcttttcagcctcagtcgttctcagggggaaaggatggggacctgcaacaactttcacttaggctgcatcaattttagttcatattaataattttcaagcacttaaaactgtagccgacactcaaattcacggagcgctggctgtttttctggtgctgctttaagggctttacatgtagtgttccatcgaatccttctaataaccctatgagatgcatactatttttattctcattatgcaattatgcacatgaggaaatggaaacatagggaggttaattaaaggcacataaaatgcattcataggctgaagttcatgttaaaaagagcaaataagtagaccatgggggtgagaaaatattttctgaatattggaaaacaacacatagccccagtcttagtccattagcaacatgttcaagaaatagctttagcagtctgttatcatacctgcccccaccctgaaggcatatcggagggacccgagaggacatcaggagccattctgcattgggatgttcacagggacctctcctcattgcttctaagttcactcttgggtgccaggtttgagggtgcagattctgattaggatatgtcctggggaagtggctttttccttctgttagttctctgaccctaatgtaacaaaatctttaaacctgtgtcccagaacaacacgcaggaaagaatatgaacctctaaaagaaaggcccagtaatggtaccagtagagtccaaggcctccaggtcaagaactcctgctctggagcagggctggaagtgggggcacgctttgcctgtatcactgcccagtgaaaccaggcctgctttgcagtgcctgttagcatgtcaacccaggattacttaggccacttcaggaatcccaggatctagtcacccatctgggacctttaggtcaggaagaaaatggaatgggctagatttatgaaaattggaaaaaatccagtcaggtgtacctataaagacctacagtatttccctgagaaaatgacatgtatcctttaccctggggttaacttctaaaagttttagtttagaatttgcatgtgtcttttccattagacacagagttatcttttgtagttcaaacttatatgcacctttctttcattgtctcctttacatctaaatacctggttaagatatgaggcaaagagataatcagtgattatatagggaagaacgtgattacagtaaaaaattgaaggacaaagttaattcagttactgctttttgaaattctttgtagtattctacatgccacaccaagcttttttaaaaattctgtactctttggtctaatatcttggtataaaactgataacataaccaagctaaaactagtgaggataaataagtaggaggaaactcatttttagaattggagaggaaaggaaaaaactcctcaaggtcaattttgacatcaactataaattcatttggccttgtgaaattataaagactcatgttcaacattgttccatgtggttgtttatataattttcagtagtgacaaaataatctccttatttagttttacaggtaatttaatagtagaacaaagtatcgtttgattcagttggttccagatcaccatcctacagtagaagtatatcagatacttttgtgtacaggtgggattggcctttggaatgtcttggaccatcacagaaagcagcatactttaagtaaacaaattgaaaccctccctacaaataatgaatttgaggatgtcccatgacaatgaaggtggccttgagaacaacacataggtttgttattagtaattacagagctacctgaattgggcatatcatgaaagaagtacacagaacatggcttttaaagaattatgctttgtcatttcaaaaacaattgtttttaaaaattgttttaaaaattgttaagatgatttaaatgttcaaagtgtatgacacctatcctctgcttagtgttcagaggttactgagggtaaggaactgagttaatatttgtgaagtaataatacttgtaaaacattatttctcataaaaaataatagaaagcaatgttgagaagaagtagagaaagaaccagtataatataattactgcctcactgggcttgggtagtgccttcaaattcctttcacatatatttaccattccaattgccctgtgaaatggaagatctaattccttctcactttgcctatttaattgcagagtctcccttaacactggtttttctcagtctataatgggctaggaactcttgtatcataaaaatattcattactccacttttgagttacccattcattatttctttttaaaacattaaacttgtactttgtaatagttgctttcccatttatcctatgtttgctcctgaacccctctttatggtcttttttgtgacacatctgattctgttttcttgacaacaatcaggaggctagtaatcccaaaacctaaggtaatcttttcctaggtctctccctcgttggtgtctgtggcacctgatactgactgctgatccttcctctccctgatggtctctctgcactatcctggtttttctcctatcccttagaactctcttttcttttcctctatttattcattcttcattctctttcttatcactcatgtaaatatttcccaaggttttgctttccttttttctctcaacaaagacttctttgaagtttactcccatatttatggcttatagtgctcttggccaaagtgtttgctagtcctaatctcacgcattcctgctgtgccccaggaccctgtttgtaactcagtgttagttgtctccactgggaacacctgtggtagctcatactcggcactatataaaatggaattcaatttgattcctttaaatgcttttcatctttacttgataccttggagttatctttgataactgcctttgttgtaactaacactcagctcccagagctgtctaccctcatccacaaaatctgttgcacctggatcctccccattcctcctattaccgcccccttcaggtcaccaatagtgtgaaatactgacagtgctgtctggaccctctccttcctccagttgctccttctcacatccaggctgccaaattagatcttctcaaaatcttgctcatggtaggccctacttaacacccttccacagctctgcaacagaggtgcaaacccctcatacctagtcctgatgcctcatttccagtctttcaaaagagctcaaatggagccatgtctaataaacctacctagatattactgttaactggattaaaatatactttacaaactttctaaattctcagatactggtgatgtgaggatacatattgttttaagattcttggtggtggggtctgtttttctccacctttgtgtcctcatggaactcactgtagtgacaggcacaaaagatatattctatacatacttgctgagtgagtgaatcaatgctccggtgggtctctgtgtatggggacatatctttaaccacgctgcatggaagttgtttgtgaatgttatttgatcttctctacaagactctaagtctctgagcctagggctccagtttataaaactgcgtcctgcacaatacttagcctgtggtcctccacattgaaagcatccactatattgatggatgaatagtcctgactcctttctgttcagagaacattaagtttgtccagaagcagacttagtaacaagcagcataaatggtgggagaaagggcagggttctgtttctgactctgtcattcattatgctgggaaactttcgttataacacttgtgttatttgggcctcagttttctcatgtgtacaataatgggtatagaccaggtaacctttaatcttgcactgctgataaaaagttagaactggcacacattcctcagagagaacaaatgattcagaggcagaagaaaagcaaaaaagaaagcaaaaaaaaaaaaagggattctgctgatgaagtaataaggtatgtgattatggtacctagtgtgaggtgactggtggaaagatccgacttgaaatttccttaaagcaagaagtccttaaagaatcctcatgcttgctctcaatcaatcctaaatgatccaactctaagggcagtagtgcatgtggcctcttttattttaagtaaggatgtgagaagtcttgacagatatggagaagcactaattttatataatgaaatctgccatgaacagaggaagcacacatgaaactgtcactagcagctgtagataagaattaaagatgtattcctgcatgggatgagatggcaagatgaagaacagaaccgtgaaaatcagcattgggccctaacaattacatgtggataatcatatctatgcactgtttgggagagcaatatgacacagtgtaacttgagccaatgggcattgagaccagacttgccaagggacctgggaggattttataagaggacagactgttagagtcgggaagggccacaaatccatgacaaagttccagcatgacacctgtaggtgactctggctccatgaatgaacttttctcaacaattagttattctgagccaggtgtggtggctcatgcctgtaatcccagcactttgggaggccgaggcagacggattgcttgagctcaggattcgagaccagcctgggcaacatgatcaaatctcacctctaaaatacaaacaaacaaaaaaccccccaaaaaactagctggctgtggtggcacaagtctatgttcccagctactcaggaggctgggtgggaggattgcttgagcccaggaggcagaggtggcagtgagctgagattgcactgctgtactccagcctgggcaacagagccagaccctgtttaaacaaaaaagaaaaataaaaagaaaatttattttgtgatttactgatcaaaatcatcactaggtccttcagaatactttctttttttttcctgagatgcagtcttgctctgtcactaggctagagtgcagtggtgcaatctcggctcactgcaacctccgcctcctgggttcaagcgattctcctacctcagcctcccaagtagctgggactagaggcacgtgccaccatgcccagctaatttttctatttttagtagagacagggtttcaccatttggccaggatggtctcgatctcttgacctcatgatctggccgccttggtctcccaaagtgcggggattacaggcgtgagccactgcgccttgccccctcagaatactttcttactttgactggctgtgtggaaggaagggttcttttgcctattagaaaataagtagatgtcttgctttattatatatttggaaagcaaatgtctctgaaatggatataggattcagctcagctgaattataacaatagacaatgttacccaaatacaaatcttcccatgattaaaatgaggcaaagtataagaaggcctcagtgtcataactgaactgttctgttttctgaaaactctgcgctctgtttgtgcctctatggttttgcttctttctattccttctgcctggaatgccattacttctgccttctactttacaaatgcccactcctttatgatccagtttaatttcatttttggtgtggagctctttccacttcaagaggctctttcctcgggggctctgtagcattttgtgcatactggaacactttaattctgcatttatatttaccccgttatgttccaaagtgtggggatggggtcttattcctatcttcgtccctaatcttagctgaggacttggtgcagaatgagggatctgataacatttgatcaatgactgaattaatgactaaatgaatgaatgaataagaacgactaccagaaattactgcattaagtgactatggaagaaacccagttaaattggtgttgtagggaaataataagttttataaaaagagggccaatttaaaaaatagaggtagattaagatacaaagtttcaagacctgtgcttttttaaaataagtgtgtccccaaatgcacaaagtggaaactctaggaaattagagcaaataaaaaaaacgaactggccttccaatgtataagtgctggactaagcactaaaatctctaaataaagggtataaaaggtaacgaaaaaattccaaagagattatatatcaattaactaagaggcagaaaggtgactttttaaaacgggaaagactatctttaatgacaggaaatccacatttaacagatgaggggcttacttggcaatgaaatgacagaaaaacagtttaaatgaaaagataaatatataattccttacagaacatagaataaagcagaatgcagaacactgggggcaacgagagcacttagttgtaccaaagacactctattactgcttaactgatacggaatttattagaaaattaataacaagccattggatagtaactgtctgtggttgttattccattccattttggctatattttctctgcaaattagtgtgaccctaaaatgttttcaggattgtccaacttgtcctaaattccataaataaactctttcagaggatgctgttttttgccatgtctctattacggttcttcacagatggaccatttttgtccttccaaagtctaagaataactctttcagttatcaagacataccaaaatccagttcagctgctcctgtgggattccagttagtttagacacatctgctgagatacatgcatttgaatccaaatgaagcttttgtttgattatacattttgaacatttatggaggttttctggggccaaaatgtttttcattttttggcacaccaaacagagatcttcagttataaacactgccttctgagcacctccaacagaaatccaatcttttcatgtgaacaggtgcctcaggaagtttttggaaggttttacactgaatcagctttccgattggaaactttctgaacatgcagtcaaatttgccaaagagaccttcaaacttgcttgagcagttttcactcatacagacatacattcacacatacagacagcccaagtaaaagcaaatcagagccctgtaaaactgaagtatttttcttaaaggttaaatatcatatgcaaccaaactgaacaaaaagaaatacacaacaggagacagaatgaacggatagcacgaggttcttcattgagcgtgtctgccttaaagccttacctagagtttaagctatacatcctttcagtaaagttttttatttcatctggtttcaaatatatactcaagcattcgcatttttaaacacggcaccatagagtattgctactaacgcctttcaatcacaaacccgttcaaacagttattttgaaacactgccttctctaacacaaatgggtaaaccagatttaaatgtaaaggaagaaaaaaaattactctttaagtcaggggttctttagcaaagccctcatcttacctgattccctataacttttactttccagtttgaatacagcatagactaaaaagttgttatagagtaaaataactttttaagccttaagcctataagtttttacagagtaaaatcactcccccagtgggcatgcctgcaattcaaggggaaatctgctttcaagttgttctaatggccccgaaccagatgctctaagatggccagaaacctttgtctacacccacttagcagatttctggctcgttatcagggactaaaaggtttattcacagaaatgaataatttccttcgaaatatcccttaccctatttacatgcttgcatattccttccattttgttttccccctacagctttactaagggaattaattatctggaagaacaggaacatacagtaagtacatctgagttacaggatgagacacagtatgtcatctattaggcctggctaagaccagcagctgatgctaaatgggaaggaacatgcaccaaatgttttttaatcacaaagttagtaattaattgctctttaaaatacattttatgcttctttctgtctgtgtacatgaaatgcacatttattacatgccaaaaattacaacattatggtttaaatgtgactggcacggaagtccggaaatcagagttaatgttcccacagcaactttaattctgtccgtgtgcacatgtagagctataatagtcttccgttccaggataatacgtatagatggttttgggagggaagctaaagacccatatcctcaactgtagttacaggaaaaaaatcaaaggataaaagctgtgctcctttccacatacgtggataaaaacaatgtccccacacccagtgttgtgtaatcagggaatgaaagaatctgctgtgatgccagcactcaaggggacagtttctgttgctgtgggaacctgaactttgcatttcctgactttggggtaattaaaatgtcagccttaatgtggcattaatggagtttgccataaaaatcttctgttttgttctctaaaaaattgcttaaaagttcaaaatgagccaagtgtactaaaaattttaatcacacagacttgggcgggtgaagcaaatggttgggagggggaggccaaggaaggtggatggcaagagttggaaaaggaagagcccattggcctctgtgagtgtccagccccagcagaatgatgctacctacggagctaaagttaaacccacccacacaacagtttggaaatgtgtaaaggttcaatgaaaaataaataaaaactgttcatgcgtaagtgcatcttggcaaagacacaaaaaatgagacagtctgatgaggccggtataaaacatgggaaggtaagtcaccatggatatcagcttccaacaaaagaaagacatcagaataggtggatctacagcagaagtagggaggacggccacagggaggaaaatcacttctttcaatgggagccttatttgggggaaaacaaaatggaagaaatatgcaagtaaaagttctggtcgcgtctatcacatgtatatgactgtgatgtgctacagcttgatagctgtcaagaaaggtttttcatatggagagcttcgtctgctttactgacttggtttagtcctgcttaagcatttaaagggagcacttggctcagctcatactcagcttgcttagtgagtaactgctctatcaaacacctagggtgttttttacccttcagattccataactcatcttaatgccttccattatcaccatgtgaatttgcttaccattagatttttagcaatggtgaagaggtggtaagctagggggtaatgggggaatattgctaaaaggaaattgtgttagtaggcgcactgcaaagcaacatacattttagcagcaatattaacctcatcatctcacaaaagaaagcatatctcaactatatttcttcttgttttgaataccactgggatcttttgccgaatttgaagaggctcaggaggttaaacagccaactgagaatttagggggtcagacttgtcatctttgctgtaaaacacagcctgtgtccttcatatgcaaaaaagatggtggcttacccacccatgtcagttcatatgcagagctgacttttcttttgtggcgatgctttatccatcatgttttacaacccagtcaccaatatgagtagttgcacattttcaagatgcctgttcagagccaggaatgccgtctttgggctcagaacagagaattccaataagaaatgctctcacaatgagagcaaatccataaacacccctcggtacccaaatgagttaaccacaagcgagtcttccatctacctgggtgtcaattttctcagttttctcatctgtaaattgggaaggatcatactgacaggatatgggcattaaatcatgactaagaataattttgctaaacacatgacaaataaaaaggtgctataaaaattcaagcacttgtgaaagcttggaacaacacacactggtggaatgtttctgaagttaaagagactaacaagtcaagggcactatttttaaatgccccaaatctgttagttctaaataggaactgaatattttaccttaaagaaattaggcttttaaattaatctatggtaagaatgacatttgaaagtaaaaaaaaaaaaatcctcttgaatgcaagaagagcatccaaaaattttaacagcttaaaataaacctttttcctgtcttctctcaagcaatctccaaatggacagatttctgtgaatctttcctaaaaacaattttcttctaagtgtaggctcaaatcaggacaaactacaatccaaatatatttggagaaaagtataatcaatttaaacaacaggttggaacagagaagacttacacatcttaatggcaaaatcaaagtgactgtctaaaaacagctggagatcaggtttctcctcctggtttgtttttccaactgagctcacatccactggcttccccagggccaccaaggagatgtatggtgacaccatactcacgctgttcctgaaacttacttcatgccaatgctaaggcctggccagaggatgcttatgataaagcacaataagtgaagcccaatgctttttctattcacaaaacattcatttttgctgtaacagaagatttctagcctaaggcaattctatgtaatccatacccataaggtgtggcagaaagctgggtaatgaagacctgcatgtagaaactccaggcccttcaccacaggaacgggctattttcctggtgggaagggacagtgtgcacatgcctatgggcactgtgccactctactttccaattctttctgtcattactattacactgaagattgccaggcaagaaggtccaaggatgtgactattaggacggtcctcagaacacagtccctgcttctgccccctggtttctctatagaagcctcaacttcgactgttcaaatcacataggccacagagatttgtctcacgttacttcccttttcattttctagtgacggctagaatatggtcttagcccaaccttaaatagaacaagctctcttcaccccaatcctgccgccagctcatttccctctctttagagactatcatgatgaagcaagtagagaatggaatctcctggaccattgtctcttgccttctttgcagaattttacatttgttctgtcagaaaaataacaataaaagatttagaatctcatttcctaataatttttgtctttgtggacaaaattttatttttgaaataaaactttgcaggtcttatgttactcattttaaagaagaatatgccagttatttgcatgttaccagacatcctttatggagatcagttcagaagagttgttgggtatgttaagactaaaaggaatattcttttggattcgactccaaagttatttcattcctttccattgtcaacacacatgtttctttttctctgaagtattgggttacatttcagaaaaagaaaaaaatctcctaaacgtgatttatcaacttgcttaaaatagaattagaagaagtgactcccagattagtgggaagatggcaaaaataaacagcaaagaagtgatttcaatagcgacgatctcattaagctgcccatttccaaatttagcccttaggcagtttttttaattaaaaaatatttttaacctggattctcattggctgtgtgaagtctgggtggcttctgaattcttggaagccattctcttttcttctgtaaatttatgctatcctttaaccacttcaaaataaattaaaaactggaaagacagaaattcagccaagctacatgagactccaataactaatgcaaatctgacttgtgttatgtaatttcaaaatggatgtttccttgtgtctaactggccttctgaggtccacatttggttgttcaatttagtaattgtggaagtgccattatccagatcaagaataaatggataccagcaacaaaacttcattttctgggttagtgttatgaaaagaacgtgttttatgtaattaatcagccctttaaggccaaatggcatgtcacctggcttttaaatacactctagctttgcaaacttatagatattggctgaatgaaaatggtggcacattacttttggctgctttagaagaccaaatgcaaagagctcgctctgaaagtagaaaagccagaacccagggtagaagcactactccaagcactgcaaagacaccatcaccttagtggtgtactcacaatcagatgacccggtgtgagcgtgagagtttgtcagtgaatgtgttgagtggatgagggctgggtctggagacaaaacagcttcaaagttcaggcagggaaggcccggcttggcgctggatccacccggctgagtaatctcattctcctcagatgccttctggttttcagctgtcttgggtttcttcctgaaaataaacaaagggccctttgaaggaactgactgcatatttgggaaaaggcatttttagaatctgttaaagataacttgattttttttttctgaagggggatgggagggagtccagtatgtcccttgttttaaaacaagctgattcttgttttttttccctccagtaatggcctaactgggaacacatgaaagcatatgggccaagcaaacagcaccacatttggactctgttggctgcataaaaagaccctgtcccagaactttagacagcttgagctacgtatggctgacattatccaagaaagcatccctcttccccccttaggagttttaacatggtctggaaaaatactagtggaagttttaccgttctagcatttgtcaggaagcttagagacaggactcgtggagtaatgggaggagcactggactgggagtcaggagacttgagctaccgtactagctgtgcctctaacttgctgtgtggccttgggcacctcacttcacctctctgggcttcagtttcctcatctgtaaaataaagggcttggattagaaggccttaaaggttccttccaactttaaatttctactcatggactacattaaggaacattcaactttcctgctcttattaagattttattttaaataaaatttcaaatcacaatttaaatttgcagcctgtacggatgagggggtagtgatgggaggtttctgttagagtagcaagtgaaaagtgaaaagaagagcttagattctagtagctaaagagggaaggtgtcatgcagagatttttctactccaactctttactcatcctacgcctaagatttttgatttggtgcatcgtcctggagtttagggtgtgattgtgtgtttgggacatgaggaagagaagggtgaagggaattagaaagtaattgttactaattgttatatggggtcaggaataggaagtaaaacagcacagctatcagtcagctcaggtctcctctccccaggacaatgcaactgatatgaaattaacaaatacttagcttatactacacagaccctagaccacagccaaactggtttattagtaatagttcctgaacatttctccaattcccttggatttgtgtctttttctatcattatgtggacatgaccagaaaaagcatttattttatttgtagaagactatgtgtggtacagaatttgttgtaagtagatttgtttccatgtttcccttgtttctgtgagcatggtaatgtacttgttatgcagaatattttgtatttaaatttgttgtgctgggtagttaaatctgccctcgcagaatatggtgttatgattagtatgctgtgttttcagtccaacaggttgtgaaataaaatctgtttcttcagagggcaggaggcagagatggcatggcaaagattagaatagaggtgaggctttcagacatctttttcagtatggaggaagccaatacaagagaagcaacaaattataagaccttatcaattgatttttgaatggtgactatgggagtaacccccaaatcttgagtgtctacatggaccctgaaggagctggtattctgattttcagtttaaagatgtagccaagatcaaagttgctaaagcccaactcctttattaaaaccaatgctttctctaaggtccatatctctatcactgttgtctaccaccaggttggaaacctcagggtcactatacaccttcctctgccttaaagccaattcatcagtaagttcttacagttctgcttccttcatattttttctcacatctgtgtttccattccaatttcactgcaatcacctactgctttttatctagctgattgtttactaactggctctccaacctctttcactcctctagtcctgtttctttgcattcactaaatctaagatgactacattagcctgacactcaaggtcagttccgtatctcttctaacttttctcatgtgtcctgtatattggccatactgtaccctcagatttcttgaatatcctccagaacatcctgggaatctacattctgggctctacatctttgctcaagttttctcttactttgaatatcccatatttcatctctgccctgttgaaatcatacttattatccttcatacttattaaatggtgtcttcatcttataactgtcttgattcctctctgccaggtaggacttcactccccacagtgaattcctccctaggtctttctccgaaatgcctaagctcttttttttcttaatcttatttcactcactcaattttatttcaataatggctatttatgtgcatatccctcttgtgagactgtaagctctctgaaggtaaggaaatgtcttagttattttagtattcctagtgttcacctattcttttcttcttccttctctcctgtcattcattcatttacatattcattttacaaatatttatgatgtacccatgatgtgccaacatgggctaaagaataaaacaggactggttccttccctcccagagtttactgccttgtctatactattaagcaatgtagcttagacaaagctgtcattcaataattgattgtggacagaatgaaatgaagctgaaattaaagtgtattttaagaacggtcatagtctgaatcccaattaagtttcctactttttatgcagcaaggtagcaaaactacctgactggctgcttttgctttaagtctgtgaggggtatttaataagagcaggactattttgctcagtaaggctaggctggccctcatgattcatttaaatatagggtcaaaacagtaatgacatatgtcacctagcagaaaaaagtgtttatttttgatattcatagacagggcctaggatactttcagatgtgtgcttcagaaaattaagaaagctttctttcaaacataaggacatagcaaaaccaccaatatattactcttttatttttaacactgcaaaaattatattgttcttcatatcaatgcccttgtttccttccctagattcgctcttgtttcctacctgacatcttgtatcacaccctcctgttgcctcagtgatcactttgggagaatattgatagcacagaggcattggagctacctctataaacaggaaatgttagcaactcaacctttttggctcacccccttatttgtcttatatcactttacttacccttataccactgggctgtttcccaactgtccagataatagagaactgctcaccatcctcagaagcaattcatgtcctgtctcaccctctctaatggttcttcggactcctttttccggagctgagaaaccctaaaacatagcacccgtttacgtctagacatgcacaggtgctgtgaattgaccccatttttgcagttcatagtttattaaggaggaaagaataagccctgtcataattagttgaaaatacattttgaggctgtataaaaagaattataaacatggcacatctgagggcaagtcttttcaagcctctgtggcgatgcactattccctggagcctttagagggcagcagcacactggctgactccagcggatttcagagaggcgaactcccgaccagaaccttcctcctggtcaccatgccaaaggttgatttgccaggctctggcctctcagtctctttcttttcagttctcattctctctctctctctctctctctctctcattctctctctctctctctcattttctctctctctctctctccaaccccttcctcctctctctctgttaaaattatacactctgatgaagtcgcccctcaaccggaaaatgaaagctccaatgaaaaagttagacaagccaacaacaacaaagaaagaaaccagggaaaaaggaaaagggggctggtgacagggaaggacttaagaataagaaaagggcagatgtttcgcaaatatatgcaaagcaaaactgggtgtaccctgaacacttccacagagaaacagaccaatcattgtgcacttcctcccgccacactggtggagctctgcattcaaaaaaagaaaaaaaaaaaaggcaaaaaagcgtggccgcaggcacccgcctttcaacggtcagttctgacattctgactgaacatctctcaattgtccaaggagaacaaaaacattttcatctcctcactgcaaacatttctgttatgagaaaaggctgcttcaagaattgggagtgtgttttaaggagactggcggccgagttagccagcagagccttctggtttttaactctcattgtgctggccccagcaagaagttttaggctgaaacatagcagtgagtaaggctgtggaggatgttggctctttcctaactagaccatattgtatgtggaaagaaatatgcattaaaacatattgatgatatggtaggtattaagcatgttaaatgcatggaaattaaccagatcggcggcatttgatgtatatatttcacactcttttgcacatattgcacacatacagtgatggcaatgctttctgcaacatatggaaaaataaatattttatctgtgtgagctcttagcagtctccagggtgttgagagtgctctcttctttcaccctatcccaattttctctcttcactgggctcccaccctctcttgcacgttaatgtgccttttacttatcagcttggtcttttcctatctggtaagtaatgtgcctgttacttatcagataggaaaaaattagttggaacctcctattggctcatgataatttagaccagtgatgcctcccccaatcttactggagtcgtaacaatttccctactcttttccccaacaatacattaaataggcttagtatctgggcaggagagaaagggtaggtggtaacaaaccaccccaataagggtggtagcggaactgcgctccactacctattagctgtatgtcctgggtagattactccgcatctctgagcctcattttcctcatctgtaaaatgggaataataatacctaccgcttagggttattgtgaggaacaaatgagataagccatgtaaagtgatttgccttgtgctggcacatggtaagagctcaataatggtagttcctctcatagggattgttagttctgtgatattcatcatgttagctttaagaagacatttccgggcaaggggtggtagctcatgcctgtaatcccagtactttgggaagtcgaggcgggcggatcacgaggtcaagtgatcgagacaatcctggccaacatggtgaaatcctgtctctaccaaaaattcaaaaattagctgggcatggtggtgcatgcctgtagtcccagctactcaggaggctgaggcaggagaattgcttgaacccgggagtgcagaggttgcagtgagccgagatggcgccactgcactgcagcctggagcaagaaaaaaacaaaagaaaaagaagacatttcccttcatttcagtaatctgtttagatatctagattttgggtaggggcaaatggattgttattgtagcaaaggcagaaacaatgttaggaccagcaatctcttcctcaacatttgatcttgctgtatacttcctgacatctcctttctgctcacatgtttgtcattgctgtggctacactacaccatgagctccttgaagctgagggttgagcaagctgcacttagcctatagaagcccatcaagcctggacactatggtctattcattgagaccaacctatgggactctggcttatcgtgttttcttgcaatttatcatttctctacctggtctgatgtcctcacatcaatttaagatattttagtgattaaacacattttattttctcaatcttattttttttaaccttggcagggctgatttataatttttttttcagtataatttcctcttaactgtatcagtcaggatcctggcaaaaatagatggcacatgcaaagtttttagctaaagaggatttaatgaaaaaactgtatttggagctgcagatgaggttaagggacctcaagagagatagcaccaggtactagcaatagtagagactgccaggtactagcagtagtggaaagctttaaaccatttaaactgaaggggcaagtaaaatggtgatgaattctgagtccagtcagaattggagttgggaaggagggctgaactaacacatttcctgacctctctcttcccccactttcacatctcctgctgatgtctccttttggccaaattcaaagggaagcccaaggacaagagagcctgggtaatgtagtccagaaggccagtcttctgggtcacacatcagggcaaaagaatggttctggggtttttttgggggtagaatggggtggcaagactaatcaacatatgtgttcttctctcttatactttcaattatactttctggaaggaaagacagaacaaaataaaataggttctgtcttagcttccatgtacctattatgtcgaattgccattcacagagcaagaaaagagaatgctgctcagccgagcagggatttttgtttgttttgcttgctgccatattcctagttcctagaacagtgtctggcacatagtaaatggtcagcaaattttaaatgactgagtaaatatactcacctctgccgtgacagactttatatatatatcatctcattgacttatcacaataatctggttaagtaggcagggccactgagcattattgtgcaggtggtatggggggggtgggtaggtattaaaatttaatatgtgcctccccaacccacttccaagccttgtgactaggcccgaagcattgtcaacccaccagaagagatatacttctgtaaatgattcacattttaattttttatcctctttattgatttttgcacctagcaagtttctgttttattattattatttctcttttatgcattggaaagccaagtttctgaatagcaaagactgcaaagattataacccagtctgtccattctctagggcccatgagaagtaaaagcaggcactggcattctgcacagatgaaatacttcctacgacaggaatacatgctcacttgtggacttctctgtaatctgtaggcaacatcagctcctgatttctaggtctggatctgggttctctgtagcacaggaaggtaagagtgataagaactcttttccctcttaaaggatatagaaacttttaaacccatctgcatcatagtaaggctgtgttatctgtatcagcatagttactctgtgatgaagaaaaactcagaaaactatccagatgtgggaatttctcgggtattccttgcacttgaacttaaggatgaatgaaggtatatacaagtaagttccttgtgtgggtgtggactgaagaaactatgtttgatcttctgtcatgtctttagtccccagtaactcagtcctattagtactatagaacacattcccctccgggaaaggcaggcctgtctatcacctacacagcagcccccatcaactatgattcagttgactggaagcattaaaggtaaaaaagcaacacaaaataaagcaaaactctggcttcatccctttaggtttgatttataccagaatagctaaagacatagaaatatgaatgtaaatatcctacctgaagcctaagagggatgttagtctcccaggtttagcgttttccagtaacatagaagtctgtaaaacaccatcccattacctgcctcataacatataggaaaacttgtgaatataacaactagttattgttttaaaatgtgtaattaagttactttgcatgcagaacttctaaataattcaaatgactggcttttctattggaaaatagcatatattcatctgttatttcagcaatgattaatgaatacttgatatcaaactttcatcagtattttcccataggtatcatatcccctaccccaaattatttctgtacttttccttgcaaggtctctacttctcctacataaatgccttgcatggcgggaactaaatcaactacacagacccatacatccagagagcagaggtgagctggatacaagtggcttagagatgtggtggaaggaggccagagctccaagggaagggcagcaaggagacaacagcatgggttgcagctcagacaacaggtaaataaaaccaagcaaagctgctggtcacagatttgaccagggtggcaagaaatgacaagctaccatgagattcaacagtggcacggaaggatgatgagaagcaaacagattaggagaagctgccaccaccgtacatagaggcacagatgaccaagcagaacagcaccagtccctgcaaggtgtgctcagatacagctcagcacagccatctggccaggagggaatgataatgcacatggtgtgcactgcagccgggaagttgagaaccgctgtgggcacctcaggactgagtctggttaccctgctgatccaagaaatgaagccatctaaaattttgcctgctttcacaattttctgtgtgtgtgtgtgtgtattaaacaaagtgaactaagaagccttttattggagacataatgtactcacagtagtttcaaaatcaatggtgtcactcttcaggtaaattactccaaggcttgggcctagtgcagatgttcattggggcagggagcagagagcggctgcatctagatcagacaaaaaacaaaaataaggttgttaaatgaacaggtgatggtgatggcaattatttattttgataggaaagaactttgggacttgagtgagaggttggttgtttggttctacatctttgcaccagagaatggcgaggtacggaagggagaatggagaggatgttgtccaggctccattttcagtgctttcacctaactgcctgtgcagcctgggacatcaacagtaccctgtcagtgcgggcggagctgattttgtggttctgacttagaagctgagttgtgggtgacagtgggggaaggaagtagaaacagtgtccttcaaccttcccacagttgattcttctagtatccttttcttttttttttcatttattatatttatttattttttattcacacataaaaattgtatatatttatggtataaaacatgttttgatacatgtatacattgtggaatggctaaatcaaactaattaaaatatgcattaccggctgggtgtgctggctcacacctgtaatcccagcactttgggaggccgaggtgtgaggatcacgaggtcaggagatcgagaccatcccagccaacacagtgaaaccccgtctctactaaaatgcaaaaaaattagccaggcgtgatggcgcacgcctgtagtcccagctactcaggaggctgaggcaggggaatcgcttgaacccgggaggcggaggttgcagtgagccgagattgcaccactgcactccagcctggcaacagagcaagagtccatctcaaaaaaaaaaaaaaaaaaaaaagaattacctcatgtatttatcactttttcatggtgagaacacgtaaaacctactctcagtaattttcaatatatactacattcttattaacgatagtcatgaggatgtacagtacatctctggagttattcctcctgtctaaccgaaattttgtgtcctttgactgatgtctcctcagcgtctggcagccaccattctaatttttgcttctataaattaagcttttatagattccccatataagtgaggtcacgtggtatttgtttttctgtgcctggcttttctagtacaaaaaaaagcctattttttccccatatatcatggatgacctctagattcatccatgttcttgcaaatgacaagatttccttctttttgaaggctgaatagtgttccattgtgtacttttaccacatttctgatattcttgatttcatttcagtctctctctttattgcttagttcttaatgtattctagtgacacccattgatctgggcatgttctgagcattccctctgtccttcactgcaaaggctccattttcttccataggctctaaccctgaggacaccgaattaccctattttttcccctatacctcagtctgctattctgccttcttcactggcttattttctttcttctgttctctaaatgtagacattcctctagatcctctcctcaggctttgtctaccccagtcctccctgacctcaacaatcacttctccatggagagcatccacattgctatctttagttctagcttttctacagagctgcacacccacattctaaataacagctggttattggttcattcgttcctttgtccattcattcagtgtttatatagcatctatgaggcacctggatgaatacaacagggtctctaactttgagaagttcacatcgccatcaaatactacacaggcttttctaattcagaaagtttagaacttaattcattgtctttcctttaaaatctgttccttctctagacgtcccatttcctgccattggtattctcttcatccagttacgtgggcctacagctggggagtcatcttcaattcttccgttttttttttcttcctatatccaattagctacccaatcctgtagattctactctgattgtgattcctgaatcaatacctgttttctataccagcccctatttctccctttgctacctactgtgaggacatctatgaaaagctcctgactggtttcacttttccagtttttctttacctcttgtccatccttcacacaaacattacattaatttttctaaagtgcccttctaaacatatcacttctttgcttacagtcctccttgcttattggattaaattcaaacttctcagtttggtattcaaagctgctacaatgtagcccaatctagtttctcactcttatctctacactccattctacgctccagcaaagtcctactctttcctaccatgttcatggtatttcttcctttctttcaatgtctacatgtagcttcttcaagggccatccaaatgccacctcatttatgaagcatttcacaaaggagagtgcccttcttaaatattattagcacattctgtactactccctttgcatattctaccaattagaatggttatttgtgtaatttgtcttccttcttcataagccctttgaaagctgagacaatttttactctgagtaccctatagtgggccatgacttcttgcacgttaagtttgcactaggctgataatctgctgaactgaatttaaaaagaataaaccctcttgccttgagtcatagaaacggggactaaattgaaaagacctaaaagctcatctgcttcaaccccctcatttttcagacgaagagatgaagggaactgacttgctcaaggtcgcatccttgttagtggctgggcaaggataacagacataaaaggccacagactaatatttatcagtgcttacttggcaccaataggcccaacagatcatcagtaatgacaagaccagagagagggaggttggggtgtgtaacctgcaaaaatatattgtgttccaaaatataacaaatttgcttcatttatttgcttcaacaaaccgaactaataaatatgttttatagttaaatgttgtctaaaaaatgagggtggatttaaaaaacaaggaagcaaagttttctaacattaccagcagaaataattatgacaatactgtcaacaccactggggaggaggtgcggatggttaatgggtacaaaaaatagaaagaatgaatacgacctactatttgatagcacaacagagtgactatagtcaataataacttaatcgtacattttaaaataactaaaagagggtaattggattgtttgtaacacaaaagataaatgcttaagaggatatatgccccgttctccatgatgggattatttcacacggcatgcctatatcaaaacatctcatgtaccccagaaatatatacacctactatgtacccacaaaaattaaaaacaaataaaatgttaaaaataccactggggtgataaactcaggctgaaaataagaataaagaaatttctcatgctttggaaaagctgtgtgttcagctggagttcttggtgaaaacatgcagtaattccgtggttaaattcattactttgtagaaacaaactattggcaatctgctattatgccacattaacacttctttttccacctagcttagcctagtactcattctctaggtttgtttaaatgtttacttgtttttctttccttatattactaatttacttgtagaaatgcatagacaattgcctctgagtctgttcaaattttcttgccttgttcttctcttgtagtagaggaaacattagttgtttctcttctctatccttatcctcaaacagaatcattttctctcacccaaagatgaaaagcccaacaaaacatgctgtggggataatagtgtttacctaggtgaggaaaacagacttttccagggaatctcagtaattattacttggccagaaaagctcagctcttaaatgttagctccaatactacaagacctcatctgcatctcccaggtgagcgcttgactcactgttactcaccagaggaaaaccttggtaggtagcattaatcaaactctttttggccagtatggtggagccatgctacgcattgagacatccattaaatagcatcaccccagcagccacacaaacagcaaaatgggctcaagagctcttcattgttctttctaacccatcataaggctggacagattattgacacttcaccagatagaacttacttctccttttgccccctggcaactacattaaaatcataaaggaaatcactcatcaatagtacattgcagtgaaaaattatctggcaaatttacaaatcctttgtgtaattatataaatgtacattttaaatatatctaaaatctgatttacattgtgcattttataattaatacaaccatagtatgtctgtcctttaattaaatccttctttctcagtcccacatcctgctgctataatcttactttcatttttggcaaagtgtcacctagctccatcttctttccccttttgccttagtacacacctgagcgtctattaatcagaaccactgcatggtgtgtcatgttttattgcttaaagggtggttacactctaaaaaagattcggtgagaatgacttcatggggtttcacatttattctcttttaatgactttcatatccagtgtactcggtttttaagtcaaaagataattttgaggggctgctgatgccacaaattctccctagaacctgaaaatccagctgttgtctctgcttcttacatcatcactgtaataaagaatctgctcttggaacccagctggcaagtttcttgatggtgtcagaggcgaacagacagtaggtcacttctctacagcccgtttcattgttggcgtttctgcagatctgtcttggaagcccttagagagcagagctgttatgaaatacactgccacatatcaatgtaaggaactttctgcagatgtctactttgagtatggcctgtcccagtcctaggaaatcacaccacatcgttctaaaattatagatggggggttcatgattaaagtttacaagaaaggtaatagtaacaataacagctagcatttattggatgtctaaattttatcagggactgcaccaggcatttttataaatgagtatgttcttgtttaaccctcatagcaatgctatggtgtatgttttagtatacccattttacagataaggaaaagtgagacttaatgggcttacgtaacaggtcgaagtttagaaagctactggatagtgaggccagaatccaaacccagatctctctgagtctaaatctgtactcttttcactatataacaactgttccaatgcagcatggacacgggacacatttctagttcccgctgtgatcacagtacaaggaagatgcttatttccacgatggttcagagccactggaaagatctgggagcacagactccaggagaaggaactatttcagaaactgccaataagtatagtcccttccctcctcctttctaattgcagatgagaatgtcctctaacagtcttctcaaactctaatgaacaaacgaatcacccagggcttctgattcagcatgtctggggtggagcttgtgatcctgcatttctgagaagctcccaggtgatgctgatgctactggtctgggaccacaggtcttatttctgacactctcctttctactagggttgtttttgaaggagcagttcaagccaaataacttggctaacagttcacacagccagccgactggcttctgattctaggccagtttgtcaggtcatcaggcattacacagaattcaaggagttcttagcatagagcacactgtcaaaaaattgtttttagatccccaagggttttcccctctctctggaaattcaaaatgataatgtctctaacatgtaaagttcctatttttttacattattgttatttttaacaataattatctggtaataattcaaataacaccttccctctgagaaattcaatgagctttactaaccttaattgtctaacagcaattcccaggtgaagataaagctgtctcaaagatcatagtaaatttaaaattgttccacttccctcgtttctttgccccaaatgtagtggtgagttagtggggacgggttactaattggcaaaggcccactatcataatttgaggcacagcaaatttcataaaaaggatacatctaagaaatatttagcagagaggtcattgtggggaatacaatgttagaaaaaaaagagttagaaagtgtaagataagaaaagagaaagcaaaatcaggactagctgatgacctccgatgagacatttaacctctaggtggctcagcttttctatctgcaaaaagaggaggttggttttatgatttttaaggtcccttaaaactctaatagtcccctgagaaggaagatgtgggaattaagtagctcatcaacctgttaaaccattaaacatgttaaggaagtctatttgacttttaactttttagctaattacccgaaacaaattcccaagtctacgtcaccagccccacctctctggaaagtggtgagaaaaccatttaatgaataaggcaccaaagacatcacggccagataaactaatcaggaacaccatcgtcagcttactgatgctgtgataactattttactttttaggttttagttccttaattaaccactagttaatacccatgtccataagaaacacctctgatggcttgaagacccctgggatggccctgccaacacaaggtggaatcacaatcccactgtttgtcacattaaatctatgttaattttctccatagagacctcttgattcctctttgacagttcataaactctgttaatataagttgcacatcccatgccatgagcgttagcattatcagatacagttgattcttgtttaaaataagagatcttttggatcagagtacatgtaaacacacacacccacacacccacacacacaatcatgaatttctggtattaatgaatctggcctggtgatgggaacccctctattatgtcaccggatactggaaccttcttatccagaaagcctgccacaggtcatgttaataagatcgttttaaactttgtaatgagaattctaacatgagcatgatttatgacacagcattttatttggtattatcagagtttcctataccttacctcttacagtgagtatgtgttctgaattaaccattatagtttgtggtaaatggaaaaaaaggtacagagaaacatcacagtggcattactccagataacacactctgtcactgttcccaaagtgaacatcatttccctcttcctgctcccatcacttcaatagtaactttggctattactgactaaatgcttaccgtgtggcaggcattgagccttttcacagataactttattttcttacaattactctttgaagttgggaattatattcccattttatagacgaaggaggtgaaactgatactcaggaaaggtacagttattggtcatcagtcatgaaggcagagggtagcaaagcagagttaagggccaggttctaaccacatgttctagagcttaacctataccaggctcacaatcaccaaaccactgatctgccttcattccactcctcttcatttgtgatccccaccattggcttaggctagattcttcttcatggctctctcatgtcttcttgaatatttcttgaaatttctcaaaaccttctacacttgatttatgttttccctccctgtattaataatttaatccaaaaactcattaacacttcttttcaacagactttatcaccccttttcttagctctcatactccttctaaattactcttttgaggcctcacatttgacatcagatgttccacacccagctattgaactcactttcccagaagcccaaggaacctattgttttcagctggttcattagtaggccccagttggccttaccagatgtatttgtccagtttgatcttgccccatgatcaaccatttcaacactgtcctcagtaaccatgcagatttccttccttttctaactttctatgtgcagtgcctccttttacattcatcaactgtgaatctgtatcaccattctccatttgctcccactctcagaacaaaaggctacacatgcatgctacctggacctatgctcctgcccactgtttccaggtacaacctatggcagtttttcttagtttgttctcctttatgaagtcccattctctttttcagttgatgagctagcatcctagtttaataaaaggatctacaccatgcagtgtggtaagcttattagctctcatctcctctaatatctctgaattttcattattttatttcctcaggatatatcttttcccatgttcccttcgtatcttgaaggttattctctctacttctctttatcttcctttggtttcatcagggatactttctctgtagctgatagcatatcaatttctaatagtactagattaatcatcaccacataccttttttttttttgtcccgcattcaactcctgcccttcaaaaatcttttcagatggtgtatcttaaagtgtgtttcatactggaacttcaagatgcatctcaaaaaaagttcctcagtcaagtaagtttaggaaacactgaaaactatatattctattttcaaactcgcaagtgtacacaggatattaaggtgctggaagcctaatctttgtccaggcttaccggattacagactcccccatccccctttttaatggaacacttatttaacctcagaatatgcttcgggaaaagatgctttaagggattcccctggttccaaactcttaagcctgggctcggaaattcactgactccctatcaaatgagtcctctcagatttcctttccattaatactccacatggtctaaactggttaacttatagggtgtcagaaagactaagcacatttctatctctgagctactgtatataccagtttggctgcttggaatacctttatcacctttcaaaaaattatataggacttttttctccttcagggtccatatataaaaatgtatcctttatgaaattttcccttgtgaagactgctttagcccataatgttttctgccactttttaagtacttcaataaatggttatggtttactgcctgtttgctatattattagcgagggtgtacatcctcttgggtaggaaccttgttttatacactacagagaccccagctttttgagcacagtaggatgttataaccatgtcatcggttaatataaacagaaatggatggcattaagacatgatggtttaaaacccaatttctgtagctattggaatagtttaagatgctaacagcccaggtgaaatgttccatcacaatattgggaagaaacactacccgccatcactgccattgccctgaaaatgataccatgtgtgtctaaggatgtggataaaggctagatacagaagagcaaaggcagctccgttcttaggtgaaagtaagaatttgcattagttaacaccaaatggcgataagattaaaataatctaggaacatcaagtgatccatgaaaggaatcactggaatataccaatggtaaaattaccattcataatcattaaatcatggtaacttgatgaaaagaaaaaggatattttcctacttaaggaagtcagggtaagtattgtctgaggttccactgtgtgctattgtgcctggtatacagaatgtgtagcaactatttacagaatctgctactgccttctagtcacattccaaattctatctctttgaatcagtctggagacacaatacattggtgaattcaaggcagcttggcaacgactggcacaacataaaaccccaaataatgaattccatctttcccataaagctcttttattgacacaacatacaacagcgcagggcaggttgtctcgggctagtgtgtaataactagatgttaaggggccctgagtttttcagattagatgttatctgaagttgggactcagcaggttccctaacagtgaatttttagtgggcctacgactagaagtttggtctcttgatgcttagtcagggagttttattatgtgagagagaaaagtatagctttctttcttaaaactgcagcaatttcatattttagcagaagagaaagtgcattttattagagtataacctgtggagtattttgctaccttcctggatataaagcggtatacaaacaaaaaatttaataaaaagctattttataaataagaatgtttacttgtgtttaccttaaaataggtatagcttgtattatttaacatgtgaaatagaaggataatggtaaaatttcataaatataaaattctgtgtccgtcttcagttaaaattcgtaacagtgtatcagagtgttggttattagtagtaatcaataataagtattttttaaattggaatttttattgcaggagattattgggtgggtgaagctaaatggcctagatgttttcctgtcatgtcaatacttaagaattgtctttctgggcaatttacacatgtgagagtgaaaatgaagggtggcctgcctattgggtgtgtaacaggccaccggggcaagactgctattttctgagagccatgggcagtttctgcaataaagtatctgagtttcttctttttgtagtaaaaataaatagtttacttttatgttctgggtgaagcctgagatctctggatctctttgctggatttcactcttggtgggggcagggagatactattggcaatgctttatatatattgacctagacatgttaaagattatgtggtactttcatgaacactctaaaaatgagttctccctatcatgagttgcatagatgaggagattgaggtggatggggtgaagaggaaggaaagggcagtttaagcgggctagctaatgagtagtagaacttaatctaaaaccaagattttcagcagaaaatgctttttttccccaaaaaatgccatggttgtcaacaagctttgtagcaaatctggggcagagcactagatggagaatcagaagatctgccttgtcttcctggatctggtaagaaccagccgtgtgaccatggccaagtcactaacttttgtgagtcttattgttctcacttataaagtcatgagcaaggaatcaatgaatggcataatacttgtaagctgtaaaatctctctcttgtaaaatggtattgacaataatgtatgctttgcctatcttataaagttgtgaggctaaaataagctgatccatgtggaagtgctttgtatagtgtggagtactgaatcaatgttgtctggaagatttaggaaagggtcccgaatgtgtgtgggaactgacagccagtccacttccattcaggttttaggagaagctataataaagcactggcagcagctcaaatcccactccatcctctcctctcccagcacgctgcagagaatcacttgaggaaagttacttgagtgggtgagccaaatgctcaagttccaacctttctgagtagaagccacagtgaatcctgagccacaacacaggtgacaatcactgttcctccaggtgtgtctgaaacactgggggaccctagggaaggaggtcagacgtcactgctcctgaggacccgttttctcctgtacacagctccagcccacatgatttcacctggcagccccaagagacaaaaaggatccagaattagcaggagcctcctctcctgataacctaagtgctctgattgaaaggcagagggtatcaggagaatggctgtaccgagtcggcattgatttctccagcctttgtctgtgtctggtttctgtctcgtttggaggtggttactgttactacaagcagcatgaatcatgtctctgttaaaaaacagagcttcaattgtcttacataacccctggtaactgaacgtctaataatagcaagccatttccaggtagggaatctgtctacctcccagacacacacacacacacacacacacacacacacacactactcccaatgcttcacagcacagtgagacagacagggaggagacagaaggagaaaggggacagcacaattgaatttttttgtgttttaaaatatattgaataatcatgcatcatgggatctgataaccaatatacttagctgagctagtttaataaactgtagaaaacaagaattcttctttaaagtatttgaaagtatcccaatccataccagacagacaccttctctaacactcttatactgcataaaaaccccaaacccccaaaacagagtggggtgaaaatttcactggattgtctgctagcttgtaccaactagcttcaactttcaaaggattttttttgtcctcttttttgtttgaccagagagtgatattccaaaggttcttggccgagatcatttcataaaattccagagagtgaaaggcaactgaaaacatggctgcagtgttccaccatgcagactatgtaatgtcaggcacttttgcccgagccactttctttgacggagatgactttccatctgaggacttacatttttcccatgagtacactctctggcttgtaatacatgatgaggtctttttatacttgatccccactcagctacccattaaggtggctactgaaataaaaaaaaataataggagaggctgaaaaatgatttttgaaaaatcacaaaggtaggattttctttaaactaccaatttgtttgagaacaaatacaaatgctggataggaagtttaaaagtttatggggaataataatataaatgtataacatatatacgtccatttcctcactgcttcaccttgcccatgctaggaaaaatcacttaaaggctgtattttttgagtgtgcattctcagagtgaagtagctgtacatatcatgtaaattggactggggaaggacttcgcagaaaattacagatggcaatcacatcctgccagtcatttggtctagaaccagagaagaaaaactttcttttctcttttgattgttcagtaacatgaaacagtggactagactagttcaaaccaaagaatgttttagggcacacccactttgaggaccagcacctggctatgctacatgctcttcaattgtttaggcatataaaaaggagtgatgagatggttatatgtcaaaatggctgttctccctccaaacaggatttgattggcttatttgcttttggagtactctccaaatccataaacaaaggagtattgaattgaagaagcaaacaggagaaagaaaaaggctaaaaaggaaaagagagaagaagaggaaggaaaaatactaatttctcagtattcctatctgcaaatctggctggatttgataacaaaactcctactactgttctctaatggtctttgctgcatgccatatggacatggcttctaaaggggatgaattctaggttttcctcacaaatatccaagcacagaacagcagggatcttgacgactaaatcatcctaactcacgacgaggatcacagaggtggaacatggctgttgggactagattcttctgcttatttcatgtgctttgtgaattaaattgttcgtagagttggaaagctggtggactaaatgttttaataaaaacagccatgagacacaacagttttcttcacaaaggctttcccccctagctactgtgaatatattgctgaatggttctgacttctggaagggcaggaggtttgcctcttctctttgcctcaaaaaccaggcttattctatgcatctgggagatgattatacttacccgaaatttcaggatactatgtcagacagttccttcacagtggtgtgtctggcacctaagcaaggacttggtgggccagacacatttaaaatgtaaaagtggatgattatattattttgcattgtaacaatgagagtatttctggattgtagctgacgtgtagatcatcataaccatatgtggcacaacaaaccacacaacattgcatcagaagcttgtagttaatatttttaaatgattgattattttgaaatagagaaatggtggatgcttttttcgacctctttaaataaccacttattgaatgtctattgtcagtgatggactctttcttcacagaagggagctgggctatgccagactctcaccatgttctttctcctctaacactgaacaaaatatcagtaaaacaccaagtacagctggttttgaacctagtaagaaatcagtctgtagtaatgggccatattggtaataattggaactggtgatatcgatagcagtgggaataactgacttacaaaggcacagcagttcaggaacgtctcagggactcagagtgggtaaatgcgtaaatctgctctcacctatttatatgctccaacaaatatctggaactctagaaacttcaagagtctaatatgatcaggccacgtttataggtattataggattcatataaaataaggaggcatacatgttgatctagtgagcgtctccatatttgtacaacactcaggatatgtctgagaacacattttaatttttagaatcagctatagaatctggcagttattataaagcaaacttcacttcaaaaaaattaactgagaagccagatgataatccagatatacaaaacaacattggtgggataagtcaaataattctctaaaatgattatggagaaactgaagaaatgaagggcacctatttatcatatgtgggtccccagccacgtttgtaatctgttgtgtgaccttgggcaagtcatgaaacttctctcgagtctcatttttctcatatataatgtgggagtgttagattagatggtttttaagattctttccagtaataacatttgatgattctaaagtaagaagagatgaaagagtaattcctctttcctcttgttttggtaaatacttgctttctcctgctccgtgcctatgcagtttgcagtgagtattaggtttctggactcaagaagtcaaatagtaaatactgaagctatttttccttgtacacatggacaaatcataggggaataatccttcctttctttgtatatcagtgtctcttctcaaatcagacttatgcctaaggtaatcacgatcattctggtactaataaagatttttcctcatccttcccacaaggccctcacccatgctcatgaaagcttatgtgattgggttatttctatatttatgtcttggctattttttctctttcaacttgtttatgaagtccctggtaagcataaagctgcaaaaacaaaaacaaacaaataaaacaaaacagctctgtttgaataatttacttcagttgaagcagtataagaaaacatcctaacgccgaggggaagaaaacaggtcataaaaataccctggtatcttagaaaagactaaataaaagcttatatcaataatagtttcatatgttattgtctttcattttcaaagagaatggtacatattggctttatagtctggtgtacagacgtggctatttttccccatagctctcaggtcagtgcatcctcaaagccaagaaggcccagagcctgccgagctagctttacataaacaaaggagctacacagaaaacccaatacccggagcttatatcatatcctgactaggcactctggttacccatgactcgctcttttccatctgtgccctgattctctgctggtttaattcccttcacctagaatgccctcagtttgcctccttttactgctcagaattccctctggacacaactcacgactagcataagccccatttccaagaagcagcttagtttgacccaacttagtttgacccagcgaaaattttcatggatagcaagtgaaaattagtccttgtgataactggagtcactgaaaccaggtatctaggaagcactcagagaataccagagaaaaactttcaagggttgcagtgtcctcataggaggaaaaaaaaaatcctagctttaagaacaagcccaatatagaagctgtggtatgtaagagaaaagttgtagccatgtacgggaggaattgtgttaaaacagtctgactttttttttccaataaaggagaagagatcctctgtttcttaaaagaagtttagtcattggatatagcaacatacagtgtcataaagtttaattgcattaattatgaagctaaaatgtctacattttagtagagagaacatggggcatagctaaatggcgaagacataggaatgtgtatacaatttgagtttcacttcctccaaatctctcagttagaggatccctctcagtctgacggtcttatcatcaacagcttcacaaactctgacaacacctggctgggtttaagggatgggccatgatatatcttgagagtaaaagatggaatgaaactcagaaatgctgaatgcttttatatatgtatacaattttatttatgtgtatatttatatatcaatatatacaaacatatatatttgtatgatgtttggcaacctcactcatggtattcctgtgaagtaggcatgtggtaaacataattagcccattaaacagatggtagggctctggcatatctcaccatattctaaaatggtggagctgtaagcagggactaaagagagtgtagtttgatacatggctaactgcaaatctctgtgaattgctactttcctaaagacaatctgggtaggctgcatttggctgagaactggggatagtttaggaagctttaaaaatatacaaagggacaacttttcacattcattcagatatagtatcttcatttttacttactagaggcatttttttttaaaaaacagctttttatcttaactcatctgtgttccaagcaaacttccaaattgctgagcagattaaaaaaaaaaaccctacatgccaagtagaaacactgggtaaatgttattttttaaaattgtcttaacaaagtgcacttttggaaaggataaagttgaaaagacgtttggtactgtaaacacttagctgtcattgtagcacagtgaccaaatacgtccaaaagcacatgtaatgaacttttatccgactgaattatatgaccatggcattgccactctatagtacagcaggcttcagagatcctgttattaaatattctagcctaattctttatcatttgaaataggatctagcagaagtgaaagagttactaaaattaagacttgaatttacaagtgtgtttgaactggcttcaggaagacatgaaacatcaatacatctggagaatagaacttgcaattgactgttctttaccatctggtctcaagaacattttctgcttggaagttgcataagcaatgaaaaaacacacaaacaacttcctgtaccatgtttttggtcacttataatgacgcattacaaagtaaaccagctaaatatgagcaactgcgccttactcgagatgacaacatacattatataactaagatcaatgaaaaagaacatctttattttaagagacctggacttaaaatattcaagaataaacatccttccttctaaggtgtttgtactccttctaaggtgtttgtactgagtagttttggctagacaggtttgtagagtcactactacaaaacaatccctatattttttcaaactgaaaaaggatataaaaaagcaagctatattgaggaataaaatgttccatatattttaaaatgttttttaatgacataaacttgcctttttaagcagtaaaatatattctacacatgtttttcatagaaaacttttacatatctttgttttcttaaacacagtatgttgatgtaatttaatttttttctatgatacagggtcatccttgtgactattcattgttcctgttttacaggaatacacttttcttacttgtggtgagaactggcctcatcccttggctcagcctaacggccacagactgagctatagcccactagccactgccatagccaactggcgtcactgtcccagtttttcagacccatcgcctctaaatcctctctgctaaatgtattttctaatgtgctttggattagaaaatcaaataaataagaactgtagagacaatactgcttgaatgcagggtttggtagaagatttgggggaaactcatttggacacttgaaggtcttcagttacttctttgctcagggttgtaactcagagatctgaactaccagaaagtggattttgaggtattattgtgtaacacagagtgaaacatttatgcacttttattgcaaggcttcttattttaaacagggttgtccagaaatccattcttgattactttacttgataggtctctgatccattatatttcactcccttgatttcctccagcaatgtaactaacataatgacaattgggaagtaaagaaatagcacatttttaggataaggtgagagagtcttggtaactgacttcatcatagtgatggaggcaaaaatatacagtcaagttagaaaacttccctggactgctaatgggaactctggcctgactagacactgggaaaacattaaaaactgtgaagttatttacattaattttcagtgttcagagaagtaacatctgatcatcttttttcctcttctccaaaaggagaagtcagaataattcgcaatctgtgataggatagggattgtatcgaaatttgcctttttattacctctgaaaataggatttctaagcaaactaataaccttaaaactgttgggaggaaggatgggggaaaccaaatgtaacctatatgaggggggggaaacatctttaactactttaacatacacacatctgataagttactgaaaattcttatttattttgaagttagtgctgaagaaactctatctgttaaaacttagaaatctcagttcaaagtacatggaaatattccatgatcacgttttcagctcattctagtcgtctgtctcccagtttatttgaactgatgaaattttacaaaataaacttctttagctttctagagttacgtttttacccatgtaatctatttgttaatttttgtagcatgcttatatgataaaaaatactatgtaagtactgagtttgcttgttatggattatttctggatacagagaatttgcaagaaacttcagtttacagcagccaaggttactgcagactaaagcagaagttcaggcataaacttgtcttctaccagttttccacaactttgctgttgacagcatctgaggacatggttgatgagttctgaaaatcattcacaacattgctaatgtttaggaatcttatagctttgccggacctttccataatcacgagagaaaacctttgacgaaattagaacaagtcctcataccctcccttcctttcttctagtgatttttttttttgtattggaacaatcgaaagattcaatgtttttaaattccatagaagactaacgattgaataattttctcacatctctgtttgcactttcgcagtctggttgcattgatttgtgtctcacaagtagacatttcctttgttggtcacaaatcaatgctacagaacaaacctgccagcacattccacccccacccccaattttttgcagtttaaaaacaaagcacatttatatactttttcttttaaaaattactttcattggttagtaatacactaaaagaagacaaagcctcagagttaaaaatccccgggagaaggagctcctctctagctggtctctgattctctcacactgcctggagcaaagaactgcctagtgggagagcagcgctcgtccgccgtccgctcctggtgtgctctgttaacccaattaaggtcctcgccttcatacatcacaaagctgcccaaagcaacacactgtgatgtcacagtcagatatgatttcatggcaggaaaaaaccaaaaaggcagaaaaggttgaacgtactctgcttttattcaaatcttctaagagggggaaaaagggaagacttttttttttttttttttttttttttttctgagagaaaaagagcacaagctttctgacgtgaatgtgaaaactccgttctgaagataccctggtgcttttaccccaagtggataagcatgaataaagaagcacaaagaaacactgtcatcaatcagaatgctcttgcctacacttagctacaggtggaaagcaagcaggcacgatttgatttacctagattaaaagagcaattttctatcttccttttttccttttaaaaatagccaatcgattttggcctagctattgctgactgtacaggtccattttaatacaccactgattaaacggtatgttcatggctgaaggcactacagcaggaacaaacagaagcagctgaaggaagggggtgggggacaggcgagagctccaaaaaacactccacgaaggccacaactactcggcacttcccccgtagacagttgatatagcacattttaggcttgaaccagctataattctgggagtttgaagcctggaattcatttagctttttaattctgaccttaagaataaaaaaaaatcaaagctatgttttttaaaaaacacaaatgagggaaatattgtgtcctaaactgcaatgacatctgaaatgaagatgtgcctcagaaagatgcttcttatgaaacacttgaaatttcataagttatagaattatctactgaaagaggacctagttgtttagagactttgtttagtgaaattgcatgtaaaagaaacagaaagaaaataggacttttatatagggtgactatatgttgggattcatcaggcagctctcagaagagggagaatatctctactagttctagaaaataaccatcttgattatcatgagaaagtatagcctttatcgaagtctgggtggcaggaaaaataaattagggagggaccttctcaggcaactcagagagagacccaacatccagcagatgtttcttctgagaaagacaaggtccatctaacaggtgagacatcagctgaacaatggatgccaggacatgggaagtggctctgagaatcagcgaactccatgtttaaaaagtcaacccactttttttttttctgtttgcttactgattccttgttcccttctctcctgttttctctctccaattatcatttacttaatttgaaattctggccttaatggggacagaaccgtatccagaggtactattaagataagaaaattcaggaagaaagatttaatgaggggcttaggagtttttggaagaggaaaaggacattagagagaaacgagggaaaaactaagaaattaaatatcagcctcagcacggtggctgtagaagaatagcttctgagagacacagatggtctgcattctccagaacaaaaacaaacaggaagtaacagggccagagccccctctccccttcattcctctctccagtgtaaattggaaaaaaactgaaatgtgttcacatcaaaaagttttccttcaaactctagcaagtgaccacagtaaaagaaacaagagagcgctggttccagcaggtaaaatgctgaaaggatgtcacatcgtgggggtgaggaagaaatcagggattaaatacatacagtttggagaaaaatcaggctctatagctaactaatgatgaatggagcagacaggtggcagatttgaggtccggaggagaggaagggctccattttgagccgcccattttctggaggagaggtggtggccgctgtggaaaatggctactcctggggtgcatagggagacaactgacttagtggagggaagggaagaaataaactagggagtcatccagggacacatcgagttagtgagggttttagtttggatgataacaagctcttaaaacatggctttgactcataaaaaatgtagctgggatggatggctacttacagggttaaaagcaaactgagagctcttctattcccaaatctgaatgctgaagtgctgcctagaacagcaaacatgtacatgcaaaatatcaaaaatacacaaagtgggggtgcagaggaggtgcaggatgcaccagtcacctccttccccacacccttcaacagcacagagctctggcagggtcatcaccagtaaaactggattcttacaagccattccacagagagaaaccatcccaggtcccccatggctccaggcatcagtgaggacagttttcatgttccaaaactaattggacagtaaggagtgtctgtaagaataaaagcgggtgggaatggaggatggaaataaaagggaaaaaaagtgtccttgttgaaagttttaaattacaggctcagtaaaaaactggcattccaccacatccggtctagttaccaaatggaaaaatagggtcattaacatgtttatttgaattacattagtccttctctttcatatttaatttattctgttagaaaaaaacacaacgctctgcatgctggtgaaaggcaggggtgtaatggatcagggagctgaaatacaatgatctttacccattatctaccctgctaaggcttttcagaacttactaggatcattcagggattcttccctcacaagggagggaagggtacagaaagatgtaaggtacagatgctactgagtttgttaaaataatattgaagcacatttaaattaaggagtggaaggacgattttaatatggaaagtttacaaaaagaagaaaagtttgggataaatgacctcttctgagactgaatgtccagatgcaaggttggtgctaggcttacggaacatctccacatgatatggaagttgtagaacattgtgttattagtattcggggtattaaaaggcgaagtctgcaggatgatctcatgaggcttgctgtcatccacaagaggtcagggcaacttcagtacaagcaagtataatgcagtacattcaggggaaaatgaaacaaggtatattttcaggaagatgtccagaaatgacctggctatctttgtggcggtgacatggaaaggacatagacttagtatcataaggccagtccctgctctacaacttactaacaccatttgcacaagtaattcaatcagttttcctcatccataaaatgggaacatgaacagttaccatagagttgtgaggatcaactgagacaatctatgtgaaagtgttctataaagcactgtacaaatgtaagacatttattttctgaagacagtggtgccaagtgtgagccaagcagtgtgccaaatatcctcagaaataggattggaaacaaagcagggaatgctctgacaaagctgaagaggacaaggatctcccatctcagtgtgactgggtgtatcgctcactcaaacctgaagggatttctcaccgggatgctgaccttgggttcatagactaactccacagtaggttgccacccactcataatgagtcatttaaagttcaaatcttacttcatgctagcgatgctagcacagaggcaagcagttttaggctttttttggtcacagatttctgctgccattgtcaaaacagtagccccaacctctaactgcaacctagggcagccagcccaacctagacttgattctggtcacttttagtggaacaaattggctcagaaaacatcgccttctacttcttctttaggatatccaaaatgagcaaaaacttcagtctctagcttttccttaagacaagtttctccctttgctacaaacggaatcacatctttttgttatgattcttcctctatggtccagtttgttgaacattttgccagctgtttctaagctgaactttggcttaaatacaattgcagtcacactaagatcattctgttttgagcccagagcatagagtgtaattttgatagaggaaggggagagttaaattacgatcagctctagtaaaaggtaacggcaactcatgggtgggatactttctggatgaagtacttcaaaaaataaataaataaaaagaataggagaacgttcagtattaattaaaataatcatgacataagatgaagatttctatttataatgataaaatccaggcaaggatatggtaaatgtctataaagaaacaaaaggtctgggaaactgactatggatttctttttcaaattctagtatacgtgaactggaagtcatcttactacttttcaaaagaaacaatttatgacaaactaaagaactactttacacagtaggcaatcaacttataaaattcattaaaggtcgatgacataaatagtatcacaaaggtttagctaaattcatggataagtccatagtgggttattcagagaaactaggctatctggaggaaaataactctaattctttaagttagcaacaaggacaattgtgtcttatataacagtttcctgtccctgtgatcagaaaatgaatgctgaactgaaaggaccataagcctgaaccagaggggcttttcttataatcacatgcttgtaagaaagtagggactaactatagtgctgatattaagcctgctggggccagaaggtgcacaaattcttgaacctgcagtcacatatgtcacattacctaagctgtattatgccactccttctctgcagcaactattatcatctccatattacagatgagagaagtaaggatcagggaagttcagagacgaaaagtaaattaacaaaggtcacacagctggtaaatggcagatttgggatttgaatttaggattatctacttctgaagctctgctaccacactgctgctgttttctgcccagtagcctgatgtattaacagcttaagatgactaatttaacctgttaaagcgatatgaagtcttgctcttcatttgccttgatatctaaactgtgtgtgcagtagcttcttgtcatcaaatcatgtgctcatctatggctttacattaaagatgtctccagctctcattaagagggaacaaaagaagcaaacagatcacgaggaggtaaaaggcatgctgctatggattattatagagtacctcagactataatgtatattaacagaaactcttctctatcaactaatctaaagactcattcttagttttcctaatctaaactcaggtactacaatagaagtaatatccaagaagtgaatgaatatgatgaattccaacaacctccttgctttggtgactctaatgttgaatgggatatcaaaatggaagatgagaaacacaagaaatagctgggttgggggagaagcacgatgaggagaagaaacattagagaagaatccggagtttactttcccagactctaatttaatctgaatgagctttgtttctccacattttgaagaaaatttaagtttagtaataggagattgtgtaatgcaagagtgttgctagcctaaaggctgtgataacatatcttaggagctctgtgtccctcataacaaaagtaacaaacctttcaaaattatttgtggccttgaaatataatacaaaatacctgtatcttaatttctatccttgtaaaatgggaaaagttatttttatatgaaacaacgaatacataaaatactatatatttatataaaatatataaaatataattataaaatatataaaatataaaatgctatatgatagtatataaaatactatatattttatataaaattattatatatgtttacatgtgaataggagctatttgtgagttttattaaaagtctaggtaaaagtaaagtcatctatactcctttctctggggttctcttccctttccttttgtatatttttgctcccctttctctgccgcccccccgcacccacccaggattttaaccacagatgtaatgggtttctgtaacactggcaactcatagctttcacaaatgttcccttggctagggaccacccaaatagtgaccaaatagtgactctcactggctaatgaaaaatcaatgtggtttgatatcattaggacaaggtcaaaataatcctctaagcagaatttccttacattccctcaacaccaatgtgacaatctcgctgcaaacaaggcatagggatgtggcactgctgaacctggtaaagctatgtcattgttaactgaactaaaggaactatcagtgccaaagaagaaagagagtaagagaaaaatgtcagaaatgactgtctagattcagagaaaaacttgatgaaggggcatatagggatggaagacatcttcgactgatgaccagcagctttgaactctgcttctggctcttgatacaaatttgatgtgttgggtggtacaaaatcactacactgtctaggcctaaatgccttcacctgtaaagtgtgggactcctttcaaatctaaagttctgattttgtgtcttgtttggctggcttactcggttagaacataggtttaataaggttaacattagagattcagttttcatataaatcagatggcctgatataatactttgcacatagtacttaataaatatttgctcaatgaataaatgtcttggaatagagaaaaactctatttcatagtcaaggattctaatttagggttaaatggagtggggccaagagagagcacggggcttgatactaatgcatctgaactcctgggcgaaataacttaaaacgtgggtctcactgacattgagtcagtggtatcaccatatagtagttgtgctacaagaacaatcttactattcagactctttgaatcacctgaaagtgttcttgccagtagcctcttcccaaaagagataaccaatcctgagagaattccctgattttaagattgcataaatagctcatcaaatccctacaacattcagttgggatatgaaaattacagatatttttttcctcttcacttttcacatggaaaaacagaagtctgcttccattgcagtcaccccatctcctacaggggtgggaaatgacttagccagtattacagattgagccactacctctttgtaaatactatagttgagcatagaatttgcccacgtatggtacacccagggatttaggtggcaatcacatgccagaattttgctttagataatgagaatcaagtcataaaagaacttgtgaaaataaaaattgagacacttaataatatcaaccacctgatcattgtggtcagacatatgataatttcaattccttagcaatacttaaaaaaaaaaaaaaaaacaactaactaaatagagggattagaacctggaagataaagaatcaaacattagaacaagtaaccttggatcataaatattctctgacattttcaatttgcttgcaacatacagggttttgttttgttttggttttgcttccatgagtgtattgtatcccccactttctccccttctagaagctggctaagtatagacgcagacggtgaaactcaatcgcagagtgctgacagagcttctcttagggtctacagaacagatctactgagtctcacatctcttggtcagcagcgacaggtaaacactagctttattttagcagctcagctgcagctccatgggcagctgtccttactgcacataatcagtccctcttttcagggggttataactcaactatcaaaataccaaaatatgctccggtttgaaacttggtgtatagagtcccaagcccaggaatgaatgtggtttacttccaaatttaagaaaatattgagttttgtaggtcatttatttactattttcaaatatgtttgaagaatcttttaaatgccataggaaaatgtactaaaaaggacacaccattttaatacctttggtgattcattctgaatttcagcacaccactgaaagaaccaaatggtggtggaaaaaaagagtttgttttattttcttaccaaatacagatgttttgaccacttgggtcctcatcagtgttcaaaatattagtgtgttgtaacataataaaataaaggcgttaacttctttgttttgttcttttcagtgatgtgcagaatggattaacgagttcttgtttctggccctcgtataactcaaaaactcgtttcaacttaaataaattaagtaagtaattagttcataatatggcctaatcacctctggtattttgaaacaaacaaaaacacaaaaatggctgttgcacatttgcacttaattacttccacagaaaacactcatgtggactttattacaggtgacataaatttcaaatctaagctttgtttgtgatagaaacctgggttatggtattgtgtagacttccacgaagattctgtaaccgtccctactattttccttaagaaaatgaaaccacagtctatgaaaccacattcttgcgctcttaattggcaaaagaaagtgctttatttcaaaaactctggagaatagtttacttcctacagaggctcaaaggacgttaatataaaaggtagtatcatttctggaatttctgcagtgttcaatttttgctcttggagtctgaacagttcttgtttgcatacacgtctatctgggaattgctcttagtgatcaggacagccttatggaaatccttccagatgaatatactcaatagagcaaaaaatcttgctctgtctttaatgtaaaggaaaaaaggacttttaaacaagtgtgtaattgtgagttctagccttaaaggaactttcttggcttggatttcttctaccctccccttcagatacttaataatcaaagtatatgccaagaaactaatgatgcaaaccagagtattgcacatgaacttggatcgctttcccattgtgtagtgtgtgtagtgaccaagattggacccaaaaagtcgatgatagaaaatagacaatgcaacataatcaaggtacgcccaccttgggtaaattcactaacccatttcctatccttcataaatgcatataatgattctcagtatagattctgaaacttctaggctaatctggccatcagctgtgaaaggaagaaggatcaaccttgattagtaaacttccaggtcatttgcttggcatgaacccactgatgtgttagctgcatacctcacaattctttaggtgttatctgatgttaccaagcattcctgatgccctttgaatttcaatacagaaatctaagtacaactaaacatttccccaagctgtgacagccttatggctattactcattttagaactgagaccaacttttcttctgacatttgacctgggagagtttcttctttagctttctgagtcatgcaaatttattcaaattctgtattgcaacccttgtcagttgtggccatacattcacttagtgatatcttacacacaataggctctcaataaacatttgctttccagaatgaaactagccttatcataagaaaaaatggaatagatttcaatagagttataaatgaactagaagaaagactaatagatcttgagtatattaaaaaaaaaaaaatcaagcagtgagaacagttgggttttgatacagtttcccaagggaagtagtagaagtttcattactcagggcattttaaagtagaatagacaaaacactagtggggtatgttgaaataaaatatgcgtagtccgtctgtgaattagtgtttactttcaatataattataagtgaagcaacactgtaatgggaatttttcatacacaggaaagctatggctactatgtttccacatcgaccatatgttgcacatattggttgctgtggatgtgtatccctactgccctctagtggatgaaatgtaagacctacctgattaaccagatctaacaagctactggtttgggggtatatcaatctttaatcatttagggtagaaagaaaatagctgtgttgatgcattttccatcaaattataaaattgaagggcattaaaaacaacagaatcaaactctgtaattaagactgccatttaatgtttgttcgcacacggtattcatttctgtgtatccctgccaaagatccattgtgtaatgttgtcctcacatgacattaaaaacaccagttccctggaaaatacaaaaaagaaaccgtgctgccttgaaatacacggagttcactttcagaaacataaaattaatacagacacagtaacataatttggaacacaaataatggctacaagaaacttgaaaaccaggactgctccttaactctgagcaagcgtattagcagtctatgggtgtgctggctggtagtcagaagagggcaagcaaaatgggtttcagaacagggaagctgatttgagaaaggactgactaaacacatagtaatagggcaggaaaataactctaaacacacatttggtactgtgggtatatatttaatgctgtcacattgaggctgcttttcaagtgtagcacccagatgctgtactcccaatgaagaaagatagggacctgtacagttctttggcattttgtcattaagacacaggacaaatctgaaggccatcctctttgtataattttaattattttacaggatttagactttaatcactaagttttagtctcacacttagcatataaaataattctcctaaaacaccaagaggaaacaattatacaatctacgttgccaaaacaactgacataccaaagagaataaatgaaatccgaaagaagagaaacataccgtgtgcatgctgagtgcaccagggcaatggcccttattatgaatgtgggaaataaattggctaaatctttaaatatcataaattgttcgaagctggtgatatgtgagtagatgtacacttgaggggaggggaactgggtgggcatggcccagatcgctctctgagttagtgacagtttttacagtacataatttggtaaaaaagtattggtttagtaatgaaaggtaggtcccaatggacttctccttgtaaacttaaaaagagcaacagacttatctagatagagctacaaagcaacatgaaaactctcattacctgagtgatctagaagaaaatctaacttgataaatatcctggaagcattgttttcatctcaactagatttactgtatagcaattagcatctctatagatagatatggggaagcccaggagagctgggggtaagcagtatgggccaaaaggaggaaatacagccaatttcctacttagcaccacggacagagctgtcagcagaaagaaacatccttggagttatccttggtgttaaagaaacacaaagaaatcagtgttgcattttaaagatgcttcttatccccattgcgactggcagtctgggttggaattatgttccagtgcttccctgtagggcacccattggagctgaacgaataaaaaggtgtcttgcccgcctgtgcacatacaggaaggaaaggttgatacaggagaatgatgtctccttgacttttgtctgactcttctctggtttttgaaaaatcatagcactctgaagaatactatccagtctttcccatgtcaagacaagtccctgtgcatttcagccttagggtctctagggcacagggattgctctggggcacaactagggaaagggaataagtaaagacaactctaaaaggaagtaaaatgccttctattccatctcatgttatagaagattacaaataagaccctcttcttcctctcagttctggcctttatgaggtggaagtcactattagactctataactgaataacagattctggaaaattagaactatctctcttgcacttgagaagtcagtgggtctccttttctgtcctgctgaagccagatacagacaaatctagagaaccagttttatgaaagaaagtagcctagcacaaattatttggcattaaaccataccatcatttgctaaagacttggagtcaaagcttttctcatttgattgttaataagaagcttatatttctaaaatatcttgattaccagggaacttgtgggttttggctttaatcaattcttagggcttttcctatcttttgtttcttagacctttatgtccacaggatagtctagagagttgaaatttactttttgccagctcactatgcatgttcaccaaatggtaaagttctcactttaaagcccagcaagacaagatgagctctgtctgcccagcagcctttcagaggcattaagggtaagagagaaggtaagtaattcactatgcgtccccatttctataatggggaaggacgtcttgatacatttacaatactcctctggggatatttcatcagttatacctaaactctaatggacaataattgatttgaactttccacttagcacagagctgtaaacagcttcactgcagacggcagcaatgagccgacgttttgtaaagtggagagagattcagaaaacttttgtactgggtcatgccgtagcctaacagcttttgaatccagggaagaaacagtttgtcctcctggttttaatagctgggctaatcgagtttcaagcctgcagtaggtataggttatcttttgaaggcattccattttaacccctcactattatgatgggtttataacctagccataaaaatgtactcctgatttagacatacatcaggacacattcaaaaacataactttctgaatgttaatttcctggtgaaggaaaaaataagacattaaagtcattttaagactacagattttttttttttttaactctgcgtgggtggtgagcctttcagggaaaatattccctctcctccagtgtccctcatctggttgacaccaccctgtctctccctctcactcaacatcactttgtttcgggctgtatcttagtgcaatctcccatggaatggccccaaagactaatctgctacaaggcatgaaacaagcacaagtatagctctgttccatgactttcttttatagcctccctccagccccgttgaacacacaagtagatgaagtttagaagaattctttcactatttaaatcagctcttctgtctcactacggcatgatagagggtaaaatgaagagaaatgaaagactaactacattttacttagaccactacatcgtctgctcagtctatagctttcctattttgttccacactcctggaattctcacaatgggattcaaagctcacctagaagccactcttagacaacaaaggacacagtcccctttggagttgttgctgccacttctcttgtgtcaaagatctacaaaccttgtggctgtgaagtaggactttatgaacacacagcaagaaagtatattttgtgaatatactgcaaccggacgttacccgccttacatgaatttgacatggaatatgaattttccctcaattcagctgataagattgtaagagcaaaggcataccactgtcagaaaatagatttaccctgcacccccaattgtaattccctttctagaaatctacagaaaaaataggatataatcagacattttgtaagatgttgtccagattctgaaatgcattaaaatcaaactgaacataacttgttccacttggtcctgaaaattacattctgtagcttctagacatcaaacttagttctggttttgatgtaaccgctgattatttaggtaacactaagcaaggtactgaaccttacagagcctcaatttttccatttctcatttggggagaatgacacctgtgtgttcttatttattgatggatgagatgaaattatatcataagctactgaaaaaaatggtgttatatatattttgggtcagtcacctttacctttacagcagcatgaccaatgattggcaaagtagtcaaagtctacttcacccctcctgggtagaaggcaacatggaaagggtattttccatcatttggcagtaagggcctagctctacccatgttcttccccaggcaagcccttttctcccataatcaaagggcaacattttaatatttaatctttaaatcaaatatggcattctcaaatttgatttaaccaatgtctaaacttcactgagctttcagttgagccactaactccctctttcactgtcaagcttccatggaacactctttaaccacaaaattttgtacaatggtacctagtgagctcaaatgactttctcactgatcaacaattattagtctgtaaggagtttatactacagaacatcactctggtgtgtcaggctcagctctcatagacttaactaagcataaaatgtgctttacaaataaaatgcttataaaagttaacaaagaagttaacaaaagttaacaaagaagtggatgacttacattcaccctgtgttttataccttggaattcaaagttccatacttaatggaaatggggaaagcttagcaagggttcagagcaaaggccaaagaaccttccttccttgtttgcccaaaatattaaagagataatttgataatggtcattagtaagatgatgtgttaatagatgttccttacctataactcagattaaacatttaaaaagggggtttatgaagtatgagggattgagttgagttataaaattattacatacttcaggagatgttaaatcctcatatgaaatactctgatgttccagtgtaagttttatgaaatacatttgatccctatttatctgtgacaatttagttaacatgctactagagggcaggacaggtgaaccagaagagttctaggctttggcatctcataaaagttaaaaatgatctgtagagcttatcttgaaatactctttcataaaatgtatgtgtatgattcaatgactgagccatcccacatgctaagttgactacggtcatagggaaccaacctcatgtgaactgtttgatcccattattgaccagtctttatcaatgcttggcagaggtcaaggaagtaaatctaacacctataaaacaaataagcgatttccttgtttgcttttgaaaatgccacttactgattttatttttctttacagttgttagcagctgtacacggtcatattataattgtcacataacaaccttaattcagggacacatcttttgaaacaatgtattattcagcaactttgggtaaacatgcaatttaggagtggaaaagatgcacacagacacaagtaatcatagatacaaagcatggtgaatttctgtgccatgcacttcacaccccaactcatctcgcagggaaactagagaaggggcagaaccatttctattatgataattcacaaagggaggccatatagatatgcatgcaaagtctctccccacctctccatttacatgccaggatttcaactctgcgacactgagtcccttcatttagccaattagtccttccagcttcatgtaatgcacgccaaaaagaaggagaaatagaagtgctgacgttcactgctttgaaagttgctattctaatgccaaagctgcctcttgagcaatttccagaatgtattaacatgggagcaaagcgctattcctaaagacagggatcacattatgcaggggagccccgtttaacgtgtcacaattgcacagaacctccatcccctgcacgatcttacagttgtagtttgcatgggctcaagtttacggtctttacttaggtgaaacttaggaggtcttcctaaagaaaagaagcaatttaaaaatatctagtaagcaaggcatggcacatcttttgtaccatggcattgaccaagtccttttactgtcattctgaagaaagctggtcaaggtgtaaagcaaaccggcctctcagtttaggacagagtgaaggattcttcagtttctttctttctttctttttttaaatcaattaagtctaggttcaattttaattattttaatttggcagacatccctagaattttccctccatattaaggaccaagttgaaaaccattacataattgtgtagctgtgtatctgaatgccctcttatgcacgtgattctgatacttagtaggcaacaaggtgtcgctctgaaatttgaaaaaccattaattcttcagctgaccaccctgtttacagctgaagcagtgatagagattttaatatcgccttctcccttactcttggcaatggatttacaaaagccagtttgtgtcagcctggccctctacaaatttagctgttctttgcttaaatcatgacatttgcaagagatgactggacaagtcccccactgaggcagcatagcagaggtgaaggggcacttgaagtcctatttcttctacacgttgtctctgcttacttcgaccacatctgtcttctaggtctccttttcccaatacacaaaatttgaatactgactgagacgatcctgcagggttccttctagcccttttttgcttttttaccctaaaacgctcaaaatgatttctttctatgtctttggcttctataatttataatcttggctcaatcttctcccttcatttatttcctcaatattaccttttgtaactcttaaatatgctgtccctcaaagaactatcttaaggccatagttttttcttcttatactcatgcatctgaagggctgatgcactcatccatcttttctcataatctacctcttttagttagggttaactaagttagttaacttagataacactttctcttcagaatatctctacttagatggctgctagcccctcaaaacccaaataataaaaagcattctctctttccttttaaatcattctgctatacaaattctgtgtaaccacagtctaatatatccaatgcctcaatcttctgctaaacgttcacattttaatatattgcttctcatatagagccacttatcaaatttagaaattttcttatgatgatgttaactcaaatatacctttttaaactaatattcttggccagctcctaatcacattgtacctaggatatgaaaattgcctcctcagccgggtgcggtggctcacgcctgtaatcccagcactttgggaggccgaggtgggcggatcatgaggtcaggagattgagaccatcctggctaacacggtgaaaccccatctctattaaaaatacaaaaacaaaattagctgggcgtggtggcgggcgcctgtagtcccagctacttgggaggctgaggcaggagaatggcgtgaacctggaggcggagcttgtagtgagccgagatcgcgccactgcactcctgcctgggtgacagagcaagactccatctcaaaaaaaaaaaaaaaaaaaaaaaaaaaaaaaaaattgcctcctcactccaaacatattctcaatggtttgactgtcacagttccctctttagtcctccagtggctttctaccctacttcagatcaattgtgaattatagactcccagcactgaaagccccctccctgtaggtctgcttgtctaacctgtcagcatccggtgccactaaggcccaccttaatccacacagcaagtcgcttttgtcttctggcttccttccgctgagaatacaccctctccatctctgaactttttccacataagcctgcatctacggaataatccctcatgcactgaagaacatctttccttcattcagatgataacttaaacctcacttatgccagagagatttccaagatgattaccagccaactgttaaccctctaaaacaaggtaagaaccactccacccacctttccacacatttcagaaaaaaattatatttttaattgtgtattgtagttgtttataaattattttgatggcagcaaaatatggtatttaatacagtttatttattgccttgcaacttttaagtcttgatttcaaattggtataaaaaacaaaaatgaaaaaagtcccattttgttactttaatatatataaagccatttaagtctcatgctttttgagatctgtcaaccgctatgcacatgataggtatcactaaacacacacttgttgaattgaattgaggaggaaccatcttaaacagtttactcacagaggaggaaggaatcagaagactatgaacataaatattccatagcagcatctgagtgtaacaagaaataataccaaaatgagagtttcccaaatttctctcaccctcttgattgtttaatattatattcataaaactatatttttaaaaacagctttgattttaaaacgttaaatttacacaccaagaagtagacactagcaaagtctcatagtctgatttatttctctgtaatatatctgtcttgagaacatcagcaggaatacaccaaagaaatatgtccctcacgggatcaactatataaaaagacagaacacatcatcagcacaaaaatcattatccatctaatttctcccattctagatggctccagtgagcccctcgatcattactgactagggttaagatagagcttaatggattaattaagccaaagcaggactgcaatgcagaccgaagaggagaaggtcctgacacagatgagacaacaactctgttcctcttttattcaaatgtgcaagacttgcccacccccaagtactacacatttatactgtaaatagtctccaaaaataagatttggtgtctgctgtctgggtcttcccctcagcactcaccaacatctaatacttgggtgttaatcaaaatgtatcgtgtaataagaaattaaatgttaagactttctttttcttcagaaacgtggagaatgattgttaacagaggtaaagcagtagaggcagagcactcgttttggcaatcaaggagcaccaactaagggagaggttattgtttgaatgtcaatgtgactctgagagagggccagggacacagaatattcacaaagagctgaaaggaagaagtgcccacagccataaagtcacggggactggggggcatgcccaaaggcatctgtcgtaatagaaaccttgagatttgttcatttaaaggggattttgaaattcaaatgtaaaaagagaacaagataatccaaagggcacaatttggggcctttttcttcttgtaaaaagaagagaaaatagagagaatcccccataccccccaacaaagtactgtaccatagtggcagtttactctcacttttacgaaccaaatcaacatattaatgacttaaaaaccacgttcacaatggggacaatcagactctatcagacacaacattaaatacgcaggtattaaaagaaaaaaatgcaaactaccaagaaatacctcactccggaaatggtaaggctgacgaaagcagactatgtcattaataccaagcacaccagaaaggcatctatggagctagactgggagggacaggcctcatttgcaccaaagaggaagtgccctgaaggggcccagaagtggggaactgggtagattttagtctttttctttttttggtaggtggggggaatgacagaaacctggcaggctcctgtggaggtctggctgcccccaccatgttgagtcccagtgtctaagtaagtaaagaaatgaaaagacacctatctcaatggttgtcctgaaacagttttaaaagcaagtacaagtccccagcccctagtagaatacaaataatttcatttgtgattcttgcatcaaggaaaaaacttgtgctaagttcaaacaataggatacctctcaaaaagatatgacttctcactagagagaaagaatcaaattctggagtgggaagtgttttttaccttagtgatcttttagtcattttgtaaatgaggaaactgaggacttgccaatggtcacagaagttaattctgtagttggcaattctagcagtaatgaatttacagatagatttggggctatgaggaatccagtggaattgggtccttcaaggccttttatttaaacaattatacatatatatacaaaaaaagatacagggggagagatctatagatatagataagtctgtataaaatatattgctgggtagtaaaaagaggaccggtgttgtagcattttcactaccatggtcaagaagccacggactagattcatttgttcagtgaacaaacagttactgaactctgtgtgcaagtattataaaagtaaaaaagtacgattagacatagtttgtgctgtttcaaaaagagttaacagtatagttgttttatatctacaatacaacctcttaaataatcaagtagtcaaactaattcctattggattaatacaaatcataatcattaattttgaatcttgagagaaggcataaactctgcattatattttagttagacactggaaataatctggaatgtttctggtaccccacatctaaagattggatttcagctattcggtgcatttggatgtttttttccctttagaatccatcctaaattcaatgccctaactcggtagctcagaaacagagctctctaggcattgctgctctccttctgcccagtctctgagagggtattgaggttgaggatggggatgaaactaagaataaggcagagaacgttgctaagtcatgcttctttcagatctaacacatttgtagtcagacctctggccctccgtatccatgggttctatatccgcaaatggaaaatatttggaaaaaaaaaacctccaataaaaaataatgataccacaatgaaaaataacacaaacaaagaaacagtgcagtataacagctatttacatagaccttacattgcattaggtattataagtaatttagagatgatttaaagtacacggaaggatgtgcatgggttatatgcaaatactatcccattttatattagggacttgagcatttgttgatttcggtatctgtgtggtgggctggggtgggatggggtgtcctggaaccagtgccctgctgattggatatcaagggatgactgtacttaatctccaagtcatttcccttacagttatattttagtatatggcaaagcacaatgatttcctttgagatgaacaaaaattgagtagctaaaacctaatgaatacaattagtttaagtaatctggttatggagaaaaatcactagtagtaaagaagtgatcatattacccaagcatttctcttaaaaagaagaaaggagaaagataacatgtgagtgcctactacatttcagtactatgctaggttctttacacaaattagctcatttaattctcataaacatctcccagagcagagattgtttccatttcttctggtaaagaaactgaggcacagcaagattgtgttttgagcagacatacaaagctagaaagtaatttatggcactcatatttggatccaagtttgtccatctacaaagcctataagcctgctaagggagaaacccaaaaatgaaacaacaatgaatgccactggcagtctttttattggatatctactatatgatgctaagttatgtgcccaattaattcgaatataaacacacattttctgccaccttgatgtttaaatatatgagcatgagcaaactaacatttggatccaccatagaatattgatgtagaaaattcaaatcactcatgtatttttttaattttagaagacaatttacctgatgttgcaaagttatcatgcaaaaattaatgctaaaaacataaaaaataccctataaactctttcagtgccagggaacatcatgcactgctcctacaaaaacctggcacagtgaattccctgttaactgccagtagatagggttttatccttaaaaatatttaaaggtgagcacatagtctgcttcatttttactccagggttggcattctcactgcctctacttaccttgttttctgtaaagtgtggaaaggaaaacaagtgaatttttctctcatatatgaaggcctagatgtggggaaaggttgtttaaatgaaaacatggagtttctcctcgtgctaagctggggcatttggagagtcccctcctccctgtgcccctccatccacacaaacatacaccccagttcacgttctagtttcacgcgggataggaaaagaaaacgaaaaacagaaaaagcaggaaaaagtacagaagaagaaggaggaaggataggaagagggtctaaggaagtagtgtagtcttccagagtgctccagaaagtgaaacgatgaaaagggtgagcctcaagagcaaggcacctcccagctctccatggatgaagagtctctatcagctccagaactaaaaccctcagtaggcaggatggtgctaaaagaagaaaaactctggaagggggtcagagacggatattgcagagctttctagccccttctacattacgtataaaaacgattattcaagaaataatgtaattttccagagcatgttcaaatgcaagaaaaaggtgcattctaagattaaatgtactacgacagctaatgattcattatgttaaagttatttattatttacaattattttctatttatgacattgtagtctttcattgacacttgataatcaagagttgacaaaataccatttgaactgctttgctaaagaacaaaaaaagagggattaaggtagacaggaagtgcgtccaccaacaataaaaaggacacatgactcataccccaatattaatgacaaaaatatctacagtgagatcctaaagttctgggtatttgtctaatttttccacaatcagaaccaaaggtaaaaacagcattgacagctactgcagtttggtctgtttaacagaccaaatgctgggatttcaaagattcatggctgggattccaaagatttgtccatgttggaaacagcattcacagtagcttttcggtcaagtggcacaaaggagtgaaaaggtagaaaaggaaacattagcaccaaaaatctctagtcatcttttaccaccttaacatgggttagctgaaggccatggagaataacggatgtgcagttgtctctttcttatacagacagcagagagaggggggaaaaccacacacttatattttgctaatgtaaaagtcccagtggaaacattagcactcaaagacattaatgtggatttgggacactccctgaaggattttgattccattagaaaaaaaaaaaaagacagtgacagatataatcctgctttgatatgtttaatgccatttaaagagaaactgtacccatttacctcaggccaggacaccaagagttcaaaaagtgaaataccatttctcagtgcaaagaaaaagcttggaaaatattatgtgaaaattaatttggcatgcttctttgaaattttagatttctgggatgagcaaatgggtacagttttcttttaactgtttttgaacaccatgtgttgagaagaaaacaacagaatggcaattgctcatccaaaatgctaacttgtggcatggcacagtcaagatggcctgccacagccaaaaagcaggtgtgtgctatgcctctcacttcagtagcatgcacgccacatgtccctgcattcggcaacctcttgcatttgcttttggaacctttctgagggggacagtaaacatgactcaacagaatgtctagctgaggagggactggctctctgagcctgctgtgagacagactttttgaggaagaaccaaaggaaaactggaataatgtatttattttggaattctttggtatcacttcctgtgacctaacaccaagacgactggttccagatcattttgtgtggatgaaatttagcatctaatcaggtcggagagtaatggtgaagcttttgtgtgactggagaggacacattaaatcagctacctcatttggactgaggtcaaggttaatgtagctggtacagatcatacgaacctaacctaaaagcttagagtaataaactcctcacccctcaggtccatggataagcttgaaacagggtgtacaaaaccatttggtgtgctgggatgccaaagcttcttcaatctgacattatgaatctgttattatgttactctaggaattaaaatagttttacgtagatataggtccttttcaactatacaacagtcctatgagggagacgaggaaacagaaaaaaaagattttccttctgccctgtaagaagcctgataaagaggccaagttaaaagtcatgaccacgtctaagctcaagtcaggaaccacttggaatgaaatcccaggatatctgtgctgtaggaatagacaaggtctgaagataaagaagtagatgaaaatcaaaattactattttagaagacaggagtgggacacctctactttattctatacttttaataaatacatcaataataatttattaaaaacctactatgtgcaaatgtcaagagtggggaagaatgaaacctataagtaataaactggaaagaaaaaacatccttaagcttttctgatgtaactgagtgatgttctctgcttctgagtagaaatttatggattcagaaaaggtaatttctttccaaacactcacatgccattgttaatttcactcattcaaatcacaacatttactactataccttttatttctgatggcacattctaggtgttgagggggatacaactgtgtgtaagtacagtctctgtatttattaagcttactgtgcagtggcaggaggaatgagacatataaacatgctctagtataagacagtatgtaatcagtgccacaggagacatacaaataagtgctttagcagttcggaagaagcaagtcctcctggctatagaaccacccctccatagacatactgaaatgactcaatgcacagaaaggaaggatctgtacaactttaagtcaacttacaattgatgtgcattaggggattggagggttagctaggctgtgaggggagggatgtgctcactgtgtccacagctcctctcacactgggtcaccccataattaatgtttatcaaaaacatgcatggataaaagtggaagtcaattgaatgatagaccaggtcaatgggtctgtgttagttctagatattttagatgattattaacaccctgctagaagttggcattataagaacatcattttcttcccacactagtgtaaaaagttcagttttttacccattccagagtgatgggaagtaaaattcagggcttcagtcttccaaatgagggaaatacttggcctgtgcaaaatgctctcggtaggggtatcaaaatgtctttcaaaacagcaaaaaatacatttcctgatagcccctaaggagtatgagttggaatccatgttctctagatgtgacgatggagttcgggagaggcaggtatgctaggatccatataagatcgtatttcccatggtagtgggaaatagaatttgaatgtcctggcttctaggtctgggttcttcctacagaaacatctttttcattttgtattcctcttggacactctagtcctttacctcatgaagagtagccttctgcaattggggtgtgtgtgtgtgtgtttgtgtgtgtgtgtgtgtgtatctttctaagagagaggatagccttactgatgtgcttttgtaaaggattcaaggttgtctggatcctcaaataatgcaattgaaaaaatacggtttctttgattcaatggtgcttacatttgagcagcgttttctttttccattctcaaacacagtatttgagactatctgccaacaataaaaaggtttagagcatcaaaagtgtaggcgaaccaaatcagaattaatctctgtgaaaaccgagattcaggcgcatggaaaaagtttaggaaaaaatccaggtgggaggcaatcccatagaaaggtgtctggcatctttcctgattcaaagtgaggtgtagtaggacacatgtggaagagagatgagcggttctagctattcatatgatccattgtctcaccaatgctcacacaacttgggactgtgttatcagggggccatttgatttatcatgtagtccatgtatcctattgtatgtatgatccggagagaggttaataaagggaagtctaagcttaactgggactaaaatgaggtggcaaacagccattcactcaaacaagactcaccagattaatctgtggagtatccagcagcatttccttttattatcatatgaaaagctgtgcattttattggaaaataattaactctttaaaaaaaaaaacttgcacaccatagcagcaaaagggaggaagataacagtgatcacttctgaacacctggtacacgtttggcactgtttttctttatgcatggatttctttacatatgttatctcatttgatcttcataccaactacgaatgattgatattttgcccattttttttgtataagaatcctaaggttcagagaagttacgtaaatatcctttggtcacacagctagtagggactaagctggaattcaaattggagcagtaggacacaaagcctgtgctcctcaccatgccttgccaggccagacttcatgtgcttttcatggcatgaaatcagtgttgggggaattctgcccagcatctctggttagcagagtgaattgcttttatcatttgccaacatgtcacagaaaaaaacaaaacaacaaaaaaattaaaactcctggctctagatttcctatcaacctgaagtttggcttggttacatattatttgaatatctgacaatcttataaaaagtctaacgagaataaaaaaattcttcatttatgctagctcctatgttagctaaaaatctcctattcctacataacaatgtgcctggggaactctctcactgccagaaactcatctgaaaatgctgaaaagtcagaatttggggcctatatactgactaatgttaccagctgtgagtcagcttgaacatcagtaatatgatatttcccgctacaatttgatttggttaaaatgtgtttgaagttcacccttttattaactggaattaccacctcctgtaactggagggcctctgagaacaggctgctggtgcaatccaccttcccacccgccaacggtgcatttcctggcaacaaatactattaaattgataactacagaaataggtcaaaatgtcttttcaatagttgctaatatttctctaatgctccatagcctccctttgattcttgtgctgacatttttttttgatgagtgcaggagcaacaactgttaaagagaaatgaccagaagaaaggaaagctggctggggtggatggaggtgctcttaggagttcccgtatcagacagaaaagctagatctccctagaggcccaagggccccaaactcagctctgctgttgagtttggtgacccagaagaaaacctgtgtcccatctgagcctcaatactctcatctgtaaaaagaggagactcgagatgactgattattcaaatttgcaaaatgcccagagttcacaggaggtagaagccctgacttatcacaaaacatttgggttttaaatttgtttatagtactcttataatgttacctgttaaggccttggctatccaagatagaaacttattttcatacaaaaaaagtaatattgtgttatattttcgtaagagagaccctttgctatcatactgggttttattcactatgtaaacctatattccctccctctctttcctccaggaacaaagtttgcttttctgagttcacatcacatgtgtgattacagcaaagacagaagtttgaggctgcagtgagccatgattgtggcactatactccagcctgggtgattgagccagacttcaacccttaaaaaacaaaaaagaaaggggtggggtgggtatagtcacattgggaacatagctgattgtgagcctgcaagaagaaaagtccccttgctaaaaaaggttttccagcacttcttctgagatgcaaacataccacggaggggtcaagccattcatgccttcatgctataaccacttcaactccaagagagttatctcagtgtaaagcagttttgaactggagctggagggagggatagggataattctggaacaggggaaggtgaaggaagcaatcagattaactaacacaaggaccctaggctctgctggcagaggagaagatgaagtgggtgacaaggactgaaaagaacccagtctctattgcagtttttgcccagggccttgtctggagctggtgaaccactaaaaaaatcccttgagagatgtcatggtttatcaaaaatgcctttggctcttctgttgctccatggttgtgctgttgctcaacaggcggtcagcaaactacagcctacttggttgaggtgagagtagcttaatctcatataatttaaactcacaaagactatctctccatcagatcccttctgttttccttcctttcctagagcagggaggaaaaaatgtgtgaaagtaagggcaaagaaggaggaggaagaggtagaagaaattaacctttcctcagcttccaagtgagttaggctttgtgttaggtaagcatctctctagatccttccaacagccctgaagatattattagtaataggaagtattttatagggttgaagcagctaactagagctcaaggtggccagtcaggctccttgttacacagcactcttttctcagctcctacaaaatatttatttatatgtatatatttctttttcttctcctcctcctttcactcatgggtgcttgaaaacaggtttaggagccagtcatgtggaatttatctttcaggaatgtcgaacaccccttgagttatccaaagcatacctgactaggagtcaggaggcctacattttctggattaaggcttggtcctaacaaactgtcagtgtggacaggcccatccatctctggggtctgctccaggccttacaattctgtaattcacactcatcaatgtggtggcaggcattagtgtgtttgtacaaaactcagcaagaagtagtctccttagatgctacatgtagactgaagcgaggaactgcctcctgctaatgccagttgtgttttgagtaagaagaataaaaggattgatctgagctgaaagcagaagggaagatgaggggaaggccacagaacacatagctagcagtggcattggtgggggtctgagagaggcagaagcccagggccagagctgagagatcagcttgtttttagcatacacggatgtgtttgatcacatgatggttgggaggtacctaggctaagataatcttaatgttaggtgctcattttaaaacatcaatttaatgactgaagcctattttaatgatccaataaaggccaaagccctcactactatgatacaactatttctccctagtattcactccttgccaaaaaaaaacaaaaaaaaccaaaaaaaaacaaaacaaaacttggctgagacagctatagagtttctgattacaaaacaagatcaccttgatcataatcatctcaaggtgcttggaggaaagaaggagagatgagttcttctgaaccacattatgtggacagaaatcttcaaagagtttaatggaggaattaacttttgaggaattgaaaaaggtatcattttcagtaagagaaaaaatgactgatactttcaattggtatgctagggaaagataaattctaggcaagaccagctctataatttgtggggctcaaggaaaaataaaaaaagtagggctccttattaaaaaattattaagaatttcaggacagcaacagaagcacatcaagccaggcatagggcccgtccaaacatgggaccttgtgcaactgcacaggttgtatacccatgaagctggccctagttttagttattgtttttaccaaggtattccagtcccagagctacccagacccaaatggaaaagcacataccacaactctcaaaactctcagttaaccctgtcttcctacggtaaggacacaactgaattctgcaacaaggatcagaaaatcctggggtctgccaacatatttgatagattgcaactgcactggcttctgcgacatttgtcacagtcactaatccgtgtttctgtcacaacctaaggatgcccaggatatcaatgtctgggaattcaaacatattttctaaaaacacaaatttatttaaaaacaacaacaaaacaagcagaagtcactaaaaagaagctgagtcccctggatgaaagtctgctcttaatctctttctggctttaccttgagtaggtcttgggtgtatgcacacaggttcagaagtgcaggtgaattaccacaataactcttttcagttagagaaaaaatagcagaaacagaagaatctggtcatagcctagcagaaactccctcatttcaccaacagtatgctttctccctttcttattatgctaagttgaagcgatgacttcactctccatggaagctaagtttctctttcctggatgcttggaatgggcctggtgaaaagctattggagggtaacatcatgtctaaaaaatgtatgtatgtatgaagaaagtagagatttaaagagctcagaccaacatcaaaagaataacagcagtccaaagtgaaatgaatgtggcctcttttccaatgaccttagggactttatatatacttagcctacttcttgagtggatagaccagtagcttggcagatgcctaggatgtctgtacaggttgaaacttaattccgtcctttctatacatctttgtcccattaaagaaaaatatctaatatagagaaccagttcactcctacagccagaattatactttgacactagaccaattgctacatccttgatttaggattttttaaaagatatctattggcaaagctaatcttttatttggcttaataggtttgtactgctgctctgcataaggccattagggtccataagtagatggaaatgtgtttgaatctctataatcatgcttagatttcaaaagtcttccatttcacagaggtgatgtaggctcagccatcattttcaagtgttttaacaaatggtaatcagcagagaaggtcttacttttttttttttaaaaagtgactgaccttcacaatggatgcacacataaaactctgattcatttattttaaaaccattctcccctgctgtaaatagatagctacgatatatacattaatatatgtgtgcacaatcagccttagcaatactgctgtgaagtagatgaggatagatggttttctatttatttgacaaatacactattacacagataggttaagcgatttgtcctgtaaggaagggtggagctgggggaaaaaaaaatcctcccacatctgctcttacatgataccactatggaattgggtatcctttattgtttttgagtgacttgatctaaataatgggtaatgtaattttcctgaaaaaaatttcactatttctctcattccctcttactttcttcttctctctgcttctcctctgagattattataaactattgataaatgtggttgctctaaatttacacttgctcttcatgggctttgatgggtttcagcttctaaagagagcataggggagaaaaaagcttatttctaaaaggttttaaaaggatagataacgctgggacagtttatttgaattaatgtcactataaagtggatactggtacgagtactgtcttggacccttctctcgcaagagctagtccaaaggctctgaagtgataccatgggaaggaagagctttttggaggcagaacctgctcatcaacactctgctattctcctgggatatcagacaaaagccagagctttctgtgcaccttcctgttgaactgctttaacttggaactattctctacattagggctgtcctctctgagtccctgaccttagatggtctttctctattttggcacatatttgcatatcagttacggtgacatatttgataaataatgggcctcactgttttttggccagtgaaaaactattttgctattattttaactctttattatctcttttgtcgattatttgtgtgactaaaaagatttcttgtctcttatcatgcttctggttactgtttctcaatgtcatctggtaaatgcttagaaaatacaattttattttgataaattctaaacaaaacataattatgaagaaaaaccaacagagacaagtatataatgaattttgaagctaaatataataaatagttctgaattttctgccactccggctcatttagaatgtaacattgctgacaaattagttattcatgctgttttttaaaaatcaggggcaaaattataagtttcaattctcctaataggagttataacccctgcagcatgaaagcacttgagtaatgtttgctatgtgaaactggcttcggtgatttctcctgaaggaaactgcactatcaaaaccttcatcaaggctgcttctgtttaagacccactgcactacgaatgtccctgtacccgtcagaaccttggctggctgtcatcccatcaagcacctcatctgcagttgccactcagacatgtaaagcgtgtgtttggggacgacgcgcggtggaatgagaagggatacagagctctgttgtaccactacatttattgtaagcaaccacttacacggcaactgctttgctcttttatattctaggcaacacaccggtgaatataattcataatgaacatattcaacattttttccatcagttcaatacattattcataaatattagagatggaaagacctggaagattacagagtccaaacctcctttttgtaactccctttcccctaactgttgatggtagctcaaaaaatccaaaccaaaaccaaaacaaaaaaaaccaccaacaaaacaaaataaaccaaacaaacaaataaaatacaaacacacaaggaaagcaacaaatttacaaattttataagtaaagtgaaaagctccaaagctcgtgtttggtgggggttgttgggggcaggatttacactgatggagctcgctgaagactaggagtatggatgactctttgctttgaagacaggccaagggagggaaatgtcagtttcccccttttagataacaattcaaggtaaagcccaagaggcaataccaagttcttggccaagtgttaactatccatctctacagcctgttgtggactcaggactcaggcactcttctcttcatttagaacttgagatattaatgctaatgataaaaagaaaatgtataaatgaatagagagtgaaaactactagagaatgctccctgggattatctgtactatcaagataggaaaactttgcagatgctactgtctctctagaggaataaatgcttgcattttaatattctcagcagctggttcctgttgaatgccatcaggatgattcagccacccaccaggaacaccagtaacagcaagtgcacacacagaaatctgcaaaactttcttctcttgatgccaacaccattactctggcaaagtcaaaatcctttattgaattatcagttctactaaatgtgaccttgttcccctcacaaataccagcttattctcaaataaatggaacttctggctgattaaaatgtaacattccttctgacttgagcacaccctgctgtcagtctctcttctgccatgttcatgtgatctacctctttttcgttttcttgctatccactgaaaccttgaaggactggcaagatccatacatactcagagtccactttgtatgttgctctgcttgctaaacccatacatttaatgttatatctctacccttacatgtctcaagttatttcatcatttccattttttagacattttctatttccacagaatgtgtttgtatgtctggaaaaacagaaatgtgtagctgaactgcatttaccattgacctcattaatacagaattaccatgccatattcaagctagataaaaatgctatacttgccctcttcttcaaatttagaccagattacacactaaagggaagaaaatgccaaagatgacagctagctatcaaaaagatctcactgtctcattttcaggtctccaaagtaaaatctaaggacattcaacacagattcaggtgctctcaacagccatgaaaatatatggctgaagagggaatctataaatgtaatgaatacacaattggcttataacagatgcaaccaaaattaaattcgatatcttgacctgctctccaaagtgaaagtttctagtttaggctacagacagaggtgtaacaagctcattaatcacatgaaccagaaatataagctgacacttctggggatgctgcaaagagcagtcttaagctgttgggggtctgtggggaacctgaaaaatcatgtggctctgacagtccacagcaagcaacaccactgcattttacaatgtatgtgggtcaggcactggccataaccaccactattttaaacttccaggacaggatttaaggatctttgtagggaaataataggtccaatatggacttttataaaaagattcaatatatttttattaggttcctgttacacaaaaatcattgtgttcattgcatgagaagacaatgaattaggtcaatctatgacctcgagaagtatataaatgggaaagaatcagaggcaggggaatattaataagtaatagtagcaataacaataacaacaatgatgagtgataaccttgagctagtcattctgctaagcactttatatactacatttcatggaattcttatagtatcctaggaaggcagatatcgtttttctctttacagacgtggaacgtgaggcccagtaaaattaagtacattgcctaaaattatgtagacctgttctttacattacaaataaatacataaatagcttgcatataaaatgaaatatggcaaggctcattaaaagatacaaagtgttgtagaaataaaggaggcagaatgtgtttctatttgggaatactaggagaaaaggaacatggatgggaaaatgtggtgtgtgcttaggaaacaaggattgttccagtttgtaatgttataaacctgttgaatcatcaatgtctcattagaactcatactttgataagatagtaaaatataccaatctgtacaggaatatttctacaaagaaatacttctttccaaaagatcttctgactacaatttctcaaaacttttcttgttatttattttttggtggcgatagagggagaaaaaatgtgagatacaaggctatggaggtctgggcagcagtgttaactccagagtctctagggagtacaatgcatttgggtgcattttccttcattcctcagaatgccttatcctcatcacacatatttgtccctgccacatccgaggtgaggttactggcatagaaatagaaaccctgagggtctggtttcttccacttcttcaaagtgggatatcacttactttttatttttataaattagttttagtggtcagccttttggcataggagtacatcaagaaaacgtgagttagaaaacttgagttctggtcccagttttgccttgctcatcttgaaagcattttatctcttctctgtgtttaagttttcttattggcaaaatgagtagtttaagcctgaatatcatttcttaatctgttggacaaccccctcatcaaattttttttgataaaaataaaaccttgttttaatgtagatccttctattcttctctatttaaaattcctggttcacagaatgcaatatatagtaccattagtccagataattttgtagagctttactttctctattttgttaagtttttctcgtaaattttgttttccaaatataaaacattgtaatatatatgtattttcaaattctacatggtcctcgaccagatattccaatattccattctgaagagttggttaacccactcacccatattgagatatctaaagccccttcaagctccaagatacagtgattatgatgctctgatgctgacatttgctttgtcaacgcttaaagcagagcttttaaacttcaaacaatagcataacaagttgctataacaattacacttacataaatctttaagcagatgtgcataacagctctttacatctactatcacactggacaaccaaagcttatgatgttgttataaatccttgcaatagtaaattctacagttaattataacctataggaaaaagtactgtccatatttagaattgattgactcttattttccacatctgttaattttgcacccagctatagggctttaaatagctcccataactttaatcattagcccccactcagtcatgacttctatgtctcacccttctgaccttgcccactgagttcactcttactgatgtaatcaaacatgtttcattgtagttgcattcgtcacagtgctcattagaattatcatcattcctacagcacctcagtgcaatgaaattgtgtgcctatgcaatttgttgttattttaagttcttcagctggaattttaaaaatctagatggacaattttattttatctgatcgataaatatatatccagttaagtgcctctgaaaaattggtaagaaaattatttattagagcaaaatcttaagtctagagagatttttgtaaacttggacagcagcattcactgaccttgaatccacaggttcaaaatttattagtgtcaagttagtcttttaaagcaatccattaaagcaataagtataaaatatatatggtttacatttatgtatgtgttgaatttaataaattagtcaggagtcaaggtatttttaaagaaatattaaatctgttctatattgatcaattaactgactttctaacttaaaatattcttttgctgtagttaaaacctttttttctttttaaaacaaacagagtacataaactgtaaggtggcaatgtagttcactgcgacaatctatatattccttaacgtttgttctttttatggtcatggtatgtagaaacaaataaatgtataatagtttaagtccaggagtttttgcctgactaaattctaaacacatagcttaaataaagggttgaaagcctggcatctcatcattactgtttatatgttataaggtttgcagggccaccttataaaatatatagttgtttattttcatgttcaataaataagtagtgtggggtttcagactgagaatggattacagattgttctctcctggttatttttggctttaagtatattgatcattttatcattttcttgttttaaactactttaaacacagcacaaatgttattctcatcatgccagaaatgggtttggaattgattctgagtttccatcaattttactctttgctctttgtgagaagttttgcactgcttaaattcgaaaggatagttttgtttaaaagatgtcacagtacaacatttagagaaccttagctgcccagaaaaactcagattttctgctttacaaaagaataaaaatcatcgaatttattaccctggactttattgaaatcagtgaagaatattcatacaaatacagtttcacgaacttcctctctctctttcttcatgtaagtgtttgacaaaagcatgtatcttctgagaagccggcctgattggtccaggttggcactgtttcagtgtttggcctacggcggctgcttaggaataatttcatctcatcctctctattttcctggactgtatcaaactcagacacgtggtatgcaaaggaaatccaagtcttttaaaaatgctatttcttttggtactaaagccaagaccagttctactttggccaaatgatcttatcaagatttaacaagagatattcagtaatatctccaatctgtgagaagacattccactaaggaagataatttattacatacagtgtacatatatttctccacttggtaccaggaagagacatgatcaaacttattctattggtactgaaaacaatgtaacactgacaaaaattctgtggcaattattcatttcaattaatttaaaaagaaataaacaagtagctcttcccccattaaaacagatactggaaatctattttcagttattgctgaaaatattttggcttccacaaaggcaccttactaacacactactttgccctccactgtgctgtcacaattcagaacttgtaacattttattcaggtactctagactaattagatgaaacaactgcattacagtattaagatgcttttgtagaattaaatgaaaggagatctgcacagttcagatagcttggaagatttgcaatgaatatcaccaaaatcctgcatgtgcaatatatttttctacatttacaaattagctaatgaataagtgtattccacaataactgctaggatttaatttcacacttaagaatatcaacaaacacagagagaaatttagataggtaaactccatttcccttcccaccccaccctagtgctcccctgcactgtttgcatttcagaacaaatgcttcatgtctcttgaaaagcgccaggaaatctcttctctagctatgcaggcctcaattttatgtgtgtagtatgacacaccttaaaagagagagccccacaaactagagtgggacgttaatttaaatacagacttaaggagaagagctccatctactgaatcagttagatcatagtgtgtaccctatagttatcccattcactactttcaaccacttagaggctctggagggaacaggaaagttatagacctgagcaaccatgaaaaacagctttgagcctaatgccatttgggatatttctcggataccctgagcccctttcctttgcccctccaatttcaaagctttccatgttgcaatataaaataaaaatggatgttttgctatatgaaccatcccttggaagtagaaagtcattggttgttgaaggaaatgtctcagacagttgaagagaaagctacagaaagaaaatctctagctggcaggttgggcagcctaggtaagaagggaaaagaagagtagcctacttactcctcctgccttgcaccattgctggggaagcctgcagccacccaggatcagctcttctggcctctccccggctgcacagtattgttgtggcattgggaatttgctgtggcttcgtaagattatggggatgtgcttcagcaagccaaaaaagtcacaaacaaaattcaagaggaaaaaaaaaaagtataaaaacagctgatcttactggagaagctcttggcattttcctacatatgccacaattttctctggtatttcctggttctgtgatcagaaaaattatcgtatcatatttattactgttgtttttttcagggttgctggtggtgacgggtggtacagtgagggcaaacagatggatcaaggagaagcaaagtaaagattacttctcccacttgtttgaaagctttccaagagattgcaggttaaaaaatctcttcttcagaatactgaagatgtatagatatcacatataggaaaagatggccatactctttctagattgggaaagaaaaaaacttctaacacagtaacagattcggaacaaagcaaattgtatcagaaaaaacttaaacgttcatatagctgcataaaattcagcagcatataagacttataaaaatacttcataaattaagataaaatatttgaatataaatgggtgttaagtatatatataattggatgaaagcaatagttcagtgaattttttattacagaaaaataaaatataatgaattaacaaaagttttacagtaatgctaaccttttctcttgtaggttaaaatagaattaatgtaactgtaaagtggattcatgtttccctgtgggtgtgaatgtatatatatacctgcccaggtattactgactgacactgaaaggtgatatgttgcaaagaaattcaaactttgagcattattttaaattgggtatttaaaatatcagtattaacctggcaggtttctttctttttctttctttctttttaatacatttaattttcagggtctgttttaaagcacgaaaagaaaaacagattagaaaagcattgcacatcaataagtattttgtaaaataatccatttgcatttattagaatattcagttctcaaaaaacggctaattggattttcttcaagccttttcaagacaagttcagttctgtgtcaaggataactatgagaaatttcacctcaaaaggtaatttgtttggttagttataaaagcctgaaaaacaagattatctccaccataactataacaaaacagctaatgagtaagtacattctggtaagaatcgataagaatggcaaagcctgagagggtcatcgcagacttgagaaaggtaaccaagtgaggaaacatcaaacagagttaaagcattctgaaaaacggaaagtgttaataatcactgacaggaaagaatattcttcgatagcgatgacaacaacaaaacaaaacaaaacaaaacaactaaaacaactggaaatacatatctccagaggcaaactatgactacttattaagcaagaggagaacctgcttctttgtcattccctttggaagcctagctttaaaaaaaaaaaaaaaaaaaggttgcacaaaagatacatgtgttccttttctggtattattacaggcccacctagatttagctttcgattccagatgagatcaggcatgttcagactagcacatctttgctctgtaagcacagagctgctatcatttcactggcaaattctcgtatccccaaatttatgcacaatagataccctttaaaatctgcaaattttctatttcagtgaaataactgattgagttaattttttttcttaatttacgctgctcgtattaagctgaaaagttaaggcaggcaactcctataaaaaaggaaagttgaacagtacttaccctaagtgtaatgtgcaagccttaatggggcaatttacttttgctctatgatatttagaaaggtgtccaggtctaaactcagctctcgcctttttcccttctggaaaactgagtagactcacagaaggtgcctctgcgaaagatcatacaaatcaacagccttacctgtggccattcagaagactgcactttggtgtgtgtttaaaactatgaataaagtcagatacagcgcatgctcagcaggcaatttaaaaatatttataacattgttgtttcaaaaacaaatttcctcaaacaaagcaaaactcaaatttttttatccatgccaagtttaacgttctgagacaaagctgttttggagttttccgctgaaggaaaaaaggcttttaaaattttttgttgaacgaaaaatagttctctcttcccttttgggtacgcttaaaggggtggaataaatttttctccaagtttcaacaaaattcacctctggctatgataaggcattacaaatttaaggtctgtaaaaaataattttagagaaactaacaagaaactaaaaactatgggtttaaagaatgtaatggtcatctgaactttcaaggcagtcttgcatgtaactatacaaaaattatatcctgatacaaacaggatatattatatgtagataagaataatgtgtatacaaccatatgcatacctagagaagttttatttttcttttgctaactaaaatcagaactctctaaagccgaaaaagaaatacaacaaaaatttaggagaaacccagtaataacatcggcacaattcatctgtttttcatagcaagcgtggaaaagaaggcaatcataccaattgattaaattttgagatatataaaataaaaatttgataaaagaaggtttttaaagtatgaattgcagtagaaatgcctgtttcgttcctggttgaaaatttctttctcttccttgaatatccctaagcattccattttaccatctatcaccaaaccctgaacagctcacagatctcacagatcttatttaaatctcttacttaattcttaagtctctgaatgaatttcagctcctgctctactttccaagggtgctcagctggcctcacaaaagctccacagacacatcgttcactatctctgatgctttcaagcttaacagaggatgccaaaaaaaaaaaaaaaatcaacgattaaaaaaagtttattaaagtgaaactaggagtgcaaatttgaagaagttgcttctacttttatttctctctcaactcagcacaggtgtttcctaacttatactgctgtgcatgctgatgaaggggagggttaaattaaggtgagggagtgggccaagggcagaccaacaagcatataggatctccagcctcatgtgttaatggatgtgtttaaaaatggaccccccaaaaagcctagaatgaggtttctttttggcaaataattaaaccagtatactgaaataattaaagctttgtctttaaataaagcatcagatcaacagaacaaaaacaaagataaaaattgcacacacatatgcatgtgcgcacacacgctatgacacacacagatacgcaaaactagtgggtgaggggagaaggaaattaaataaaagaaaacaaacagagtcctaacaggccattctccgaaaaggaatctaaataaaaagtcatatgatatctgatagtgcaggacacgtcgccaagaactggagcggattgcctacaggaagaaagggccagtgtattccagctcaaagagcttttctttcctcctcctctattttttttcccttttctcctcgactgtgaatgtgtcactctcaggtcagatccacgaagaatcccagaatgacagctatcacctgtcactgtactcttggcggcacaactagctgataggagctgcctgagttgggatcaagaagagctagtgcagctttcagtaacagcctgttatcccagtccctctgcccctttcaaagatccccttggtcacatcaaaaacagaccaaaaagaaaaagaaaaaagaaaaaaaagggggggtaccaaatgaaaaattaaaaatgcagggacaacagcccacagcaacaaaagaattcagggagaaaaaatagaacacaagcaaaaaggaaaaaagcaaaaccaaaacaactcttgtcttcaatataaaactttttaaagactgagtttctcttatttggatgacattctttttaaaagtatttttctccttaagcactattaaaagcattaaaaaattctacaaaaatacagaaaagtctgaaagcaattcaagaatattcctaaagaaaacatgtaagtgtaagaagtgagttaccctggaaaattctggatttgccaaaagttcccctacttctaatatctttcagtgagttcaagtgctaacactggccacctagtacttgttttttatctgaggatcattactgaggcaacacatacatagtaaggtttcccgaaaagactccttgttatcaagttacttcaaacataaggcactcacacctcccagccaggagggttttttgatgagcatcacactctgccctgatatgtattacacccttaagaagcagttacataaatgcattctataattatggaaaatgtatatatctatattttcccctacattttccctccccagggatatgaatagattttattttcagttaatagaaaaaaaaagaaaagagtttctgattcttgaaacaactgttgtagctgttttctacttagcaaaacagttatctgtagttaggaatggtacataatatatatttaaggatttttgtagagcttgagaattgttccccttgtttagtttcgtgtctataatgtaccttaaaaagatttctaagtgacaatcaacatataaatgcattaagaggagaactttaagaaagaaaacattatcttgggtttacaaatccaggatattagcataaagatataaatgtacagcatatataaaagataaaattgtttactacattttacacatacagctcacatctgatttctttttgcttttgttggagcattaatttgaaaatgataagcattctgaaatgtttgctacaacacaaattcatggtaaaaatatacatgcataggcaaaaattgaaatggagaacacaaagctacgtggcaatcagaatcgttgacaaaatctccatctagactatattttgcatgaactagtgtatcatagaaggggcaagaaatctctctgggggttttgtcatttacataattagaaacaaaaataaaatacaaatatctgctcccttactaccttttcttaataactgacaagtgacacaagtggtaccttttaaacagatggatgcaaaaacttgtgagatcgaatgaactgatgtaccccattggtattttgggaacccaaattccataattaactttttacccaagtggcaaaagtagaagatgttctagtcaccaaattgattatttgatggacttttgttctttcttccacaagattttggcgacccagaaagggtaaagacatgataagagaagatgcatcctgaacaacttttattgtgagtagaaaaaaaatagcataaagtgagcataagaacagttggatttggaaagattaaaagaggagaaaagagcaacatatgcaacttaactagtctttttctttttaattttttcatgtacatatatgtatatattgggatgatggggagaaaagataactggatttcttttgaatgtctttgtgtctttatagagtgaatgttctgttcctgtctctttctttttaggcgaaaaactaataaaaatagaaaaacatatatcagacattaagctcactccccccccccccacccttccctttgtaaagaactctttgttctctagtgaaaatgctgaaaaatccccgggcagctactccctgaaacaagtgcaaaacacttagaggcttttgggctggctgggagccagaaaccctcccgctgtctggttagaagaggaaaaaaagaagagagagggagagggagagaggggaagagggatggggggcagagagagaggaagagagagaggaagagagaggaaaagagaagggagagagagagagagagagagagagagagagagagaaattggagcttcctttaatagacataggaagcagcgtttttttctttcttttttttcaaaactggcggtcaagcgttaagtaactcccgtctaaatccacctgctagaaatgaacttgggtaaccccccaggggtgcacaaagacagggaagacagtaacatactccatactctttcccaccccccgttgtactgcttccattctttctgctctcatacacaaatgcccacagcttctcacgccgcccctcttaccccccaacaacaaacacagcaaaatacatgctccctcggtctcctaaaaaaaaaaaaaggcttttccatctcggttgcgacacagtgataaggggtagcgaacatctcatacctggtgtgaatgctaatcagtcaggagttctccttttcccaagacagggaactgtttccttccaaatttattagaacctcctccactgcctctttgaaaaaccttctttgtcaccctctcccaagtcccgatacttctttaaaaaaaaaatggcttcggagctccttctattcttgatattgattctctctctctccccccacccctcctcctctctcctgtctgtgtctcttctgagtggtctattgataagtccctggaggcactgggtcagcctgcccgtaggaaaccagacacaatgcacaaatctccgagtgccattctgccatcagcaagcagaccacgtttaggagagagagagaggaaaaaaaaacagtagagcaagagacagagagagagagagagagagagagacaccaaccgagggagggagagagagactgagagagaggaagagagagggggaagagagagaggggggggagagagagagagagagggagagagaggagagacggagagagagagtgtgtgagaaaaagactgattggaacaggagggagagagagagaaaaggagaaggagagagagcgcgagagggagagcggcactgccagtcaggttaatcatccctactttaattagctgttcggcttagacataaaacaattgaatttgaatgatctgtcagcaggctcggctgaaccaaaggggaaaagcgaatattacaaaaagactgttggtgtgttctgataagcaatactgctcgtactgacaaatcctcaaagggggaactattaaaacttacaactaaacaaaaagtgcaaatacaaatggcactagatagaggtctttaaaaaatggagttttctcctctagttttatgaaccatagatatttatgtgcaggtgccaacatattaggggttttcgtgtaatgtgtgaaagtttattaacgatggtctaggagtgtagcagacagatgctgcagagaacaagacaggtacagtcagatgccgaatctagatcttggagggagaaggatgctggaagaagaggcaccgtggcaagagatcagcacagacaaagtcagtgggcagataggcagacagattttaggcacggcacgatctcatctaaaaaggcaaaagttctgatgcaatattaggtacaaaacaatccatccatcctcctctcccgggtgcactccaaggtacagttaaaatggattaatctttgtgacaaacagagctggcaaggcagacactgaaggcgatttgcagacccagagaatacagagctagaaaaagccccagagatcaatctctccccctcccaatttagtagagaggaaactgaggcccagagtcgacactagacactaggactccaggagcccaccaggccagtgctctttccaccacaccagctaacctagagtattctttgaagatctggcccaacaggtatgaaaatcacccttacctcccaaataagaagattactccacctatatagttagtgcacaaacctccaatttctcaaaatgtttaaatagccaaatggaaatataattacatatataaatacatttccactttatatatatgtgtgtttatgtatatatatatatatggagagagagagagagagaccattttgaatgctaggaacaagggatttaagtctttaattcattctaggagaaaagcagaaaaatataatattgtagaggcctcgtctcagcaagatataacttgtgtcacattttcaagctaatgaaggctagtggtttgatctacaaagacctcaccctgaatttacaattcgctctatgaacatcatctgctatatatcaccaagtgagaagatgtggtttttctcatacacctcgtttctaaaatataggcacattgtgggtgaaagagattgagtctttcagcatactatgtagttttaaagcactgatgagattttccacctggagaattaggtatgtacaacctttccaatatatttcaattgaaaatgagctactaaaaaggggaaactatattttccgcccatgaaagtgatggtatctttttcgggacacatatgatcatgttcactaaggattcccttttgacaatgggtaattgaaggtccagtttttaaatggtgaaagaggtgcttatgaagagaacagtgccatcagatgttactggagagattaagtttcttgccctaaaacaagactcaggatgtgtatgaaaccgaaaactatctctcagtcatgcttcagcaacaacattgctacttagggagaaagaagaaaaccgaaagaaatgtcaggcacgtgggagcccactcaaagacaagtaatctgagagaagtcatagccagagtaatttagtttatttgcacaccaacctctttaacaatggctgctatgccatgcctaaaacacacggcctacagttgactgatttggaaagggggaaggaatcagtgattttgataatggcagatcctttggcaagccccaaaatacctgataggccagagcccagaagaaagcagtggagtgcttagtaaatgtctgttggtgaactgagaaaaaagaacaagagctttggagcaaacacatatttatatataacactgcaaaagtcacagctactctgaaagcctcagttttcctttctgtaaaaggtgatgatattggtcccatagagttgtcttaaggatgacatgaggaaacatataaagtacacagctagtcattacacggtagttattatggaggaaggtgtgtaaacaaaagtgtatattatggatgtgctgagtgtgttatattcaaagcatgtaggttcaagacatgaaagcatatagcaaagcaaggatctaatatacagatctctactagaaaggattggcagtagagattataaagtttagaactaaattcctaaaatctaaacttcaaggatgttaggtcatctggggttgtattatttctttgttcccagattttactatatttcctggctcataataataatgatggccaacatattactaattggcttgccctaagcagtctgctaaggactttacattttaaaatcatactttagcatcacaagaatcctatgaatgaggtactaccaatatccgcatttcatagaaaagaaaactgaggtatagaaagattgtgtaacttgctcaagatcacacgcctagcaagtgaggagctgggaattaaatccagccaatctgattttaaagcccgcattctcagccatggtactaaactggcacacagtaggtattcagtcaatgtgtgttgaatgaataagcaaataaaaaaaacactagaatttttatttcattggagatcagtaataatctgtgcaaaaccacttgagagaatcttgttttcgaattatagaatctgtccttcttctgtagctcacttcaggtgtagtcctttgtcagaaaccagggtgagccatgtccctgcatggtgctgaaaatggatgaagggaagagtgctgaccatgaccacccagggcatttaaatatctgacggcattttcagcactttgaggacagtgttagcacaagggttattaattggcttaattccagttcggataattacatcgtgtctctttaattttcccccgactatgccattcttcacttcctgtcacaaatgtgctctttaaaaaagcatacgaatacacacaaacatatagttatatttaaggtttgcataatcatttagggtgcttttttttctaaatgatcagtgtatagtagctatgtaataaatgaatgggcaaaagaattaaagtcattgtaaaataaagataactagttgaagctttttgtttggcaatgaaacagatttttaaaacatttccttggtgacagaattccaatcacatttttttctcatgggcagatatttccagagctgatgacctgctcatgataagctgattttcttacactatgtagtttccagtataaaaaaataccaatgaaaacttcgatattttagagtagaaaatgagactaagtcctgagtggtagagcatactgaacgtacgggttttcagtgaattattaacccatttattagctctgacttacttgacaggttttttttttttatctccaaacatatcactagaataatcttcaaattatgaaagaaaaggacaacatatcctaatttaataagcttaggaaagtttgacagtcataaacagacacaactccttttcctttttccaaagaattcttggcctttgaaatactgtgcctgcattatactaaagaaacactcccagaaaaatatgcttaaaacatgtacacaaataggtaaatgcacccatggtagaccatagtttattaggcctttttagtgtacatttgtatgaataagtcatcaaatatagggagtgtggaaaataagagaataaagggttaatttatttattatgcaggaaggtttctagatctttgctccttcagcttttagttcaaaattccatgcatattctgcacataataataaatgccataattcaacgtatctcataatttgatttactttcaagcacctttttttctggttcagctcttgaagccttccttcttataaacttcctccaagttattttttgtagcgctctgtaaaatatcatttaaagttggtgttcataagataaccctcatgctatagagagatttgtatcaaactagtccatatttccttttgagaaccagtggtcaagtcccatgctcttatctgagaacaagccacaataaatatataaaacagccctttcccacctgtttgacccctgtaataatgatagcagtctctcagtgactgccctctggttagttactcattccttaagactgagctcttccaggacaaggtctttccattctaccttgtatatttaatgtattgtccagcatcacacctgccatggtggtagatgatctcccagaaaagctggaagcaacaaattttaattccctttgttcttcatgagtaaatacaaatttttctctctgtgtgtcaagttttcaacatgtaaaaggggcatactttatcctaagattagtgatttgatgttcagaaaataatattggagggtatagtatttaagaattagctagtgaaaagcacttgttttggttattttcatagtatcgccactatttttatagcaagaagtacttagaaaacatgttttaaattcaaaatttaggtgaattttgaattcaaaagaaaagtggacaagatttatcctgaatattagagatagtaagcacttggtttttaaatgccatttaggaacagcctgacagattttatacaagcagaaggtatttaggaaattctctggttctctcagtttacagagaagagctgagtggcagagatattttatctgacaagcttaaggtaaaaaaacttggtagaagtgaactagtgctggaacccagtctgtctgtccctggttccacactcttctcactcatactttgaaagatggcttttatactcttgactccagatcccctcttttttggacatattttactgacggaactcttaaattctggtgctgataaaggggtacaatattcctaatgtagtctgataaacacactacaaaggaactatagtaggctgaggaatggccccccccaaaagatatccatgtcctaatccccagaacctttgaatgttaccttacgtggcaaaggggtcttgcaaatatgattaaattaaggctattaaaatgaggagattatcctggattttctaggtggactctaactgtaatcacaaaggttcttataagagagaggcaggaggatcagagttagcagatgtgatgacagaaacaagaggttggggttatttgaagaaggggtcatgcaccaaggagtgcagggtcctccaaaagatagaaaaggcaaataaatggatcctcctttatagccgctaaaaggaaccagccctcccaacacctttactttagtacagtgaaactgatttgagacttctggtttcagaactgtaagagaatacatttgcattgttttaaaccaccaagcttgtggtaatttgttataacagccataggaaattaacacagggaccatcagctaccttgatctggacataatctttcaacacagttgaaatatttcttagctctttaaaaaattattttagcagatatattaccttactggttcaaactgagcttgtgatacaagaacccttaccagtcttcagaaaaatattgactaggataagtcaaggagggtcttttctcctgacactaagagcttccttctaagttgacataaagcaatcaatctaatgattattggttaattgatcagttggctgcagatccatctaatcacatttgcccacctcctgtcttatagtaactcttcactggtggtttggcaattgtatctccaagttaatctacaacagtagttctagttagaagcaaagagaagggtttcagtgtccatttcttgagtgccagagacctgaactcattcagaagtgagtgctctcttgctagacccccaccccacatttttttctgagctttcttaacagaggtcagaaaaaagaagcatgaggcagcttaggcaaaaaacaaacaaaacaatctcctcccccccccctctttttttttgagacagggtcttgctctgtcaccgaggctggagtgcactggtggtgtgatcacagctcactgcaacctcaaccacctgagctcaaggaatcctccagcctcagcatccagagtagctgggtgtgaccacaggtgtgtgccaccatgccaggctaatttttaaatttttgtagtgatgaggttttgctatgttgctcaggctggtctcaaactcctggcctcaaatggtcctcccacttgggcctcctaaagtgctggattacaggtgtgagccactgcgcccagcccctatccaaactttaataagactcttttgccatagtgtatcattgccattcagttaccgcttacattctataggatagtgctcctaaaagagtagtccttgggccagcagcatcagcattgcctagaaacttgttagacacgtaacttattgtgtcttattctagacctactgaatcagatgctcagaggtggatgtctgagtgtgtatattttaacaagccctttaggtaattctaaagcctagctgagaacaattgtcataggacaaatctgtgaggctcatcaaggctaatgaaaaaacacgttggactcagagtgagatcacctgctaatctaggtgtcatggtgactctgtcatttgccagctatgtgactttagattatgttcttagtctatttgtctcatctgtaagatggaaataataataattaataataataataaattgctttatgtgaaaagttaatgtagaagttaacaagatcatgcatatgaaaacactttacaacctcagggttattattgtagaagaaacatcaatttggattgcaagtatcctaggaccacattgttggtgatattgccttgatatttcatattaactagggctcccaggtagtaatactgaaaaaaagttcaagaagctccagatgtccaattctccaggccaaaataaaggctggaagtctgtagatgtttaaagggtgtgatgctgaatggaggatctgctggcattattagtctctagaaccaagtgctaaatttcttgatttgaaagtctacctttctatttatcaggtagcagaatttagtgacagctttgaattctgtatgccagtgaaagtctatggcttgtgggattcagaaccacaattttttatcaatttccaatgacactcagttttagtaaagtggcccatgatctcttgcatttccataccatattctcaaataagtaagaagctccagggagctcgctcaacaattgattatggtcacatattttttcaatagaaaatatgtatatcctggtaggtgggaaggatggtcctgatcaggactgagatctttttagaggttcaagtccaaactcttagtaggttgaagggaactcagatgcaaccagattagacacaactatgattttcatggaaaatcatcagaattttatccaatctctgagtaatgaaaatttgcagtatttctcaacagctctatatatgtggagaaaaccacctcataagaaagctaaccatgtcttttccttctttcatgaaataatagtgacgtatgcctcttggcctgaggactcgtccttcctctgaagactaatgtctgcacgtcaccttttggcaacccctctgtgccttgcaggacagttgtgtagcaaagattctgtttgggttgctgtttcctctgagccagtcacactggtgcatcaggagatgcagctgcaccttttaagagctctgtgtccttaagcaagtcatctgtccttttacatttcatagatttttcatttgtaaaatatgaataatatgtgccttaccaatcttacaaattgttctgaagatcaaaatggatgatgtatccaaaatgctttgtaaactaagaatctcattcggttggtgttactgatgttgttattatttactctttagcaggagagtaaagatatatacagacatattgggtacggtagcttgaatatttttagacatctacgttgtatatgcctccaaggtttccccctgaacttacattaatccctttttcaggttacagctaaggtggtaactaaggatgttaatttcctttaggtccctataggatctctattttgatcatgattagtttatacatgaaatagacactgctgcagaatttacaatgtttccattctggccaactcaactttgaacatattccctaagtaagaacaaattcagtactataacactgaagaaaacatagcatccgaagctggtattgagggagtgaaaatatcttcaaaggctttttcttgattgcttaatataaaaaatctgcttagaaatgtccactagttcaacaagcattcctgaaggaaatctgtaacaaagctactgtgcattaacatttaaaagaacaggaacatgtagtctacctcaaaacaaattattattgcttgaattgcccaaactttgttaaccaaaattgaatttcgcctaagttgaattcatgtgaagagctcataatgcattgttgctatttagatagttgtcatagtatgtggtactcagtaagtcctctaaaatggaagggaaattaactacatggtataatttcaacataagtcattaatataattgtgcgaagaatatctctgaatatattgaactgctatttgaatctttaattgtgcatacaattctaccttttctgctatgcatccttaactagactatatgctccctgaggacaattcctgatttacacatctccaaatttcccgctgccttcagtacagtggtttacaagtagcatttgctttcaaactatctgctgtttaattatattcactttttattggcttttcttggggggcaatttatgcacataaagtgtccatagataaatgcatcattatcactgaggtgaaagttgtgattcttaatttttttaaaaaaacatatacattgggccacttatttttcctgtgtgacactcaatctaattatagaagtgaatagaaaaacatgatctcttttaaaaggcgcactttacgtgaaacaattttaggaattcagcttatgtgtcaagtacagtcattctgcacagtgatggtgatggggaggctctatgtactatggttttgacagaaaatattttaacttaaagccagctacccataaaattacgtaaacataaatatgcactctcccacaaacacatttgcacatctttaaacttagattaatgcaaagaaaagatatattcttttgttctagtggaatacaaatgataaagactaataaatgaataaataaagctctaggtaaccaaatcaatgtctgctcaattctggtcaaggaggtgaagggaggtttccctttgagtcagagaatgtagtggataaaaaggacatgaatagctggggggatttcctgaggccattgtagaccagctcacacactgttaagaggctcattttcatgagacttttggttgcatttgtaacacttgctctaggtcccctagagcattgagtgccacatcacagcactacaataacaggactaaatgcaagaaggtacattacaaggttctttttctttcagctctgaatatccaggagtttgtagatgttctcaagactttttttccccttcgtttttccttctcccccaacccccacacactcccttcaaatagaactaagtggaaaggactgttttgtttttaggtaaaaacctaaattcttgtacttaaaaaaaaaaaagccagttgtaaaatctgtaatataattaattatttccataggtaagagatattttattttttataaaacctggtctgactggtaagtttgttctagattaaggatttagctacagtttggtgagtgtttgttctctgttaggcttggtgcatattaattcgtacatattttaacatttcactactgtattaaattattaataatttgaaatcattagcttgtactgacaccatttttctgaaacagtaccacctgtttcttctaagtttggtccagaacaaaagtctgaaatctaatttgtcaagaaaacaaatgtgtagttcagaaaaaggataggggccaggtgcggtggctcatgcctgtaatcccagcactttgggaggccgaggcgggtggatcacctgaggtcaggaattcaagaccagcctggccaatatgatgaaaccccgtttctactaaaaatacaaaaattagccaggcatggtggcacacgcctgtaatcccagctactcaggagtctgaggcaggagaatcgcttgaacccaggagccggaggttgcagtgagccgagatcgcaccattgcactccagcctgagtgacagagtgagattctgtcttaaaaaaaaaaaagaaagaaagaaaagaaagggataggaatcaccaaaagaaggaggtccaaagtccaatgttaggatgattatgctcatgacacggccatttaatctttaaaacaaatataaaagacaggtattccctgtggcagagctgagctttacctcaggtctgtgtgacagagtctcatctcttctcttatacatcctcaatcttcagacatttaaggtctctgagtatccaggatttcctttgcgacaataattaacaaatacatgtatgtacatttgtgtgtgtgcattatgttttaagcatatatatatatatgcaggaaactcacatctggagtaccagagtctacaggccaggactagatacttagatctctagggaagtgatccaaatatctagttgcagctatgtagatttcaagaatgcagtgaggggagaaagagtatacttaatatatgagtacatatacactatatatatcccatatatgtatgacatatgtaactaataatagtcaaccctcactaacacaatgtgcctaatattattgtaagcacttcacaccccgttactttgttctcataacatctaaggtaggcatcattattattatcatctagttttacagatgagacaagcaaggcacacaactaataagtggcacagtccaagttcctatctgtgatcctgtctttttcatggaccttttcctatctgttgcctccatgagaacatatctgaactttggcctattcttttttaagactttgctccctcttaggagataacaagtagcagaactcacatgttacccagccaatagtgtacttagcttgggaacaaaagactaaatttgtggaaattcctcacatttgtacaagagaacgtcccaaagcaagatactatggcctggaaaatggaagagatagtttgggcaggtggatgttttgggtctcccaaatcacaacacatgtgcaatgcgcaaccatcaatacataaatccaatttaattcagtatatatttaataagcacctgctgtgagcaagggactctgctaggacctaagctctagaaagtagctacaaagattagaagcaataatcctaatatttagaacatgggagaaaagaaataccacataactaaaacacgatgcaaataagttaataccgtaaagcgttgctaaaaaaaatctgtaggtttcagtgacttgaggaatatcatttgctattcagcggtggacactgacaaagttacctgaagcaggcagtgtttgagatggactttggaatgtgggaaaattccaacaattagaaattggagagataggttttaggcaagggaaacagaaagagtcaaagcaagggataggaaagcacaaactgtgtctggggtcaatttgactagcttctagactactcaaaggatagcagtaggagtttgagatgttgtgggtgaaacatgtggaaatgtccattgagcagcaggaaacccacatgtgcagtaccagagtctacaggccaggactagatacttagatctctagggaagtgctccaaacatctagttgaagctatgtggatttcatgaaactgtccacagatttcaagaatgcagtgaggagagaaagacagacaaacttacattttgtgggcagataaagggaggatggatgaaagatcattcagatgaacaggagaaccataaaaacagacgctatagagtgtaaaggtgaagaatgcttcaaatgcttcaagaattagagatagatagtcaaaacaatcaaatcataaacaggatacctaggattgctgtgaggaagaggtatatttaagagctagagtcttcatcactgtactcatctttgaaaggaccacctcttattgctttctaccctttccctaaactcaagcatgcatacaatcacacacataaacaaacattattttttcctaggaaaaatgttggcattattaactctgaagcaaaactatatctggaagtttttagagtagttagcaagatccaaactttatggtttgattttaattcaaaagataactgaatttttatatgcaggttaattattccttggtgggaatgtgaatttatttgtattttattcaggaagtatttttgagcatttcctaactccaaggtattgtgctaaacgctgggatcagaaaaatttccataaatgcttggatggcttttacctgggagcactccttcctatggttggcaaaaagctgacgcctttgtgatgatgagtttcagtcctagcctctaagagtttttgtggtcatgttattaagtgcaatgtttatgtgtattttttctgttccaagattttttttaaagttttgaatatttttttatgtcaccaaaaggtgctttagaagaacaaactaactcaaagccaacacagaaactggttctcttgctttgccaaagtggcagtgtagcatgtgggcaagtaagaatacttttctcaagtatttaaaacaactacagaaatcttattcttcattgtattctctaaagaataaaggtaagaaggaaaatcaggttttgatagagaattaaaaaatagctttagcatatgttcaaaccattaggtcaaaagggactaacaaagccctgtagaaggggacccacaaaagctgcccttgggacttacttattcacttatttgtttatattttttgtatatgtacatatttttctgatactgctttgacacatcactttagctctttttctatatgtatgaatattcttctcctacaacataggaatcttgatgtatacatagtttagtaatctgcattcattctttcaagataaacatttttaatcctacatggtattctattctaaggatataccagcataaaatacaatttaaacaatcacctatttttggacattttggttgcattctgacttttattcttttcaataattctttgtccagtatcattgggcatagtctttgcaatgctattatttaatgaaaagaaaattttggaaactttaacaggtaataccacaagcgaggaaacttaatacaacgaccacaagcaatgaaagaaaagtcaaatgcctcaaggagccagggtggaagagcaaatgagtgaagtaggtgtggcataaaatatggggtgatagggactttgtcaaactggagagaacatggtttgtctgaagtgagcagctgctactcagttccagatattggtgccacatgtggatgcagatctaatgttgtcagatctccaatttttcaagagaagcaaaaaaaaaaaaaaaaaaaaaaaaatctagtttttttttggtgtgaaatctctttaaccttaaaggttggctcaaattattttaaatattctgtggaccaaacatacattttaaaaaattctatctgctagctagatgcagctcataggccactgatttgtaactttctaattaaagaaagggcaagacggtgtttggaaatatatttctaggtagagagttaagcaaataaagttttacttcaagttttcctagtcacaaggaatgtaatgtggagagactgaacctcaatgtgcaaatcttgaaagatgggtaaatactgctccccacttaacacccatgaagaatttaatagaagaggggtctaaaatgcttttaatttcacaaagaaacatgctttaatgatataaaactctaacccagtgcactgtatgatgatatctaatgataatttcccttcatttcccatctgaacaaacatttcccattaacatccacctgcactacttcctttcataaagaggaggtggtatttggctatgttctggttctgattcatgagaaatcagcccaagcccaacatttctgttcttaacagattttggtttttaaatctgtagaacacaatgtttccctgggctgagttctagcatgccaagttttggctggccacagactttgacatctgagtgaaaaatctttcaacaatggcatttaaactgaagaatcaacagacctttaattataacactgcttgtaattccctccctctcttatcatgatgttcaaattgcctcaaatcactaactgcatggacagcatgttatttcatttgccattggaaatatcataattttaaaacttgggggcttgagattgtgcattaatttttgaaaaatcagtattacttattcaccataaattaaagaggcatatggaacgaaggtcaaaattactgattcattagaaataaaaaacaaaaaccactcaccacacaatttctcaacttatctaaaatgctcaagatttagattaaaaacaatatttccacttggaaattaagcattaaagatatagaaaaagggagtctctttttagtgagatttcactaaatacctctggtatctctccataaaatgttaggtgatcatttcttaacagctttttaaaaatgacacagtctcagattaccctatgtttcccttatataataacaaaagacacttttatactactaaagtacattaggaatcctttgaaagtttctgttttagaaactgatgttgaaaaagtacttaatttatatttaacctgcctatctgaatatacttagtggaaaaattagggttaaaaatgtaaatgtggaaaatgtttatttccatgttttatagtagttagttttttatttgcttttaaatatagatcttggttatatgtggaagacaggcataatttcagctcctttttcatcttgaagagaaacctggctctcaatttccaggaaatatatttatttagacctaacaatataccagaattttatgcattatttctaatcttcataataagtctacaagttgggtgtcattaatctgttactgataaggaaattgaaactcaaataaatttaatgcttttaccaaggtgatttagttagtgtctttttgtccatggattttaagtggtagaatttgcatgcaaacccagatatgactccaacggctctgctttctcctttagaagaaaaaaactccttcctgaaatactaacatcttttctttgtgtaattgaccatcctttcttaatacaattggttatcagagctatcatattcttaattatcagtattaccttacgactctaaaattcatctttgtccagtgtatagaattcacatcctaaggttagatataggagattaagtctctgatctcctggagcagacctggtttcaaatcttgtcttttattatccccataaatatgcatgtatttataaaattatgtcctaagtctttgttcagaaaatatgtagtgtctgacattattttgtgtataaaatgctgaaaaggtcacatccaggaaactagtcctgaccagcatacaacactcaagaaaggttctccaaggtagaatcaggggagaatcccaattgaagttgttgaggggagtaaagataataaataatattaacaataataactccatgcattgaactcttaatattcttcatcctatctatatatcatatttaatttttacactactcccattttgcgtgtgagaaaacagaggcttagagatggtaaataactagttcaaggtcacatgactagtggcattttactccagagctttgctttttgtactttgctaaactctctcccagaatatgggaacaaaatctaaagaggtaaattcaaagatcaatattaagatgataaatacaagatgcagccaggaatcaggaattggagtgggaacagatgaggaaacaaggtggtgggtccagcagggttgcatggttgaagtcagcaaatgtctgatatatgggggtgtcatgtcacattgaaagtacagctacatcagggaggtggagcgactgagagaatatgtagagggtgacagatataggactgcttggctgatttcatgtttttcctttacaaatgtaaataaaacattgtgtgttggaggtcagagggcaaaggagatataactgaggactctactcaaaaaaacatctcgcttcatgtgtcattaactgaacaggggaaagaaactcagttgtctaacaagatatttttaaaatatttatttctccaagagggttaaacctcatttacaccttggagtaaattactttaataaggttaccagatcacctaactgaatgtaactaaagtcaagaagctgcagtttgaatggggaaaggaaatggataactgtggaactgaagggtgggagaaggggatgatagtgacacaagcaaggataaaaaggatttccttaggcgaataggagggcaccaaagataattttatgaaaagacagttcagggctaaataaatgtaaagtactaacatcatcattatcactagttctactctgcacttatgtctagaatttttgtagtagccagtgtacagacaaaatcactaaaattggttgctaatttctgatttacaagctgagcagaattccctacttagagtaactcctcaaaacatacttgttgagcaaaatgggacgtcaaaattttgcctggaagttggaaactttcagattttccaaattccaacctgtttttacagtctaggttaatccagtctaacctatcaagttcatctaactgggtcctccctgggaaaaaggaagaaagaggacataggaagtgaataaagaattgatacctcagctgggcgcgcagtggctcatgcctttaatctcagcactttgggaggccaaggcgggcacatcacctgaggtcaggtgttcaagatcagcctgaccaacttggtgaaaccccgtctttactaaatataaaacttagccgggcgtggtggtgcaggcctgtaatcctagctgcttcggaggctgaggcaggagaattgcttgaacctgggaggtggaggttgcagtgagccgagattgtgccattgcactccagcctggacaacaagagcgaaactccatctcagaagaaaaaaaaaaaagatacctcactgctctccttcccttctgtgtggcccaatacagcatgctgttgaccctggggaagcttcagaatgtatgatctaggaaagctgaggcaatgctgtaataacaagagctatgtgaaaggtaaagtatgaaatgtatgatggaaaccaaaccaaagagggtatgttaaagataagcccattaaggaaatagctcacctgttggactggaatctcaactggctcttttatttcacgctaaacctgtgctgagtctgcacagaaggacttctgaaatgcttatatatacaacctgacaggtacaatcagaaacagtacaaggactgcgtgcctcaacaagaatagccagagcactgaaatcaattgcagagcacagacatacttcaactgtggctatgcagacagtccccaggtatggctggtgaacagcacgctttatgtgtgctatgtcccagacttcctggctttcttcccttccgtcctaccccttcggcacacactacatatctttcacattttataaaatcacaggagatttccaaattattgtgtctttcaaatactttaaaaatatattgtcctcctaatataaaggagagaggtggagtatttagctgatgaactgaatttgaaagtaagtttgcatttttgatatatttccttccttatgagtgagtcatgaaaaatgcatattttgtctaaatattgataaagctttagaatataagagctggagtgaacctaagaggttttgtagcccggcaatttccaacccaggatgtgtctcagaatcacatagagaggtttcagattcccagccaggcacagtggaatgtggctgtagtcctggtgactgggaaggctgaggcaggaggatcactggacccccagagtttgaggccagcctggggcaacatggtgagacccctgtctctaaaaaataaaaagtaagtagaaaatacaaatcacagattcctgggccttttccttcccctgccttccccaagtgattctaattctatgtcagttttggctgcttgcaaccagttatggagaccagggatcttgatcaatctcttcatctatctgatgaggaatctgagacccagagaagtaagaggtacagtgatttctctaaggttacacagtgtatgagtccatttgcacactgctgataaatacatacccaagattgggaagaaaaagaggtttaatggactcacagttccatgtggctggagaggcctcacaatcatggcagaaggcaaggaggagcaagtcacatcttacatggtggcagagaagagagagcttatgcagggaaactccccttttcaaaaccatcagatctcttgagacttattcactatcatgagaatagcacaggaaagacaagccccctgattcaattacctccctctgggtctctcccacatgtgggaattgtgggagatacaattcaagaggaggtttgggtgggggtacagccaaaccatatcccacaggaatatgttacaagtgaagatagtctatggacactgtaaaattgaccccattagctatatcccaaactagttcattattttagaatctattttgtgtgtttgcatgcatacagcaatgcttcacatatctgcacaccacttatgtggcattccaaatatggttaagaacaaacaaagtgaaaaagacctgcaagcagccaaaattggtactaaataaaccacacataatcctccaagtctttttaaaagcctcttctcttgcttctctatctagtgaggcataggtgactcaaaatctttatctccaagcccggcccttctgctgcactatagtgtcgtgtctccaaaagcctagtggaccactcacagatacccagtcggcaccttcactcagtgtgttcaaaattaaacgtgtgctttcccctcccaacccttctcctgctttgctgctctgtttatgactctactaaggttcaaaatcatagagatgtgtttggtgtcttcctctcccttgctccccaaatataatggattaattctcccgccacatttcataaatcagtttgccatctctgttcattccctctgcccctgccctagttagtgccttcattgcctttcacctggactattgtaatagtctcctgcctgatcttgtgtcctctggtctctccctactccaatccattttactcactgttgccagattaatcttcctgaggcacagctctgattatgttactctcctactaaaaactttcaatagctccccactgtctcctgaataaagtccaaattccttgccctaataatcaagtcctttcactttctggtcccaatatacttttaccgctttatttcccactacttatcttcacacattccatgctcaagttaaactcaattacttctttgcagaatctttaccctttgattcttccatgcttttctcatgatagagtaatgttctttccttctatctctgtatgctcaaatcctgcttgtttttcaaagcccaaatccagtgtcatcttttctgatgaagccctcagttagccctcctctgagctccaagaataccttatctgtactacttttatagagcatttcacttttcactattaattctagcaaagtagacacatgtctcagctccgttgctagattaaaacttctagggcaagacatgtcttatctgtgtatcctctccagtgccaagtatacaagtgcacgactcacaatatttgtcaagtgaatgagttcatgtatgtactttacacacaatcaaaacatgtttttttgttttattgtctaaagaagattagaaataatgcatcagagaaggaatgaggatcttagagacttgcacaacagaaagtaacttaatagctaaagaagaaaaataaaaactacgaaaagaaggcatgagaactaaagatatagcagtcagagggtaaagaaacacagaagcaaataatcttatagaataaggaccaaatggttaattgagaagcttggaaaccataaaataacattcaaatatgtagcattatttttatacttccacaccctcatcaatagaaacaaatttgaattgtagttcaagataacaaccctgaatcatttagaaaagtttgaattatggtaagtatattcttttttttgagatggagtcttactctgtgaggctaggtaaataagctgcctttattaatgaagaaattcatatttttctgaatattagagaaatattaatttttcccaattaagatatgttcatgatatacaatttagaaaatataggagagtaataaaaaatcttaaaaatcctaaaaaaggtgggattataccatatgtattactatgtatgctgccttttaacttaatatatagtataaatagttcatactattataggttcttcataaacatttactggctcaaaattctatctaatagatatgtcgtactatacttaacacagcactctagagttgaacatctagcttatttccagttttataatacaaatatgtctaacaagatttaccatgggctgacaactgttgaagcagagtgaggaactcatgagagttcactatgatattcttcctacttttgtatatgtttgaaatatctagaacaaaaaggtaaaaaagcatatttatgtcttaattcatttgtgttgctgtaacagaatattataaactggctaatttaaaaagaaaaaatatatttctcacagttctggaggttgggatgtctagtatgaaggtactggcatctggtgagggccttcttgctagatcatcccatggtggaaggcagagggcaagagagcacaaaagccagagagcaagaaggagccaaactcacttctataatgaacccactctcatgataactaatgcacacactcctgcagtggtggcattcattcattcatgaaggcagagccctcatgactgaatcacctcttattaggccccaccttccaacactgttgcatcagagattaagtgtccaacacaagaacttttggagacacagtcaagccacagccatatgataaatatcttgtgcataatggcttttgtttacttgtaattattttcttaggttgcagtttagggctagactgcctggatcaaagtcttaccccatcattacctagttatctaaccttgggcaagctgctgatgctttctcagcttcagttttctcatttgaaaaatgggtataatggtaacttataggggctgttctaaggatcataagagaagatgtgcttctaatcccttccacagtacctagaacactgttagtgtgcaataaatgtcacctttgaaaaagcaaaatactggttgcataattatgcgttgtgcttataaagaaacatcacatataaactgaaaaacatacctgaaataacatgcttaagtgtgcaccatttctatctccaggctaaatgcttatttcaaagatacgaccactgctaaaataatttagatccataattaccattacgaagcattttctatgtggttgatattggccttactgggctacatgtttgatgtgtactatctcatttaatcatcataagagttttctgattactttatagataaagaaactgatgcttaaaggtgaattaatgtgcccaaaaggacacagggtctgttttcaaacacaggattgaacctctggaattcatctctaagctactgaaaatgacctttgttccctgcactttttttttttttttttttttttgagatggagtttcgctcttgttgcccaggctggagttcaatggcacgatctcagctcaccgcaacctctgcctcctcggttcaagcgattctcctgcctcagcctcccgagtatctgggattacaggcgcccaacaccacgcctggctaattttgtatttttagtagagacggggtttttccatgttggtcatgctgggcttgaactcctgacctcaggtgatccgcctgcctcagccttccaaagtgctggcattacaggcatgagccaccgcgcccggtccgtaccctgcactcttttgcatagacttcagtctttctttctttcttttcttttttcttttctctctctcttcttccttccttccttttttctttctttctttctttcttctttccttctttctttctttctctgtctctctctctctctctctccctcccaccctccctctctctctctctctctctttctttcttttttttgaggcagagtttcattcttgttgcccaggctgcagtgcaatggcgcgatcttggctcaccgcaacccctgcctcctgggttcatgagttctcctgagtagctgggattacaggcatgcgccaccacggctggctaattttgtattcttagtagagacagagtttctccatgttggtcaggctggtctcgaactcctgacctcaggtgatccgcctgcctcggcctcccaaagtgctgggattacaggcgtgagccaccacacccagcctagacttcagtgtttctaatctttattcctcagaggcagatatgaattttggacaaagttttggtccaattttggatgtttaactggacctttgggtaaagtacctttctccttcccattcactttaatcagaattatttatttaacaaattttattctagcaaacaattttagagaagaaaaagtagtactccataacaagctgctcttaaaaatgcatatctcattctggaaaaactaatagctatcatggttttaaacaataattttccattggtttgattatcttatgtccactgtgaaacaacagttcattattaaacaattcattatcaaacacacaaacacatatacacatttaataactttaaaacagtccatatttacatattttactttaaatatgtaatctgaaatgtgtatgcatatgtgtatgtgtgagagtaagacatagaccccggaagtctgaatttggaaaaaccctgtgaaagtctgaaaaaggtggttttctacaaaccttatgaaaaattaagtcatagaaggtcacaattttaaaaaatagataccaaattaagtattttattctgggtttagggaggcttctcctgtgcaacatactttagaccaaggcagtcaagaaatactaaaggggatgctgcaattcctctgcctcagacagtacatttatgcatctgtattataaaaaatgtgccagctctagcaagctcacagtactgagcaaagtgctatagttacagctggctctgtttactctttttttttctggtctgttcctctattgggggggggccacagtagggtgttttttcaggatggggggaagaaggaaggagtttttgtgagttctattttggattttggtgaataagaaagcagagaatttgctagcctgttactcagttacactgaaacatgatgcaaactgactcaatttggagcacagaaggtgctgaaaaatttttctaaggaggtcttgaaatatctaagtctgccttcaaggaaggacttataaaaaaaaatcaccatgtaaataatagaagtatgttgctacttctcttaaacctgacctcttaagtcactactcacactaatatactctaaaagtagccagcatgatatttcaaaaattactttgtgtcctttatcctcagtagagtattaagaggaagatgcttgagtgtagacacacatgtgggtcttctttacaaagtcacgtctacatatgtacaccgttagaagtatgggctctaaatgattgaacaagctgtatttccatatttgtattgtccaacctattttcttttttcttattttcctgaatatgtctgaatatatgtgttcagtataaacatacaattgtgtggacgtgtctatgtgtgtttctaattctatactatcttgaaaatggctcagcgttctagaaatacagccacataatttgttttgttttgaaaaactgctcagcaaatgcatacaggtcataatggcaggtaacagaccatttattgaagtgctgaaacaaatagaaaacaaagtccaggacaccatcacagagcagtacttcccttgtgagatactctcagctaagtaagaattgagtgagacaacaataaaacaaatacccataggcttttcaaacagtaacaacccgctcagggttagcagcatttctagaccttgatggtacaatgatgttctcaacctttgctttcagacactggatcactgcttaagtagcctttatcttttccccctaatttttgttgaagatgcccttgaaattagattatatttgttcctaacaaagcatatgtatattgtggcatcactcttaaaaccaacaattgggcttagttttatgaagaaaaaaaatccaccaacctttcatgctgagatttctcatgctagttctcagcacagaagtgattttttttttttaagttgcataaagcctagcaaggtttaagttttcccagcaaggagaaagtgtttttcagctgttaaatttttcagatgctttttttgaatttggataaaactcaaaaacatgtttgttttaaaatgtaaaccttttcatgtacagaggtttgcatatagagaaatgctattactatgtttaaagatacttgcttttgaaataaggaggtcacatgcatttaaaaataacaaactgcatgttgctttatgaatgtcctattaagccctaacgtaaatatgatgttctggaggagcactgatgcacacgtttgctgataggatcacttacaacactgcttgtggatgtatttccatgtgagagcaaagggtggtcaggtttgaactgaagaacatccatatagtcagctaatatgctttttaaagaccttttacctcagttgcaacacacttctttgtcctaaacctgctggattactcaacttgttggctggactaaagctgacacaatacatatttcaagcacaaaaatgatgaggaacacatagggatgtcagcaaagaggcaaagaggatggtaagtcatcggaaggctggtcatttttttttttttaaacagttcaatgtctttactgttttctgtaatattatcattttccatttttcaaacaatggaaagaacaacaattagtttcatttttaaaattattagatcataaaggacaagtttaggaatattgtttctagcatactaatagatgaagttagttgtaaatcaatagtcttatttctctgttttaaaaaaatagcaaaatacagtattctgaggaaagttctgacagattggagtgttacaggatagtctgaaatctgtttcattatagaagtttggccaatatagagataatatattttaaatggcttaagtatatattttttgtggattgcacattctgtaagacggtttgagtgccttgagatccaagtctttaggtcaagactgaactctagaaatggccccatcgaatctacaaaaggatacattaaaaaaaaaaaaaacctcatttcctgtaagctgctgatgctactcaacagagttgaaactcaggtcacacgcatcctactactctagtgctgccccatttactaatccaaacgaggataaaccctgagagatccgttatgtttctacataaggagtgtacaagcttctcttgaaaatcattgcattgggagagacacagagaaataacagaggtgagaatccctccccgatttgcttgctaaatccgtattcattcctgaagatccagatcaaataccacctgactgttaggccttctctgagaaactctattttgcaggcaagtattggaacgactctatgcgcatctccagtcccaatgcatcctttaaataatctgtttcctctctgtttcttgctgcattacagacatctgtgttacacatccatccttccctaatagtcagtggactcttttaggtgaaggactgtgtctctatgtccctatgctgaaaggacaatgggaagagatggtgctattgatgcccagaggcctgggtcaccagggaagctggagtcacagcaggtttgttcagagggagtaaaccacaaaggaaatgtggctggtgatgatgatgatgcaaagaacggtgggggaaatctctggcctatgccttctactgaccctcttgccactcacaagtgtctcacaagcaccaaatccaacttggaatctagctgacatgggtcagccactgttgtagagcaagggtagggtgagggttgggtctgagggtaaacacatccacaatgtgggagcaggaagatgtctttgcaggggggtgtctaggactatggacttaagataacctcacagggtcaccatgccccagcatgacccagaagggcccagagcaaggaagacatgacaaaggagcctgaagacttgaggaggccttggagctgggacaaggaagacacatcagggatctacatggacaggaaactaaagatgaggtgggctctcagacatctcagggaatttgagctcagaagacaacactgagaagaccagacaccatagtgagtagactgtatctaactgctctccaccctcactttcatattgcatttggatggcactccaaggaaggggagaggagaccacctagcagaatggaggccaaatctgagttacctcatagataaggaaagaaggcctgtgatttttaatgggtcagtcactcttaaattttaagcaaactgtagattttctgaataggagaagatattatcttaatctacacaaattttttgttgtttttttggcagggtttaaaatatttttattcatgacttatagtagaaactacattttatattgtgacccagtaactgtttacacacatacatggatgtatgtgtgtgttctggaggtagaaagtaaccaatctgctcaaattttaaatattaagattattcataattctttaagtagtttattgtttggaaagttatagaccaaggtctagaaattcagcagacctctaacctctaatcaaggacttttaaaaattaagaacagtacctgattttctgatttagtctttgaaatgccagtgctattcattctttgccttattcactcataattatttattcattctccaaacatttattgagagcttactgtatgctttatactatagacctgcagcacaaatataggcctattacttcacagctgctttaggatttatagcagtactggtcagatagttcttaaaaaggaaaagttttcagagtgcaacaacctgttcacaataattcctatgtagcagtgaagagccttgacagcatctcttttactttctcattgtggttctagtttaataacataagtctatttttacttttcatatttaactttaattaaacatgctatgagtgcaatcatgagattttaataaattagactatttgaaaataattttcccataatgatgtcttcctcatatctttcatgatacacaaaaagaatatttgtacaaatattttgttgcttcaaatatgcagaaaactgaccattatttacagtgattttgaaaataaatgagtgaaagcatgcgaacttataaggagagtaaataagcagcacaccattaccatctgagacagcatggctgctcccctcttggtgagggcagtataggtacagcaagcagaagacagatcataagtatttactatcagaccttctttaagtgaatatgtcctattccagtagaaagtatcatataagcatacggcctgaatccaattcaattatttacatggctctaccagtaaatggttaacactgtagaccagaaatttagaaaatgcagaagactgaacgatatgtaagtgactgagaacatgagtctctctcctcatcatgtaggacatgggtcgaggtcatagacttaattggtaggagttgctactttcgaagagtgaaatgctttgaggcttttaagagaattttaagttgattaactttttatttgggggaattatgatgtgagctttattaaaatatcacaattcggcattgtttcataaacataattataggccaccttttcaaaaattgcaagagtagtactaagaaggtcctttgaactaaggttcaaaggaccttcttagtaactcttgtaatttttatgggtacagttagttgtctgcataaagtcattccattttccaaagctgcttactctttgcacaaatgacaaattggcacatgcacaatggcacaggaaaagaagtaactgctaaggtcacatatgtgaggacgttgcagcctttaagtactggaggccaaagttaccagaaacatgggcagacagattaaaattttcccttcttatgtttgtgcattgtttctatatggaaaattacatttttctgagagtatatgtgtaaatatgcatctgctagtgttttggcaactctaagttacctaaattagttttgatcaacactgtcggatttttaaacccaccaacgtaataaaagcaagtttaaaaaaacacaaacaaaccctacagtacattgtgtgctctgctgttccaagcctcagcttcaagacaaaaggagagcgagactttgtcattcgctagctgttaataatcaagagaagatctgccagacaagctcttcgagggctctgtctgtctggaccaggtatatactgcaatacacaaagggctttgcagggggagaaaaatgagtgttcatggacaatgatgcagctttcttaattaagattttcattactgatacatacattaagttctgcaactgcaagagccaaagcactgtcatgtgcaggtagatgtccctgattccatcttcaggcagtaaagctaaaacatattaaatgtgcacccagcaaatgttgtgggagccaggagagctccagaaatatttttgttggaatgcagagaggccccattataggcagatttgtaatgcatctaataggcaggagaaaagctcatatcaatagagtgtgtgtgtgtgtgtgtgtgcgcgtgcatgtgtgtgtgtgcgtgagtgcacgcacgcacgtgtatggaagtgctttgaggccctggaccacagacaaaggtaacagtagctgatctagaagtaatccccatataataatataatagctcaggtcttaaaaggaactttgatcttttaaatttgccaatgccgattgttgagacaggaaataaaggattgatttggtagcttttggaagatggtaaggactcctgcatacagccagtcctgactctgcccctcctgggtcactcagtctattttccctggatccgcatgctggtctgaaagtcaatgcagtctgccaaagtggtatactgttcccatgaaataatccaactgtggtatggagaaatctttttttcttagaccaagttatttttacaaaaatacttttgcgaagaaatgagaggaaactaaaaccctacacaatcctagaagtggattactgtctagagtgcatgttttttattccatcttataaagcctaactcattttagggtggctagtgcagttaaggtgcagacatctcttggttgtttttctggtgcttttacttgcatgctttcctgtttccaaatctgcatccatattgggggttacccacagagagctgttgtctcctctctgaagaacatctccatcttttggtcactacttgagtagagatgagtgatgcttaatgaaatatcattttattacaacggtcaaaaattatggattcatttcttattagattatatgctctgaatgttcaccaccccccaattcacatgttgaaacttaattgcccatgtgatagtattaagaggtggagtctttaggaagtgattaaatcatgaaggcagagccctcatgaatggatttgtgcccttatataaaaggtgtgaaggagctgtctctctcccttttcctcttccaccctttgccatatgaagatacagcaagaggtgcgatcttggaagcagagaggacttcaccagataccaaatttgcaggtgcctcaatcttgaatttcctagtctctgtaactatgaaaaataagtttctgttgtttataaattacccagtctcaggtattttgttatagcagcaaaaatggactaacacattaggtacaagcatttatttgacatttaaatgtaatccctcattttctaagaaggaataagccagaatccaacatcaaaatgtttcaaaaggaatacttcaaagtgttttagctgtagttctttgtcgattaaataaaaaaaaattccaaataatggtggtcagtaagagtgtgtgtgtgtgtgtgtggggggggggggcggtgtatgaattcctgtgctaagattcagatctttgaaactgttttctagaatgttatcctacatgtctaaaactttttttctaagtgtatcagagatttgggatggagtggtaaacacataggttactaggaggtggcttgcctctgtacccattctagatgagtaatgttaatgactgatgataatgtaatgatgaaaaaattggttctttttaagtaaatagatagtctacagacaccctgtcaacagatagtgcatgcttactgaggaagttaacagtgttaggattcttcctaacctttactgaaaggtactgttataaaactggtagaggagtatgtgaaagctactggtgaagaaccaatgcagtgaagattattcaagcatggtggtgatggataaaagcatagaaaaaaaactcagaaaattattttgactgaagacttttcattacttttcttatgtgtccttgagtagcttataaggactaggctgaaggctactattaaaagatttaggtgtacctttcactcatgttctttcatgagacacacggttctctcattcaaagtacaaggttaattttaaattagaggtgagaattattcttcatgtatcaaaaagcctagaaatttaccagggattaaaggtagaacccattttagcctatcgaagtgtgagaggtaaggtgacctgtttagatgaatatcttgaaatgattctctggagcatgcctgatctgttctcaatacccacacattagaagaaatgaagaataatatagagactacacaaagagaccatgtaaaagaagaaccctgataaaagaaaaaaaactcttaattttatcactgcaaagacttcttgtacaagatgcctctgcaagtgtcctagtagcatgactccttaaacaagtaggatgcgtgtatgtggaagatatatatatgtatatataacatttaaaatctccctcgaaccccagcttctgagtataaactatgttacagaagcatgtggataatatgtgaagctttctaggagcatcattaagaaaatgagacatttgacactctgagccctaggtacactgagtcagtggcatggtctccaagggcactgctggcagcactaaagcctggctcataaccatatgtgcacacctcaagaggtgtttgactgttcaggtagaggataagccatttcctaggcctggttccttccattctccttagcttgtagttggcctgaagggacttcctagactctaacatgtttgcctctcttttgcttcctttctggacactgtctaaggatttaaaacacacatgactttcatgtccacaattttctgccaaagagggggaaaaatgccccagagcatgtcatcccttaccatctgcaaatgaacttctgtggtcaaggaatgctccaattaccacccagaacagctttgtacaactcctgaccctcgggaagactcgaggaactcactcccagaacccagatgctccctgtcccagaacacagggaagacgccctgtcatcacagtttgcacggcagaggcggaggtgatgctgttagtgtggtatttccaattctctagcgtctttcactttccctgaagttgctgaagaatattccatttcattaagtatgtagtaatacacatgggaatcagagagcggggaaagatggaggacgttgatgacatggcctctagcactttatttatgagaacatccagaaatctctatctacatctgggagaagaataatgtcaatcctgccctggagacatggatcaggcaatgttgccagtgtgtatttttcccttcccaataatttactgattctggagtctaaggcagagcgctgatgataatttttacattcatgtgagtgagcctggccctttgagggctggtgatgccaaataaacataaatgtatgtaaccaggtgaatacttaccacctcccaacccagaaatgtcataggtctctggtggtgctttgcttcccacaacactcccctgaagggcggtgagggtaggtgttgccatcagagcataagaagcagagcttgaggtggccttggaggacttcagggagcactgcctttgcagtaaagaatgagactaagcaaacaaacctgttagacggctcatttgtcttttccaatttttttattgtgttattcatcctttcatcattgatttatagctattcttaaaatattagggatatatcacaaatatttttcctagtttaaaaaatgattttctaccatagtaatttttattttcatgtaataaaatttaaaatacatgtattttttaaaaagttttcaggctttggttttatgcctggaaaatgcatctcatacctccagtatgaaaatattcatgtatatggcaaaaattatcactgaaaattacagaattagtgaggatgcagagaaatgggcagtctctttttttgttggtgaagatattaaccaatgctagaggacagtttagtaatgcattttacttttgcagttccactataattaattgatcctaaggaaataatcatgtaagtgtacaaacatgtgtacatatgcatgtgcatataaagacagttattgtggcattgtttagtaagaagaaagttccaaattcccaactgtccatcaataagtgattgagtcaataaattatgcatatactgaagtgcaacgttgttgtcaaaagataatgtagatctatatttattaacatggtaaatgactattacaatgttaagtgaaaagaatagaatacaaaacagcaagtaacttctcctttcagtctggaaagagaaagacaaagagaaagaaaaagagaaagataaacaggactgtatggaaatataatatttcctaagttattaatagtgattatctctgggctgtgagatttcaaaggaatttaaccttgctctttataaatactatcaatgaaacaaattcaagcaaaactaaatgtatacttttttagaattaaaaattagaacttttattttgggggaaaaagaacttacctaaaacctgcaataaatacttaaaaattccaatatgatcttcagtcattagcaattactaactagctctcttagtagggtgacatcaatgtctgcctcaagtttcccccaagtttgacactttgagatgtacatcatagttcttcccttaaagaattttaaaatataaaatttcaagtagtgaatataacccaaatatttttatctagggcatggttaggtaaattctgggggctttatgtgatattattcagatgttatagtgctatttataaagagtttttaattataccaggaagtatttattatataatattgaattaaaatgggatacaactgtatacatgcaatgtatgctcaggcatgttaaaatctagagaagacactagaaggtgatctaaaaaattattaataatagttggttctgtgtagtggaattatggatgtttcccctttactctatactttctaaatatttcacaataagtgtgaattatagaatcataaaaaaagtaaatattaaaaaaaagctgttttgctcgacagctgccaaattttaccccagatgtatcagcaatttagcttttagtcaaatgaccctaacatcatttcctaaagggaatatcacagaatggaatgtgcccaaataaagataagccatcacggccaccacctctttctaagctatcattttataatgcttaaaataaatctgagtaagggatctttcttctgttggaagttataaacttccacctccttcagaccctctccatatcttctcttgcattaccagcacctggaatttataattaacctatagtaccctggtacgtttctaggtctggaagctgtttttggaggctgatggtgtagatcaccattagggatggaggattatttattcattttaaatgggagttcccttgaataacaaacagggatgagctgctatataagatcttgtgtagttaatatgctttcttacccttcttatatatatatttattgattgattgattttttgagatggagtctcacactgtcgcctgagctggtgtgcagtggtgcgatctcggcttgctgcaatccctgcctcctgggttcaagagattctcctgcctcatcctcccgagtagctaggattacaagcacccgccactatgcccggctaattttttgtatttttagtagagatggagtttcactgtgttggccaggctggtctcgaactcttgacctcgtgatctgcctgcctcggcctcccaaagtgttgggattacaggcgtgagatcccgtgcccggcccgcttccttcctcttctttccatccctcccttctttcttcccttgttccctctctcacctgtctacactcctgtctccagccctcttaaataaatagcttttctgtagtgttagatgccagctcttaacatttagagacaattcacactataccaataccatacttcaagtagatgatctaattgtttctaaatcatcatattttagcaaaaagataatgggagaaatcaaagttgtctctcacatatgtatgatgcatactagaggcttggcaataaggcagagagtagatattttttgagaaagtaaataacaaaacaaaacaaaaagccaaaacacaaaaacaaactgggtattgtgaggacagggcagagggaaggagcaggcataagaaagaaaaggaatgacatcggtctcctggtccttgcaaaggttattcaagtccctgttcctggtgttttggaccagatatcagcctacaaaccaccctggactgtgagctatttgaaggcatagatggtgtcttactcacctctgtattttctgtaccaaacacagtgcctgatacaatatactcaacagatgcctggagaatttaactaagccctttcactgccctttcttactggcctcagctagaaccaaaacaagaagctaaaactcctaatgccacaaatgctaggtgaaaccctatcctaattcaaactcatttcttctgattttgcaccttggtccccaaactgctggagaaaatcccatgacagagcagataggtatcaacatcaacccaccagactcacctgcaccttccacactgccaaggagagtcctactgtatttctctggtcaacttgctgtcccatttgtctcaagaacgatttcaaatctctactttccttaaatctcttccccgcttattcttagcaggaccttgcccctcagtgcccatcacttgggaaacctcttaacctttcagtaccaaatctacacgtgggcttgcatctgctcctttcctttactcctcctttcttacaaaaatagaagatgtgtccctccttccatctctccacttgtactcaggattccatctctctggccttatcagtaatcttatactgccagtcatcctatgctcttctctcttctgcacattggatctctcctctctacggtattcttcccatgaaaatacaaaaaatactagtgtttccatgcttttccaaccttcttttgacctcacttcccccctcaagatattgcagtagctcattttcctttccttcatagcaaaacttctgagtggcccacatttgctgtttcttcacttctcattctctcctcatcccattacaaacacgttattgttttgaccacttcaacaaaacagcttttgctgaggtcaacaataagctcaaaattaatataagcaatatatatttgttagtctttaacctacttgattgctcagtaacatgtcacatcactgaccactacctttgaggcactctcttggcttctgtgcctatgttttctgattttcctgccaccttcttggtggctccttctgagggtattttatggcctcatttttttctaccagcggattaaatattaagagctcttcaagtctcagtttaggtcttcttctcaatctaaccctgtccctaggcaatgttattcatgccaacagattcatttaccactatatgtcgattaccctgaattcatgtctccagccttcatgttacttctgaattccagttttatgtatataaatacctgtgcaatatgctcactatgtatctatccaaagtacctcacactcaacatctcaaaaacagaacttacaaacttctctccactccagtcctcctttggtgtttcatgtaactgtgaatggtattatccttcatatagtttgataagccccaaaccaggagtcattgttgccacttctctcttttatttcacataaccaaccatgaaaaagtccaggaatattttacttctgaattatctctcagttccatcaatttcctcccatttccactgtcaatactctagtctgcctcttatgtggtctactggaatagctccctcactggtttcctcatatccatttttgatccttccaaattatttaccaaagttaagctaccttgatatatatttttaaatttttaatttcaagataattttagattaacgtgcagttgtaagagataatacagagagatttgttattctttttacccagttttgcccaaatggtaacattttatataactgtagtacaatatcacaatcaggaaattaacattggtgcaatccatctgccttactcaggtttcatcagttttatatgcacatgagtatgtgagtgtatatttagttctgagcaattttattacatccatacactcatgaatactaccacagtcaagctacaggacagttccatcacaaaagatcccttgcgttatcctttatagcaacactcacctccatttctatcccaactccctaactttgtcatccacaagtatgttctcaatccttacatatttttttcatttcaagagtgctatatagataagaatcgtaacagtacatcatcttgagattagctttttcacccaatgtaatacccttgtgattaaaaccagttattgtatgcatcaataatttattctgcttagtgctgagaggtattccatggtatagatataacagtttgcttaaccactgacccactgaagaaaatgtgggttgtttccagttttgggctattacaaataaagctgctatgtacattggtgtaacataatgtacaggtgttgtacagttatgtttccatctctctgggataaatgccccaaagtttacccttttaaaaaacaacaatgatcatgccacagtccttcttaagtttgctcctctactgtccttaggataaacacaaaaatccttaacatggcctaccaaggacctgttatcatcaggccttacgtatctcttcaacctcaacctgggctgctagtcacctttttctctctgtgcagctctcttcagggacttcatgctgttccctctgcctggaatcctcttccaccatccatccttactttttgtttttaaccttcaggtgtcatctcaaatgttactatttcagagaagcttctcctgaatttccagactcagttaaatcttcttcttttatttgcccttagagcacatggtacttttattatatagtggtaagcacaatttgtaattacaagttatattgtgagaccatttgcttagtatctgtcttacattccccagattataagctccagaaggagagagactatgttaatattcctttattatatatacctttagtatttagtagacactcaactttgtgtccagtaaaatttggctgaggcttttaagacatagtcctggaatcaagttctatctctaccatttattagatgttcttataaaataaatcaaacatgttaaatctcagttttctgatctgcacaattaggattatagtagcatctacttaatagggtagttttgaaggttaaatcagatagccatgaaaagtatttagtccagtatctaaagcaaggcaagcactcaataggtatttcttattgttattattagttgaacaagaaactagagtttttgtattttttttcctaactaggcttttgtccattatcttcatttcttgcctgttcccccaggttctgattcttgtaacttttgagactctgaaaaggggcccttagtttagatcttggataaccagtaggactactggttcttaccccaggtatatgctctcagaccagatgtggctctggttcccattttcatctcactcagtacttcctcctcttgttttccagtctatggatgtcagtgtgggtaagaatgcctcttccctactcctagtttccagatgttttctaaacactgctttcctcttgtctcattccttataattccccatggaggcaaagtatcccattggtgggaaagcccttggtctatatttctcaggtaggtagaactgatctatccaaatttgtaagcacaggagtttaacctctttgtccttccttttctactgagactatcgggaggtgatgacctggaaagtgttgctcatatgcagatccacattttcctgtaagagagcttttgaaaggtttgactgaagggaagagagtcagcaaacccatttcctctttacactaagctatgctcttcaaccaacctttataaaaattttggttccctagctatcagttcttttgtcttatttttcaataggtttagaattcaagtggggaaaagtgatgctatttatgggccccctcgaagattccaacactttggtatatgattttgcttggaatatgattctgtttctcttcatcttttttacattttagccagttttcaagactcagctgaatcagttttacatgaaactttctagcctgcaaggctctttcatgaatgaaaccctatggtacttcctggactgtatcattccttttggaacttagtcatttattatcttatgtgcatacacaacgctcaacaatataactgtttttcctaactcaattttaaattccttaagagcaagaaagggtcatgtacttatggtatatttatgctttaactatccaataaaaattattctttgtacatagcatgtttttaataatatcttaaagcgtgaatgtgggggagagtggcctactgaccaggctttgatttgaaggcccaaggtacaacggaaatggcttagtagctggatggttcctgaagaggttgtcgcagtgcagtggtgaaagaaagaaaaggttactatgggcatgtccctgaggtgtgtatcagtgcaagtctgtgtatacacacacacacacacacacacacagtctctctctctcttacatatatatgtaaatagaacttaaatctgtcttgtgctgtgttttcgccttagtaatactttatttctcttattaaaaatacatggaactcaccatctgataggtagaaaggctaagagaaatgcaaccagagggaggtaatattcctggctatagtcgattggtgttcagagtgttttgattctctgaatgagtcaaaagattgaaaaaaaaatagccactcttatcactaggaaaagaaatgaggaggaagggtcctgaaaatggtgtctgagcaatgaaagacagtgaatattttaaagatcacaaaatttaatttattcaacctaaatgcataaaagtacaggtggggacattatttatgcaggtatatgcaaatcactttataaaataggcaaagcccttctgctttttataagttgccaaggtggttcctgatattttaaaagctatgcacctttaatgtaatttcctaagagttggaatccctctgtcgaaatcatagtcattgtcagagcaagttgatttttttttttcctatcctctgggacatttacaaggatcttataaccatcacaaaaagagtggtttccacagagatgtgactggaaaaatcccttggaaattgctgaggagcaagtcacagtgttcaaagcaaagaacataggctttgaaaacatgaacccatctgacctcttgaatttagtacagtgaattcctgagctctgaaacatggggcccggctgtgcatgccatattggtgctataagactggcagtaggttggctgtggcatggtctatttcaaactccttcacagtgcccagtgttgcatgttcccagatgacatttggttggcagaagctgggcttccaaagctggcagcctggaatgcagcccactgtgttttgacaaacacataattgaccatctgatcaccagcctacgttctgcactcaggtcactgggggacctgggctttcaataggtccctactcctcgtcttgttcatcttcccaaacctttctccagaaagcaatatagagaaggcttaaacacacccacgcatatcctcccatttgcaaaagagaacatagtacatgaaacataagctgttgaaaatttcctttaaattgtcctggcagcccaaagtgaacaagagaaaagcacacttatggtgaactctaattcagagagaaggaatgaatacactgaattgtttcaacacccggctgtgcataagttgcaattcagttcaatggtttggaaattttgcttagaaaaagggagcaatgagaaaatgataggaaattggggcattgattgactttaggggggcattatttagaaactgtttcattttcaggtgaaagaagagacaagcaggacactgggaatgtcttctccttatctgcctgctcctccctcacacccactatgggcagtaggaggcacgcgagcctggtgaccagggggcagtagctcaaagtgaggtcatattcaaattgaggtctttgctgaagatcccataaggatgtattttggtctgaaatttgactccacacaatgtttcagcctttctcctagaaggcaaagattatgcaataggccaagatatgctggaattacacaaaggttaatgtctatttcaacactaccaaatagcctctccctccatcctacccctactgcacagttcaggcctttggcttttacctttgacctggtctccctattctgagtcagcctctccactttcaccaagtgctctttctaaaacatacatctgcttacaattcttcaaagcctccttgagcctgcaggatcaagtccaaactcctctgcacggcatacaaggtcctccgtatggcaggcaaggtcccctgcctgctttccagcccaatctcatactactctttcaaccaccatgtttcaatcacactgaactattcactcctctgaatctcgctgctacttaacgcctcctgattttgtaaatgctcttacatttttcttgattatgatccccttttctttctgctctttcatatctacctggtaaactgcaatttactcttctgactttaagacccagcctggtcaccttaccacatccaagtgggcactcctccttcattcctcttactacgtcttgtatatacctgcatttcagtgcctatcatatgctatagtctttattcacttatgtatctcccctatcagactgagatttctaacaaaagaaagcatttcttatttatcccggagtttccagaaccaagcacagtgactagctttccataaatgtttgttgaatgaaaactaaataaagagctgtacatgataattaatcaaaacgaagccaagtagtagtgttagcttttataagcatagtaggagcccattagcaatctaatgaaggcagaagatcccagcagtaaggcactttctgatgggtatggcaggggctggtgactggctggggtgacagtaagagtgagggataaattctgtgatggaggaaggtctttttaacagagactgccactaaggctgtaaattaacacccttttcaagacttaatattcaatactgaaagatattgtcctgagaataaatctgaatctgaattgtatagagacctaacttataagaaccaagtttcccaaataaggtaagtctgtgctacctgcttcaaggtagcatggcagattatggagggttcctctttgtttctgctaaacagtaatggaatgggaaattcttgggggaacatctgagagctcttcagttcctattgaaatccaggtcaaatacagattgtgatactggactaaatgcactgctaagagaagatcgaacaagcagaattctgtacctgtttagaggaggccattgaagaggcacttggagtcaaagcactggggagataatgttctgatctgttctcaagggacattggacatttcttttccttttgtcgagcctctggggcaccactctggagccatcaaccatcaactgtgtctatgggatacttgaggacagtaggactgtcataagcccggtcaccctgctgatatgagggcagcttcaagatttggaacaagccaagcaaacatgaagcctggcccagggatggcacaaggtcatgggtatatgaacggattatctgctcattataggtcactcccccagccttatgtgtggttaaaaaataggatatctctagaagctatgcaactgatggctgatgtagcatagaatcagatttgcattttcctatgagccagagacagcctttcaactacactttttatctcaaaagtctcccccttgattcctaattggtgacacaggtcccctgtactgcttgtgtctgaggctcgccctatagcactgacgtcacaatagctgagccgtgcgggcaggagtgcactgtgctgactcatcccggtgatgtgaggattaatgccttgtctaacacagagctattatgtgaactgtttttacacaaaagaactgtaacaaaaatgatttgccagtcagaggactagaaatatgcagtgctaggtaactgaggggagggctgtgcagatataaagtggtaaccataagcatgcatattgacatcctccaaagcatttacagacccactctatcaacactgaaatagagaataacaagacttgtcagggacaggtaggacccacccctgttgtataaatgcattacacacagctccagtctttggggagtttaatcaatctcctttctctgtcaaataaactgtcacgttacactttagccttagcatcctttggaggattctgcctccctaaatatatttgccactatcttctaggaatgttagtggaaggcacgcataaacaaaatagccatgggaacctccattctgtgcaaatgattataatacaagaaataccttggagtgaagagtcagtgaagcaagatataatgttgtgaataaggaacagagctcaccagagagtgagaagcagccagaggataccgataattatttatcacattaggtgactatcactacctgtaggatcttttgggtggtgtctcttataagtgactttgattatttgggttcattggcctagaatctttttcaagcagttcaaaataaaatttatttaaacccattcagtgcagcctggtttgaattttaaataatgaacgttctcttttttttcatataaaatcgtgtttttttttccccccgaatacctttccatcttttctaaaaaagagtggtacctttataaaccttctggcacacgtgaatctgggatttctttttttcccctgtagacttcataattttgcacaaaagtttagtctatttattttacagtcttgtacttcttagtaaagggatattagaaattttgtcaataaatgaaagctctgatctagaagttaaaattaaaaactattggacctagggatgggtacataactgaagaatacataattgcccaatgattgacaggggagcaaaagcccaactgttgctggtatttggctgaataatgtaagctatactttaaaagagcagtgacttttgcaaacagcagctgcagccaagtaaagggcagcctttatagaagtacagtatctgggccactggtattttctgcaccctcatggatagcaacttagtattaccaccaacagcatacactccaaacgcaaaagaaactaatacacactacagaagcactagaaaccacaacaaagtcaactaggaaatatgccagtgaaaaccacaatttcctaaatctgacacttttttttttaaaggtaaagaaatcacttttacttacgtaaagagaaggggcaggtcacagactgatggtcaaagatctgaaaatcaaagaaaaaataaggaattaaaagcaaaccgatatatgatgcaaaaccaatatataaaagcaaaatgatacagtgggaagaaagaaagcaaatctaggcatagatgggactggttgttcctaaaggagcctattttgtcacttctagcctcaaaataaaggagacccagcttcataaaaactttctaaaggtatgaccccctgctatgatgaccaagacagtacttcccagcacaaggagtgcaaagacctttctttgttcatttcattctaatctgtatcatataggatttggtagagctatgttaccatttaacaaaatagccactagccacatttgtctatttaaatttaaattatttaacatttaataaaaagctaaacatttagttcctcagtcttgccagcttcatttcaagtgctcaatacccacatgtggctggtgactgccttactggatagcacagatagaaaatgtttctattattgtagaaacttctattgggcagcactgactagaataggtaaaagctttactatacagtacatgaccaattttagctaattttgacaaagatgagtcaaaccctgataaactttgtctcttttaaggtatatttagtatgtttaatgtccagaagttcctctgaacaaattcaatacattcgtgtgtagctaagaactcagtcctaagtttgccccggacttgccttctaaaactgcctctaccccttctcaccagcctagaatgtcccctctatggtggaaaataatctgataaagtgattttaaacaaagcttctctcccaccaaacacaactctgtttggtgatgaaaatttcagatgaaatgatgaaaattttagattttggagaagctgaccctaacagtgttcttgttctatgtttaaaatctgatatttcactctttaaattacaagccaggctaggcgcggtggctcacgcctgtaaatcccagcactttgggaggccaaggtgggtggatcacttgaggtcaggagttcgagaccagcctggccaaaatggtggaaccctgtttctactaaaactacaaaaattagccaggcatggtggcgggcgcctgtaatcccagctacttgggaggccgaggcaggagaattgcttgaacctgggaggcggaggttgcagtgagcccacatcacgccactgcactccagcctgggtgacaagagcaaaactccgtcaaaaaaaaaaaaatcacaggccaaaaaaaaaaaaaactattataggactggtctgcccatcattgtgctttgtttttttttctttcttttttttttttttttgagatgaactctccctctgtcacccaggctggagtgcagtggcacgatcttggctcactgcaacctctgcctcctgagtttaagcgattctcctgcttcagcctcctgagtagctgggactacaggcacgcaccaccacacccagctaatttttgtagttttagtagaaatggggtttgccatattggccaggctggtctcaaactcctgaactcaggtgatccacccaccttggcctcccaaagtgctggaattacaagtgtgagccaccgtgcccagacccatcagtgttttgatagcttctcttagaaggataaaactgaagtaggaggagagccatgacaaattaataaaccaaaaaaagatactgagaaaacaaagcaggtccccctacctctagcccacttaaatatatcaagaatttaatacagggtgattcaatcttgcctctctgacaccatgattttaacaacttcacataaggcctccagaaatatgcaaaacaaacttcactaaaggagatcaagtagaaggacctgattaagtatctttgcattgaaaaggctaaagcagaaaaccagcaattaaagacatcacccttcctggaaagtttctgggacaactgcactattgtagagatttcttcaaagaaatgatttccctttgtggtcaatgtgaaaccttgctcaagtacatgcaggtgtacttgatgcaggatggtgacaagacgagttaagatgaaaatctccagcctggattattataatgctaatacaagagaggctggagatctccaatgctttcaaattgtttcacaaaattcatgagtttaatgaaaattttaggcaagagaattagattatgtatgattcattgaaagcacatacaaatttgaaatatatatataacactgactagtcttcaaagattttaaagctctaagttttgctatattctagtcttctctgcaagccaggatattagactatggcacaggggcatattttcttaccattttcctccctccctctctcctttcttccttccctccctccctccctcctttcttacattcctctctctctatttctctttctttctttccctctccttttttgaacttgctgtcttctctaaccttggggagaagaagaaaatattattagcaattttctatgaaatatgttcaatgatcatttttctgttgcatgttataaacccaataactctcaacaatattatgctcttctaaaattatacctagtgtttatgttcttatatctaaacacataactttcttttctaaatttcaaggtgcatttattcataaaattagttaaaattaaatttttgatgtgatcaaaagagatcaatgtaagttgtacccaaattgactaacacatccaatgtctggaatgaaaaactatctttcctggatgtcaaatgacacacaggatggctgtcaatgataggaatccaaaatggagagaaaaattacagtgtgtatgtcacagtctaaaacaaattaaagccaagttagatggaagttttattggatataattgttgtacttatatgttaatataaaatgataatatgatcccaaacttaatagtatggctaaaaatttaatctcagagttcttacacaattcataaatgttcataggcatcaaaagacacctacttcttgactgaattataatctgctatgtaattctgagaatatgtattaatctacatagatttatatttgctcaattcaaattgttatttcattgatacatgctctttccacctaagtgatattcaccttatatgtctataagttgtttttatctgaaatgcaaagaattatctataaaagtttcacagaggattaaaaacatttgcattaagcacactttgttcaaagcataaatatatctagcaaagagtataaaactgtaaagcccaagtaattcaggacgttaaaatatcagggtggaaggtgggggatgagcagagagagggggatgacgaggggtgaagtttaatcttcgtattataatgtctgagtggaaattattatatagtgtcaatctccaagaatcaaaaatattattaattataactttaaagtcaattctagtgtagtttatgtaaagttctacagcagtggttttcaacattttgaagtgataccgatccctatgagaatctctttctccagaaaactcctcaaaaacaccaagtttcaaggaactcctagactccatgaaggccattcatgaatcccaggttaggaacccctggcctaggcagacaggggagaaaaaccctctttcaatcccatagctactcacctctacagagttttcatgaaatgctataaactaaagccagcagcaaagaaaatgtataaaaaagagttctaagtgggtaagggtatgtggttagagccacacaggcttctttgaaggcctgccagactcctaccttcctagtcctttataatttcttttttaaaaaaatctacaaagccttagcaacaatggagtagaggagtaccgagcagagagatgataatgatataagaatcactatctactgagtccttcaggtaccttgagaaataaatccttcccaaatttggatatgagtatacccaggaatgtgagcagtgtaacgggagtagaaaaagccacaaaataaatagtaaatacatggctgtcttcctggagggtcagtattccttgtgggcaagtaatttaaagtcttatttgcacacgtgttcatttatccaataactacttcttcaatgttataccaaaaagaaaacagatactgttcttgtcctcatggaacttccggttgagtgaaacaaacaagaatatattgaggagctgaaaggaaaatctgtgtatatattttttgggtgaaacctgagacttcactgaaaagtcttgtttgtggcagactacttcaagcaatgtcctggcaggcacccttagtattggatcactcactctaacttgaggatcacccaagtggaagagtttgagaagcatggttagcagtgtatcatttaatccccactacaagagaaaatactgttacttccaatttactagagaaaaaagagaaatttgagaaattaggaaacagctcagatcataccgctgctggcgtctgaataagtgtgtgccattccaaaatctacatatttttaaccactaaattacactacctttaggagtttcccactttatgtttccccttgaatctgggctcattcaggattacgcaggctagtttaagcttctctttggaagcagacaggtttggcttgatttgcattctaaatatttcacagtggtaagcgaaagctattattatacccattttatggtgaggaagctgaaccacttgccagctgaggtatctggctgggttaaaaacagaatctgggtcgtcagactctcattcctcttgactaactccaagcctaggcactattactgtccatgggcttttctgaacatgagattcacactgggtgataaagagtgagacaaattctgctaagagaaaacaataatagtgcaattgaaaaaaagggaaaataagtaatcataactcacaccaaaattggttactttcagcattgtgaatagaaaagggagagattattcatcacaaatgagtcagaaaattagaatgtgtcactgcactgatgacagagctgaggaatttggatgaactgaagtttgacacttatccttctagctgaagagggtaaatggtgtgacaacaggacagaaatgacctcttatttccaatcttaattaatatttccaatcttttttccttaactactctgtctaaaagttagatgggtttatatgtttgttttctatcggtagagataatgttttaacatccctttaacgttctagaagtattgcgttaattaattcttatgtgggagtcattccaaatagtaggatgatgatttttaccttattgattttcctaatacctttctggtttccagtgttttcaaaggatgaggcactattagatttttagatttatatgtctctcaaaattaagtgcctgtcaactgatattccatctttactctggatacatgatttcctttatctgacagattcaaaaaaatttgtactagatttaatgacatttcatgcatcttgaatttgggagtttttaattctctattttctatttggcaaaaggtttacaggagaaagccagatgcaagggtatttatatgtgcatacagaacctgtgccatcactctctaggtactttggggtttcctgcaggacagattcttgatgtattttcattccttttggtcaggaagaagaagactataaatgccacaaatggtcatacatatcttggggtctgctttccaaaacgcatattattttggatccgtctcaagaagaacaataagagaatgatactgagatctttttttcttaagatgctatgataacaatcctaaaaaatggcctgccttcaaaattttgatgatgaaataaggttataatcaataaagagagaagattttaaagttcagcaattaggtctgggactgcttctgcgcctgagacattgccaagatacaatgtaacactccatcccaccccatatgaatctccctgttccttcttgattcttacggggatagggtctgacagactagaatgaaatgaaagcagtagtgctgggaggggtggcaaggaccgaatttgtttaatacatttaggatggttttttattgctgctaaactagacacaattccttagcatgatgacattcaggaatcctttacaatctgattccaaagaactttctcttctatatcttaaactactgaaattgtagctctataaattccaaagggattgatgtaccaggacctttgacttatagtaaactgatcttaagggatgctgaaaaggtttggcactgctatcatgtggtctaatcatttagacttgtcactaccaactatttgcttaagagcctccaagacctttcacaatctggccccggcccacctctctacttttaataaaaaattttcccactgctgcttctttatatacggtgacagcctatttgctcttccctgaacatggcctgggacatctatgtctctgagtcagctaacggttcacacttgaatctcccaagcctagcatagtgtgtgaaacacagcacgacactccaatgtttgttgaataaatgctgtccgtctattttaggagacagagatgacagaagaaagttgttaaatcagtaaataaatagcaccagagagaggtcaaggaaaagttaattttagtgcattttaggagtgggggcaagatgagcttgaagattaggaaaactgatgctctttattcttgggtctagccaatgctatgagtcagttactttttcgggaacaagtttaaacctcaaggttaaatgaacacaaatgccctgtccatcagcatataatgaaaaagttgtggctatttccacatcagcacagtgaaattaaaatatgcagtgcctctctaagaggcatcacatatgacagagcttttaaaaatagtcccctttgccactcaggtatagaaagagctatagaaacaaaagcaaatgtttgaaaaactgagataatttagcttagggaagaaagagctgaggtgtgtctttatggttttttgactataagaaaagttgttacaaagaggataatgatcagcatttttgtcctagggcaaaatgacattaaaccgtccagtgcagaatttaagacttaaagatgaacattctaaatatgcaagtggtaaataatcaaatagattgctaagagcagttctgaaatttctttcttcctgactctcttaaaataggaaaaatcttcatctattttggataaaataaatgcagctctgcctccagtcaggagaatgaattcaataacttttctagtcttgtttaactctgtatgattctataaaattctataaaatgttcaccctaaaaattatacagaatcacaatacagttgagtaaaatacattctacagtttaaaaagaaataagcaatacagatagttgataagttattacattcaaaatagtaatatatggtgctcacgttttttattcaatttgccaagtgcatataacacaaataaaattgggaaaaatgtacttgaatctactaaggctttaacatagcgattatctagagtaaaacagtctaacaattaattctttcatgtctaagaaatttgctgaatatttcataaacctcatattgaatatgtatataaactcaatttccaattaaagaaaaagttttttgaaggtccagaaagtaatatatgaactcactattattatttcctggaccatcttcaaagacaacaggagaaccactaaacaattcctttaaatgaccaaaatgtgccccatatgattaagaatgtaaatctaataacagactcacagataaggtctaacaggggtggcaagttactggctttctttgtctatttaccttttagctttggagctcagcagaagtgtccattacatacagcacagggttagatgaacagctccaatgaccttgtctgaaccaaattcatttaaagcagtttgccacttttcttaaatagaagatgagtccattctatctatggcccagatttggactggatcactgaactattgcccaactcttataagcaaagcactaacatgtaccaatcaacaggcgaaggcatcaggaaggtaaaaatacacatacataagaaactggcagtagattaaagaagaaagctatatctaaagatggactttggcttttaaagcctttgagtgttattcgaatcttgttaacaaaaacaaaaacaaaatctgcattccaatgtaacttgtagagaagatccagtaaaaaaatgaattcaagagagagagagaaagaaatgtagttttattttgcaacccattatttccataagaacatgaatcaaagagtcagctatgccaatttcttcatagctgactagttataggatattgttctagtcttcactaatgacttcttgaggttggttattactgtgatcaggagttgggaggatagaggtctaagacctttcaaaagaaacgttttgtttagtatcactacagaaaataaagtcagcattaagctaactttgacaacctaactaggataatggttggtgcatgtagccattgcttatgctgcttcataatgaatggaacagtaaaggtgtcaagttaaccagcaacttgaattttgaaaagctgtggcacaataagctgataacataggttgttagaattagcaaaacttactttctgcttcccccaccttctagtcctacttatttccacatccacattcctatcaccaggcagttaaagaaacagaaacaaatgcggctgagactgcttctttggggatactcttagtgagctctccatctccccaaccacaacttgctctcagtttgctaaaaatatattcatttaattgttttaatgcctctacttaggggaatttgcattttcttaactgttgatacaagatctacattcagtttttttcacaggtaataagcaaagtatttggggagtgtgtgtgtgtgtggtggtggtggtggtggtggtggtggtggcaaattccgtcctagatgcttcgagttttccaagtatactgctaaaaggggtcatttgcttccccacctcaagaagccaattgtgcttatagttttacttcaaataaagatatatacctataaatgcacacatcatacgtgcacacacacatattcttcttctcaaaagtcataaacatttggtgactctctgtatactccatgaagtgctgttactactaaagtcagagtaatttaggcagaaacataagaaaccccaaatggtttgcactgaaattttattaacatatttgtcagtgttttcctcatggataatctccattggttcctggctccttgtcagcatatgctccaggagcctctcacaatatctttctgccctagaaatcctggcctgtgagatttccttgtaaatatctgaattcttgtattcacctattaatgatccagggatcgaggatgttttctatctgctccttaacctcccacttcaaggattagattgtaaacaacctagtgggaacccttcaggccaaaccacagctgaacgaatctcagcaggcagggaacccgcagcagtctgtgaaataccgtgaaacacaattacgaaaatataaagtattcacccatactttggggaagaaattatgttgtttccaagatgagacctcaaaaataaggctagtatcctaattgagaaagacatgattttaaaaagtgtcagcagaggtaaatttttaaaagtaccagatttgccaggtccttctcaaaccatagattcattttcagtatatgacagtggcctgagccgacacttcaagggaagtccattcatctctgaccaatgaagcccaaagtactcactgcatgaaagggttcctttcttgtttccaaaggcaatcaatttttgtcctagagtctgaaggttcatgggctttcttttaattttgtcagtctgcacatgcatggttcctcctgcatgatttggtctggaggaagtgacccacccacaacgccacagagctaattaaccccacactgagcttttttttttttctcatttcacacatccactcaatgctttaaatgacccagcagcagcatgatcatatgatttcttccccctcagtgaggaaagcatggtgatgggaggagcagggatatatctgccctaatcaaaacagcagtgtgatcctaaaatattatctaattgcattgcatccgagggtgcaaaatactaagaaatccctgaacgaatctctttcatgtcattcatttaacttcttgcagtgtccatttgaagtagcaaataatacataagaaacactgaggtagagaagtttgatctatactcagaatgtttaaaaaacatccgatcttacagggggtaaaagaccgagagctccttccctatcccgaatagcttcaagagaagggccttttttccatttgaaggaacagactcatgtttttccagatttattttttccaaagggaatgccttgaaaactctaagatgatcactgttttctaacttttcaaaaaagaaaaaaaaaagtgaacatgatggtggtgggtgatttaatggaatcagcttgtcaacatgatgaaactgaaaaaagcttttatagactctgtccacatgctaaaaaaaaaaaaaaaaggcaacctttaaagttatgtgtatagtatagagtggtttttgtcatggcaaagaaaagaaatataattatcttatgcagtaaatgtaaggctctgctaagaatctcattggataaatcatagaaatacatcctggccagataaatggagccagacaagttctaggtcttgtaagaagctttcaaaagaatcatcatattgtaagtctgtcatctctgtaagtgacaagaaaaattctaggctatttccctcggttctactagtaacatggcttcagagttttaaagatttagacttaaatggacaagaaaatgacttctgaatatcccatcttaggcaaactatcggatttctctcattcttacaagtaagtgtagcaaattggttcaccttggaaggacttggttagagatcatatatgtcttatgtgaacttttaacctctctttcctttgcaaagtgatttatgcatacactattaaatacacaggaattctataattcttagttcagtgaacagttagtacaagggaaaatctatctaatattttaaatttttgtttagtgtcttaaatcctacactttagaactggagaccttatagataagttctataaggtcttcagtgtgctgaaaaacacatttgctactgctccctaagcttctcttaggtaaggctgccaactggggtaaattgatggataaaactagctcaataggcaaaaaacaaaggtccagtgaagcacagtttatttttatttatactggtcagaaatatcacagttaacaaatagcctaaatcaagctcttatatctagggctccagcctttggctgaagtgtctcatctggtaattctgaaaaaaatagggttgttgtgatttcaaagactctcctgcccagtagactttttcaggctcactgatgcttaggattctaaagcctttactatggtctgttagaccaatacagtatgtcccttactatttctctgacttcatctcctaacattttcatgcaaaattggtccaacagacaataaaatagacagggataggaatatgaatggggactaaaaggaactaattaataaaaattagttgctttatgtccttgttaaatatcaactctttcatgacagcctaataaagtttctgaacttatcttgagagttggttaagataggggagaatatacaaagtatttccaacaccatgcattcattcattaattcaacaaatagttttcccgagtctattattgattactctgccaactggattctacttctgccctcaaggaccttccactctaatgtatgttttggagagtttctgtctctattatcactgacaggttattagcccactttagacaagttataaatataaccacctgccatgatgattcctcttcttgttctttatttgtttttattcatttgccctgtaacatccattaacctttcatgaatgacctgatcctttgtgagctatactatcaacacagctaatttttatataaatgagaaaccccttctccactcccaactaacttttctttctcaaacagccatgaaaatataaaagtctacccagaattatttaagtttttgaaatgagtccttacaatctgatctgaagcaccatttttttcctttcttttttgaaagagggaatggagcctcagcccctaagatacatatctcaagttacaggcaaattacacacaagttactggtctcccagacgtagtactcactactctctggggtagaacaatttctgcattgaacagaggaccataatctagctcaagtaatctcaatctcagagaacagttaaccaagtgcatatttctggtccctatattctcttataaggagttaccctctccactatattttggtattttctgaacctggctaccttaggtaaatgacagtggacatggtaaaaagaacactaactcttcctcaatttgttaaacttgtttttcctcctcatatgctttataaacaaaaatgggagaatttaatgtatgtatagagcagcaaatgttctctctgttgctttcagacatttttatcttatataaacagtggtgatgaaattataaataccattattccacctctatgttaatactcttattatcttgcatcaacagacgtgaacaaatacgtacatgacaccaatcaatcccttttctaaaaatgcagtttttgtatttctaaacagtggaggaagaattttatgaattcaacatgtagtttacctatttatattttgaattttaataaagtaaaaccaaattatcgcttatgttctttcacacttacatcagccattaacactctccatgctggcatggggtagggggtgtgtagaactaatggcaatgggtccaagtcccctgggtcaggtggttaggggcttggcaggctggagaggatgtttagatgctggggcaggatatttcaacctgcttgacaggtaagagatattttctggcagtaagaggaatattttttatggaacaaattgctagggagaggtcattttggggcactaggtgagagaaatatcaaaaccaaacctaaaagcagtctaagggaactcgggaaaagaaaatcactactttttcaatctcctcactggtttcccttattccatagtgtgccttctccttccatcttctagcacttcatactcttttctcctccatttcttcaggttttctttctcctacctctttattataacaaaaaaaagcatttaggaagaattctaggagacagggagacaaaaaaaaaaaagaatttagagaagacataataacatactgcataaatatgtatgtatgtatgtatgtgtttatgtatgtgtatatgtatgtatatataacagatattcgatttaccaagaaggataaactgggacttttgagatttaaaaaattcatggtatgtctggtcatattaatctccaaaccagcttgtttttagcattgctagagctataacagaatcaggagtagaaaacaaaaggaaaaaaataaaatttaacaaaggatttatatttgcaaaggaaagaggacttatttagagttgtttattgaaattcccccaaagctattttttgaacttatatattgacaacatcaagagaaggagcttaggaattctcatagggtttaggaactactaaaccttgtatattatgttcatctcagtccactcaagcaagtaaaggataactagaggatggtatctcacagtgcataacatggttggttactttgctaggctgacatatggagacagggcccataggagcagagcttttcttacgaataccagagagagacacccaggttcatctaaatgtatagggcatgagggattagtggtacagtgttatctgcaaagtacctaaaagtgttttctaaacaagcactaacttcttagcccagtcttcttggggattaaacaaaatccaatagtaagtaatggggaatactttatttggtcactgggttggggagggttgctgagacatatgacaacattcaatccattaagataggaggaaatgaggagaaagagaaaacaaagaaagggagagcgagggccagaaaagaagagtgtcacctctgtagactctctaacagaataaatcgataatcttaagaaaagtaaaagagcatgcctagagggaaacctcagcacacttttggaatccaaggcaaaaaataaaacaatttgcttcttgtcaagtttattgccattgacccatgggaggttcctatttattctgctcttacatgcacaggtatttcttctactcttacattcttttcctaaggattagcattctgtgataatggtggtaatgacagctgccttaaattagtggcaagttaggaatgaaacactgaccaccaggctatgttcttgaatccagtctatgccctgtaatgtgttcattctactttctgcattttctctgagacctgtcgcataagacttgttttgtaaggccgggctccttacggggacacatatggctccagaaaacaagtactctactttctcaccctgactttttggttttcttgttttttcctcttttctcccagactattattttccagtttcttctctaccagtctggacgcccatggttgttaactttagagatacccaccagctccatcaattccctcatctacagttctcaactgtatttacctagttctggagctcagatgaacccacatgtatgttctcctcagcttccaggctgctgatccttgctggagaaaaagcacaaaactgtacagcttgatgctcctgcagaattacggtttccagcataagttcgaatttcagaattagtttgcaattttaaaatttgctcctagtcagtttcctttttcactccacagtttcattcattactctatttaactggttataacccatcccctacccttcactctcagctagtaaccttgcctccttttgcatagagaaaacagaggccatcaaatggcacttcctatcactccacctttgccaccaatgaatccgcctgtaacatttcagagatctttctgcctagcactgataacctcatccaggatcttattatatcagttacttttcctttcttttgtattttcaattttcctactgcctgccaacatgctttagctgtcttcatttaaggtaacaacaataacaatgataataaactaacaaacaacaaaccatcttttgcagactttatctttccctcttttgtgccaccttcaagcttcctaagctcccgtttattcctcaaaccattacaatctggtttctctagctgtgtttctaattaaacaatttttttttttttttttgccaaagtcaccaaacacttctgaattgttagcttccaaaatccattcttcaacctcattgttttctttcttttaaaggtcaggttcactgaggtataatttacatacaataaaattcatccttgctatactcatttaccattcaataagttttgccttatatgttggaggcctgtaaaatgaagcccaacccccaagccgctttgcttcatatacaaatccctttggcacctctcagcagtcttccccacataacccattgtctggtgacaccacactactcagcattcaaggatatatgccatgtacattcatgccccttgtactttctttatgtttcctctctataaacatatatgtcttggtataacacagtaaatgctatttaatattaccacatcaatttccatatagaatcataaatctatacgttattttgagaagctgaggttttccaaatagaagtcatccatcaaaatgctactacctgaagatctctattattttagtattatgggttgattatgttcccttaaaattcatatgttgacattctggcccccaattctttagaatatgaatagatgtgtgaatagggtcattgaagatgtgattaagatgaggtcatgctgtagagtgggcctgcaatccaatatgactagtgtacttataaaaaagagaaacttaaacacagacatgcacacagggagaacatcatgtgacgatgacggcagagattggggctgatgcttctataagccaaggaacaccaaagattgccaggaaaccaccagaagctgggtgggagtcacggaactcacagccttagaaggagccgaccctgttgatactttaatcttgaacatctagcttctataactgtgagacaaaaaatttctgttgtttaagccactcagtttgtggtagttcgttacaaagccccagaaaactgatatactcagtaaaagaaaaaatcttcagtatattggaatcagttctttcactcatcaggtacttactgagtgcctactatgtgctaggaactgctctaggatattgaatgaatgactaagaacttcatcacgttactgcattttttgttcactaataagtaatcaatctatcaatcaatatattaatagatgaaatgcctatcatttattttatcagcaaacatttgttgagtatctcctatgtgtcagacatcgttctaggcacagaggataacattattggcagatcaagttctccaccttgtatagtttaaattccagtagagggaacatatattaaacaagaaaataagtaaataagatatgtaattttactctgtttctgacactgagagtcataggcatttatcctctaaatcactgaacaaagcttggaactagatagcgaacatgttacttcacagtttacaaagtaataaggaagacaatgaggtctcatactagaggcacgttaaaccacaggcagtgtgcaggcttaaagtgtttgggaaggacatcccaaaagctaggtttcttagtcagttcgtcagtcaatcaacacatatttcttttttttttttttgaccaaatttctctctgttgcccaggctgaagtgctgtgacacgatctcggctcactgcaccctctgcctcccgggttcaagcaattctctgcctcagcctccctagtagctgggattacaggcacctgctaccatgcccggctaatttttgtatttttagtagagatgggatttcaccatcttggccaggttggtcttgaattcctgacctcatgatccacccgcctcggcctcccaaagtgctaggattacaggtgtgagccactgcacccagccatttgacatgtattttttaagcgcttactgtataccaggccctatgctgaagatagtagaactgtggacagagccaacatggtactattacccactgagctcacattctaaggggaaaaatttgaacaacaaatctcacagtccgttctttatcatatatcctcataagaatacataaagggggttaggagatcacctgggtcagaggactggcccatgaggggtttccaaggggccttccttgaagatgtggtgcccggacactgctttagggctggggtatgggtattggtttgagcagggtcatgaagttttcggtttcttcttcctcatcccctttcaaccatgtacacacatttcaaatacttaaaagcattcttcaaatatactaagaacaccaagaactaaacacaagagaaggactctccagaggaaaggggccaaaaatagaagagaaaaaaaacccctaatctcaccatttgttttgaaaacacccaaaatgattaaaacatattataaactaaaacatatgaactaatcacttgccaagtttcatttttaaatcaaagccgttttgaggttcataaactgaaaaaagaatcttcaaatatgaacttgtgtttttcttttcttggccctcagttggcttgaagcatttgctgttatgctgtgtggagggaaggggaacctgctagttaggaacatgtggcatgcatgtactagaaggtaagctccacaagatcatgactcttcacagtggtatccctggtaagtagaagagtgcctgaaagataacaggggctcaataaatacctgctgaatgatcaactagtgaatattctgggccctttaagggattctccaactctcttttcttacccaagctgcatcttgctttaggccagtggttctcaacctggggctaatttttgcccccagtcaggggatatctgtattttttgttgtcacagttagagaagttcctactggcatttagagggtagatgccagggacgctgctaaacatcttacagtgcacaggacagccctgttccacagagatttatctggccccaaaggttaatagggccaaagttatgaaactctgatttatgccctttgtttctattgggctgtacctgggagtcagatcctctgcatatttggaatgaagttcagtcctaaaggaagcaccccagaaaagcctcattgcttcatcctcattcccttcaagacctaatagaactgcccccactctaaggcaggctcagagagagccaattttgccttttgtcctccctgggtcaacaatgcaattgctagggaaatcatctgaaaaagtctgtctctacaatgcaagtaaataatttttacagtacattggtaatttccctgagcttacctaagcatatatactaatttagtaaaattctcttgtttacaaactagtcatgtatctgcaggaaaaaaaaatctcctcaagttcaaccagtttatccatgtctgctcaggatcagtacatgactctagctttattcatgataaataagatcaacttcaagaattccatcaaaccccagtaatgtgcctttagagagactgggcttatagcatttcctctgccaccctccttgccctgcatattaaaatacaggtatctgattccagtttcaatggggaaacttctgtcgtgccagaggagggcatgcgctgatttccccactctgatggttgctctagtaatcttggtgttgtggcatgtttcccagttaccatagagactgcatacactaagactgcagcattgtgattggtgggaaagatacattttgcagaagcttttctggagagataaaggtaagacacgagaaagaaagtgagactgccaataaaggggcagagcacagagaagtcccaaacaaccatacattctagaaaactgggacagcagagattacaactactgctataaaactacataaactgttcactcaatggctgcctgtcaggaaaatttcaagtattgtcagacagaacagacacaagatattctagaataaaaaggtaaacaagtaaacctactgaggttataggggtgacaaaagggaaatggcaagaaaacatttaaaaatgattcaatgctagaaaaaaaaaagaatctcagagagcaataaaatttaaagttacatttaactttaaatgtaggctgacctttggggaattatttaaattctgagtacctctgcttccttccctatgaaaaagaaaaagaaaaaaagaataaagatggaaatagaaagaataaagatgacttctctctcactgtttaacaggagtctctttaaatatctcaataatttgacattatatcagttgaatatgatgtaccccccacacaaaaatcagacaaaaacacttaaagggggtgataaatagggggacgtcattaacaatgcaaattgactcattccatagtttcttagagtaatgagtcaactgactacgtgatctcatgtacataattttgttcggcatgagattttgaggtatacaattactacagaaatcaaggtatacctgcaatgtaaagggtaaatcgtaggcattttaaatgaaagctggggataggatgtgtgttggtttgagggatgagtgggagtggatttaagagaaaatcagtctaggaaaatatcacataagtgtttgtaagttccttgatattcaggtctgtatcttgtaatgctttattaaacatatttcagactaatatgtccattgcctactggacattcatatctccctgtttttaaatacctttcaaatctgtatcttgagccattacttatctcttgacctctaaccctttatatcaaatgaattactagacaattacaattagatattccaaaagcatcctaaattcaacatgtcaaagctgaactcatcttttccttcaaactttctcttcctcctatgttccctatgtgagtaaatattaatagtattaccattcacccatctgccaaagttccatacctaggaagaatcatggttgcttttatctcaccttcaaataatcacccgtgcatatagatgtgcaatcctaataaccaaaggaggccttttttgaatagaaagcaatatttacagttaattgggttttgaactaatattaatttattaaacttacaaattttaaaagcctagttttctttacacctttacctgttaaaaacacacatatatttttctatgtcttaatatagcaatttttgcataaaataagaaaaattactttcaggaagggtgagattactagacaaaaaaatttgggacctcaaactatttcaactgtcagtcagaatgttaaaagaatgagagttagggtctgatctgggaacacctttcaaatgattttgccaaggtcaccagtagacacactgaatgtttttatagtcactctgaaaatgagaaattttacgtctataccctacaaaggaaaatttacaatccaggtcctctatgtttaagtttcattcttatctaactcttttataatcactttccactttatagcctgataaaggtagacaatattttgtgtctccactaaccaggtttcttgaatctagtgccctttcacttcataacgtttttcacatttctacctctctcatccccattgcaccacattagctcagagcatcattatctgtcacttgtaatattgcgacagtacattgtactatattttcttaagtttctgagtctttgcacatgtcaccacctgtgtctagaacacccatattccctgataaacatttactgaatgaaaaaaaagttaataaatgctttggatgttgctgctttgggtgctgaacagaaatagtggcctatctaagattctggataagcctgcataaagcactcttactttcaaaattaattttgaagaataagaaaattttgccatggagaatcatggagcctatgccacaatattatgttttgcatttaataaaacacctccaaacccagggaaagaatcagttattacttccttcaattcatacaacgaatatttactgaacactctctatgtgccaggctctgtactaggcactgaggatttcttagagcatagaacaggcaaaaaacaaacaaacaaaaccgaaaaaaacctcacaatcatggggcttatattccatggcaagaggaaataaatgtgtaaataaaatatatattttgtctgaaggcagtaggtgctatgaaccaaaaggggtggaaagctaaatgttaaatacagtggttatgaaaggccttacttagaagtgaaaattgagcaaagacctgaagatgataagcaaacaagccttatctggggaaaacatttaaggcggtcagaaaagcaagtgcaaatgtgaaatcatgcatggtaggctggaggttaggaagggggtcaatgaaggttgaggggagtgagctagggtggagcgctaaatgaagacagagaggtaatggggaaattgaatatggagggtcttgtgaactactgcaaaggcttttcttccaagtgagatgttgagccattagagagttctgagcagagaagtgatgtggtctgactgaaattacattacatatattgcaaagcatcactctggctatcattttgagaatagactgtaagtggtaaggccagaagcagggaagacaattaggaggctactgcaataatccgggtaagaaatgatagttgcttggattagggtagtagtggtgatgaggatgaggagtggtaagattctggacttattctgaaggtagagctgcaggatttgttcaatggttgggtttgtgagagaaatacaggtctgggagagaaataaatttttgatttgagtaaccctaaaggtggagcgttatttaccaatattggggaggctatgtatttgcttggtaaaataaggaattccatttctggtatgtcaagtttgagatgctcattagacagacgtggagatgttgaataggcagctgaatatgtgagcctagaattctgtgtaaaggcctggactagagatacaagcttgcaccataagcttgggtgcaaatattaagagagtgaatggagctgaagagaagagcttcaaagattgagctctagggccctctaatgtttacctgcttgggaaatgagaatatgctagcaaaagagactgaggaggagtagactgtgaggcaggaaaaaaatcaggagagtgtggtggactgaacgccaagcgaagaaagtgttttaatggagaatgaataatgggccatgtaaaacaattctgagacatcaggaaagacaaagactgccgaatggttaatggatttagcaacatggaagtcattggtgaccttagcatcaacagttttactagactggtaggtgcaaaagctaactagaggggcaaaagagaaccagagcataggattggagagtgtttatagtgactatacgcatttcttgagaagttttgctgtaatggaaatcaaagaaatgggacaggagctgctagggagtatggtttataagggtatttttaggatgagataaattatgtgtttgtatactgataggaaagttttgatagaaagagaaaatttgataaaacagaagaaagatgtgagctttttcaggagcactgtttatgcatgtgcaagaggagagagattctaaggcacaatgagggatgggctgagccaagggtacacagagtttatccatagttgcaggagagaaggcaaaatacatgggtacagataaatatgggagggtaggtgtgctggacagcaagtatttgtgaagttgtcttttgatggtttctattttttcagtgaagtaaaaagaaaggttctaagttgagcgtaaggatgggggaggaggtgttagaaatttgagagagggaaaaatatgaaatattcttgtacagatatggaagagtaaatgacaaggaaacatattatatttgctgggcagcattaacggcctccttgagggatcatgaatttaaactgagagtcatacatttgcttgtgtgtttttctccagccacattcagctggcacacaggcatgaaatagatggcgagttgcatatgatcagtatagttgagatttgtcaagagagcacagttaagtcagagaaggtcaatggtgttaaaggcgcatacaaggaaatgattaaaatcattgtccatggaatctacgctatataatgaagtgagcatatgagaagctatgggtaaaatcaatgaattaggggtcctagtgggtttaaggaattggtgtattaggggtaacaaagggattgaactaccaagacattaggctgtggttggaaaatggaatgcttgaaattgagattgtggaatattgtaattattagtaattaaaacatcagaaatgtagccatgggaatgagtagctatggcagagtggagaatcaatcatgagaagttcaagaaattgagaggaggtattagagggagcgtgtatttacacagtgaataaccaataattgtaatggggtagaaatggaaagagtgttagtgagctaggggctaacgttttcaaggaattgggaaacttgcctggtagacaactgcatcaagggggagttatgggaacacttagcttttctactacctcctcaatgtttcctctctctcactttccatctttccagcttatatactggcattacaaactttaatttcctagactagatagctacatatcacctgtgtctaccctttctcctccctatccaaattatctccaagtcttgagaatttccaatttttttttctgagatggagtctcactctgttgcccaggctggagtgcacagtcatgccatctcagctcactacaacttccgcctctcaggttcaagcgattcccctgccgcggtctcttgagtagctgagattacaggcacgcaccaccacacccggctaatttttgtattttagtagagacgaggtttcactatgttggccaggctggtctcgaactcctgacctcaaacaatccacctgccttggcctcccaaaatgttgggattacaggcatgagccactgtgcctggcctccaattttgaatactctctactctccccctttgggaccatcactactctagcctgtcactctctattttatcactcagattaatgttcttcatggcactaatcgctctctaaacttaacttgttcatttatttgtttgctttttttgttggggggggtgtctattttccttcattaaatataaatttcataaggggaaaagttttgtttaatttgtgcctggaacataatatgccctcaataaatactttcaggatgaattaataaatgccccctataacatgctgatgaatccttatattcttgggttcacacaacagctttgctttactatcctaccagcttctccctcctttcctgctcaaaccatccatttcaccgagtaaagtcatttcactactcccccaaaacaccatgttcatttctattcagatgatttcatcatatttctcccttgtttatgtctattccccacataccaattctttgagtcccagcttaggtcttacttctcggatggtttttctatgattaccatgaggcctgctgatttctccctcctctaaaatcctgctatccctaacaacaccagctgctttatattttctaattgtttcatatgggttattcttaccttttcactttaaaataggtttatttttggcctaaggatcctgacttacaactacagtatactcagtaaaaactaacacagtgtagggcagataacgggtattcaaaaaatactatggcctccttagatagcttcatagacttccatcttcctcaacaaacattttctaccttttaccctgctgttagctaaatctaactattcttcctgctctatgatactgtctttgagaccagaaccaacccctatgtccactacacagaattctacactcttgcactgcaattcccacagctaaatcattgtcattgccattattgttcctggattctcttggcaattttagtatattcaaggcatagctgccaagatcatcatcctccttgattgtttggaatctttatttttttaaatccctgcattttttccatcaaactttaagtgttcctgtgggatttgtttttccttggctccatccttggcctggttcttctccactttcttatgttcagtcactcgatttgccctttgtctcatttgaaggaatcagctttcacaccttcttttaaactaccttgcatatttagaatattttctcaaataatataaaatttataatatttatgaataaatgacacaatgccaagatattctgtctcttctttcaaataacatctgaagatgcacctgcactagtgagttctatatttaagatattgaataagtatcattcacccatctgctttcattctgtcctgcattttttaggacctgcttcagagttgtattttgaggtcttttggacggggaactgtctggcatagttcacaaactggcctttgctctgtatattcatgttcctttgataaataataaataataataatagcccactgtgcatttttacattccactcataaatccctggaaaaagaaaaactaacaaccagggattataatagaaacacagaaacaaaactaaccttttaccaggttttgctacagtaatatatacttccatagacctatattctaacaaataattacctgcttaagtcatttgtaaattgttcctttgccaacattatgtataatagcaaatgtctacgtggtttataggacagggaaaacaactagaacattacagctatgtgggggatcagtgcaaaagcagcaaaataagaggtttactctgttgggtgcacagtttggaagaattagtctcacaagtagaactacttgacagaatatatgcctgctctccagctcccccttctcccctcctccagatcttttttcaataatggaagaagacttactttcttttttcaaatccaggtgggaagtgtatcattttgcgtgaaaaatctgtttttctttgaacataacaaatggtctgattgaagctgctctatgaaaacggcagcatatctaaccagggaggtgggaactatagtttaatgggtggagcacctccatatttagctgcagatgagccacatttaactttaaaaaaaataaaaatttaaaaaataaaagaaggccaaaatgtaatgattgtcttgttactgcagtggccactagatggcaggtccaaaaatctgatgggagtctcacaggagggcaaatcttagggagcagaatgtttctggcactcaatccagtgttggttcatcaataagccttggcagtttgctaaaatatcaggtgggtaagacaatatccatgttatttcacagggctgaagggggcaggaagccctttggtatctaggtttgtagagtattgtcatcacatactcacacatccagatactgctacccctttggacttctgtccacagacattcttggagctggtttttatatatgttcagctgtattccattatctaatggtctgtgcaatactgagccataatctcaggagtgtaaaaggtagttgtctaatctgcctccatggaaacaaatgaaggaggctgtcaggctagggtaagggaacatacagctgtactgtatttaacaacatatatttaccagtaattgcaacttcatgttaaatatgtgtatttcctatactggaggctgaccatatattcatgttaattgttttgaaaaagagaatgttgatatataagagacttattatttaataggataaaataactaaggcctatgattaaaaatgaaatgagtaaatttagaacaaattatttgttgtacacagtagagttttcattttcttttactaggatgggagacttctagatgtgggtcttatgagactataaaaaagtcattcttggaccaattattctgaagatagattgtgtctttcccttcataatttttttttttttttggttactagattatcctgataaaagtgatttcactacatggacaatgcctacttttctttatcttttaattaaagaactgaccttatgatttttaaaagtagagaatcacaagctctgagataatttatcattctcactaaagaaaatgtgctctagagtcaaatttatctttgtacaagagctgtgacatgcattttgatatacatttaagcatctatgtcaattaaaatattataaaaataaaagcaacaaaaactcaattatagccatgcaactcagtcatcactcaccttttgttccctttttctttgaaaatttagatagaataatggtaaacatgttgatttcatctattcttgctctgtatatttggactgtgaaatgtctacatgagacacaggaagagggcacgggtcttcaggataaaaaacaaaaaaaaatttttcctaaagaagaaatatgggctatattgaattatgatagatgttttaaatcagtaccgttttcctttagtttggagtaaaatttaaaatgagatgactgaaataatttacgataaaatatcatggttatttctacatatttaaggtttaaaaatgctcaaacttatactttcctcatagaaagagcactggaatgggaaactgagaggtctgggttctattctggctttgacagtgactcactgtgtgacatccagagagcatgacctccccaggctcctcacttctgaaatgggagggttttgaggacaaagtctctctctgctttaacattcaatatccaagtaagtaaattgctacgtattgcagatttttttttcctcagaaatagactaatttcctccgatgaaagaataatactgttaagaagctgatgttgaaagctaacatgtccctaccaacactgtgggctctacccatgcaggtgaagctagagcttgttcttccttcaatcccccctttccctattctgcaccactcttccacacactcccccatcatctttaagtctaaattctacctgagaggtcctctgtgacccctaggtagttacttgctaattattactaattattcaataactgttttacttttcctcttgagcacatagctaagttccatttcccagccttctctgcagatagctatggccctgtgaccaaattctggtgagtgggatgttggtggaagtgacatacgctgtcccaggcctggtccattaaaagttcctgtgtaatcattgctctctcttcaccagatttctggctggatgtcacacccacagcaatcttggaagctatgtactgaagagcctctgtcaacctgggtccctgaccagtctttacatgagcaagagagaaactcatgttgaaatactgagatttgggagtgtgcgtattatagaagctaatgttaccttaactaagaacactcctaaagcagaaatttgttctctctccgagacattatgtctcttttaccacattttccacctttaataatttatttactgatatgtaagctccttgaggatagtacatttgtttcactagtgtacccacagaactctagttagttgaatgaattcagaatagaacatagctggtttggaaagtacagaagttacagaaggtagtaaaagcagtttgatttttaaaaattctagctttgtgttttatcctataatatttaggtagaaggtagggatgatgggttggggttttgttggtgtggaaatgtattgtgacaaccacagccttttaatatattttgtgtactgcatccccaataaacatgttttccaaataaagtgtaaagtctttttctaaatgctgtatggcttgccttttttatatatttgtgtaaagaaattcgtagtagtaattctctgacactgagttaaaggaagtcctattttttttcacaattatgtgaaaacacaattatgtgctgtataatgacattttagtctacaatggaccacatatctgactgtggtcctgcaagattataagataactgaaaaattcctaatgcctagtgatgtcatagtgatcataacatcacagcacaattactttttaaaacataaatttagtgtagcctaaatgtacagtgcttataaagtctacaggagtatacagtaatgtcctaggtgttcacattcactcatcactcactcattcactcacccagagtaacttctagttctgcaagatccattcattgtaagtgccctataaaggcatacacttttgatcttttatgctgtgtttgtactgtaccttttcaatgtttagatatgtttagatacatgaaaacttaccattctgttataattacttacagtatccagtacagtaacatgctgtgcaggtttgaagcctaaaagcaataggctatatcatatagcctaggtgtgtagtaagctctatcatctaggtttgtgtaagtacactctatattgttcacacaacgatgaaattgcctaatgatgcatttctcagaatgtattccctttgttgagcaatgtgtgactacattttgaaaagttaaaataatactaaagggagggacaagtgaagagctaacttgagaaatctaagaactaggtaatttaaaagaagtgcttttagttacatagggtttttaacatcattaccacctatgaaattacaggtattaactactgtctcaaaatgatcatcgcccttttgatactttactctcagtgtcatggctgacctcttttgagtcaagtttattggacattttcagttttattttttaattctcatcactgcccctccctgaaatacttcatccctggtttccttaataatactggcctaatttccctattctctatctctagttttctctcctcttttgtttggctcctctttctcatctattctttaagtattagaatttcctagtgttctgctctgagtttttctttctctcataatttttccttgagtcatcttatctagtcttatggctttacctactacttcctcacaaataactcccgactcttgatctttagcccagacctttcttcggagcttcaaaacctgtattgcctatagtatcctgggcattttaagaaaatctaaatattttgtgccaccttaaattcaagtcccaaaccaaaagcactccttgccctttcaagtcaaaccttcttcctcctgtgttccagctcttggtagatgacatcaatttagaaacattaaactctccttttctttctttcttgtcccttatctaaattatctaattaagttctaaatcctgtagtgcttttatagtccatttgagattttagcctaagtttgaggactagataagtgaagacagattaaaaataagacttcttttaactcagtgtcagagaattactactatgaatttctttacacaaatatacaaaaaaggcaagacatacagcatttagaaaaagactttcatacccttccatcataccagagttccattatcagcctgaagagaaccaggagagctgtcctgagagggagctttctcacaatcaggactggattgaaacaaaatagaatcaatggaaagaaagatttttggggaggggagagaagttttgcttgctgctggtcctttggtaacctctgcaaaagaaaagtttaaaaaatgaccctggctggcaagatggccgaataggaacagctcccgtctgcagctcccagcaagatcaatccagaaggcaggtgatttctgcatttccaacagaggtacctggctcatctcattgggactggttagacagtgggtgcagcccacagagggcaagccaaagcagggtggggcatcgcttcacccaggaagcacacagggttggggaattccctccgttagccgagaaagccgcgagggactgtgccatgaggttcggtgtattccagcccagatactatgcttttctcaccgtcttcacaacctgcagaccaggagattcccttgggtgcctacaccacgagggccctgggtttcaagacaaaactgggcggccgtttgggcagacactgagctagctgcaggaattatttttcataccccagtggcacctgcaatgccagtgagacagaaccactcactaccctggaatgggggctgaagccagggagccaagtggtctagctcagtggatcccacccccatggagccaagcaagctaagatccactggcttgaaatccttgctgccagcacggcagtctgaagttgacctgggaccctcaagcttggtggggggaggggtgtccaccattactgaggcttaagtaggtggttttcccctcacagtgaaaacaaagccaccaggaagttcaaactgggtggagcccaccacagttcggcaaagccactgtagaaagactgcctctctagatttctcctctctgagcagggcatctctgaaagaaagttagcagccccagtcaggtgcttatagataaaactcccatctccctgggacagagcacctgggggaaggggcagctgtgggcgcagtttcagcagacttaaacgttcccacctgccagctctgaagagagcagcagatctcccatcacagagctcgagctctcctaagggacagattgcctcctcaagtgggtccctgacccccatgcctcctcactgggagacacctcccagcaggggtcaatagacagctcatacaggagagctctgggtggcatctggtgggtgcccctctgggatgaagcttccagaggaaggaaccggtagcattgtttgctgttctgtagcctctgctggtggtacccaggcaaacagggtctggagtggatgtccagcaaactccagcagacctgcagcagagatgccagactgttagaaggaaaactaacaaacagaaaggaatagcatcaacattaacaaaaaagatgtccacacaaaaaccccatccgaagatcaccagcgtcaaagaccaaaggtagataaatccacaaagatgaggaaaaaccagcttaaaaaggctgaaattccaaaaacccgaatgtcgtttctcctccaaaaaatcacaactcctcaccagcaagggaacaaaactggatggagaatgagtttgaggaattgacagaagtaggcttcagaaggtgggtaataacgaactcctctgagctaaaggagcatgttctaacccaatgcaagggagctaagaagcttgaaaaaaggttagaagaattgctaactagaataaccagtttagagaagaacataaattacctgctggaactgaaaaacatagcacgagaagttcatgaagcatacgcaagtaccaatagctgaatcaatcaagcagaagaaaggatatcagagatgaagatcaacttaatgaaataaagcatgaagacaaggttagagaaaaaagaatgaaaaggaatgaacaaacctccaagaaatatgggactatgtgaaaagaccaaacctacgtttcattggtgtacctgaaagtgatagggagaatggaaccaagttggaaaattcttcaggatattatccaggagagcttccccagcctagcaagacaggccaacattcaaattcaggaaatacagagaacaccacaaagatgttcctcaagaagagcaaccccaagacacataatcgtcagattcaccaagattgaaatgaaggaaaaaatgttaagggcagccagagagaaaggtcaggttacccacaaagggaagtccatcagactaacaacagatctctctgcagaaaccctacaggccagaagagagtgggggccaatattcaacattcttaaagaaaagaattttcaacccagaatttcatatccagccaaactaagcttcaaaagcaaaggagaattaaaatccttgatggacaagaaaatgctgagagattttgtcaccactaggcctgccttacaacagctcctgaagaaagcactaaatatggaaaggaaaaaccggtaccagccactgcaaaaacacaccaaactgtaaagaccatcgacactatgaagaaactgcatcaactaatgggcaacattaccagctagcatcataatgacaggatcagattcacacataacagtgttaatcttaaatgtaaatgggctaaatgccccaattaaaagacacagactggaaaattggatagagtcaagacccatcagtgtgctgcatttaggagacccatctcacgtacaaagacacacataggctcaaaataaaggaatggaggaatatttaccaagcaaatggaaagcaaaaaaaaatgcaggggttgcaatcctagtctctgataaaacagattttaaaccaataaagatcaaaaaagacaatgaagggcattacgtaatggtaaagggatcaatgcaacaagaagagctaactgtcctaaatatacatgcacctaatacaggagcacccagattcataaagcgagttcttagagacctacaaagagactttgactcccacacaataatagtgggagactctaacagcccactgtcaatattagacagatcaatgagacagaaaattaacaaggatattcaggacttgaactcagccctgggaacaagtggaccaaatagacatctacagaactctccaccccaaattaacagaatatactttcttctcagcaccatatcacacttactctaaaactgaccgcataattggaagcaaatcactcctcagcaaatgtaaaagaatggaaatcataacaaacagtctctcagaccacagtgcaatcaaattagaactcaagattaagaaactcactcaaaaccacacaaccacatggaaactgaacaacctgctcctgaatgactactgggtaaacaacaaaattaaggcagaaataaataagttctttgaaaccaatgagaacaaagacataatgtaccagaatctctgggacacagctaaactaatatttagagggaaatttatagcactaaatgcccacaggagaaaacaggaaagatctaaaattgacactctaacatcacaattaaaagagctagagaagcaagagcacacaaattcaaaagctagcagaagagaagaaataactaagatcagagcagaactgaaggagatagagacatgaaaaacccttcaaaaaattgatgaatctaggagctgattttttgaaaagattaacaaagcagatagaccgctagccagactaatcaagaagaaaagagagaagaatcaaatagacacaataaaaaatgataaaggggatatcaccactgatcccacagaaatacaaactaccatcagagaatactataaacacctctatgcaaataaactagaaaatctagaagaaatggataaattcctggtcacataaaccctcccaagactaaaccaggaagaagtcaaatccctgaatagaccaataacaagttctgaaattgaggcagtagttaatagcctaccaaccaaaaaaagcccaggaccagacgaattcacagctgaattctatcagagatacaaagaggagctggtaccattccttctgaaactattccagatcatagaaaaagagggactcctccctaactctttttatgaggccagaatcatcctgataccaaaacctggcagagtcacaacaaaaaaaggagaatttaaggccaatatccctgatgaacattgatgtgaaaatcctcgataaaatactggcaaaccgaatccagcagcacagcaaaaagcttatccaccacgatcaagttggcttcatccctgggactcaatgatggttcaacatacacaaatcaataaatgtaatccattatataagcagtttagagccaatgacaaaagccacatgattatctcaatagatgcagaaaaggcctttgataaaattcaacaccgctttatgctaaaatctctcaataaactaggtattgatggaacgtatctcaaaataataagggctatttatgacaaatccacagccaataccatactgaatgggcaaatgctggacgcattccctctgaaaactagcacaagacaaggatgccttctctcaccactcctatttaacacagtattggaagttttggccagggcaatcagacaagagaaataaataaagggtattcaaataggaagagaggaagtcaaattgtctgtttgcagatgacatgattgtgtattcagaaaactccatcatctcagctcaaaatctccttaagctgataagcaacttcagcaaagtctcaggatacaaaatccatgtgcaaaaatcacaagtattcctatacaccaataacagagagccaaatcatgagtgaacttccattcataattgccataaagagaataaaatacctaggaatacaacttacaggggatgtgaaggacctcttcaaagagaactacaaaccactgctcaaggaaataagagaggacacaaacaaatggaaaaacattccatgctcatggataggaagaatcaatatcgtgaaaatggccatactgcccaaagtaatttatagattcaatgctatccccatcaagctaccattgattttcttcacagaattagaaaaaaacaattttaaatttcatatggaatcaaaaaagaacccatatagccaagacaatcctaagcctaaagaacaaagctggaggcatcacgctacctgacttcaaactatgctagaaggctactgttaccaaaacggcatggtactggtaccaaaacagatatatagaccaatggaacagaaagaggcctccaaaataacaccacacatctacaaccatctgatctttgacaaacctgacaaaaacaagaaaaggggaaaagattccctatttaataaatggtgttgggaaaactggctagccctatgcagaaaaccgaaactggaccccttccttacaccttatacaaaaattaactcaagatggattaaagacctaaatgtaagacctcaaaccataaaaaccctagaagaaaacgtaggcgataccattcaggacatagtcatgggcaaagacttcatgactaaaacaccaaaagcaatggcaaaaaacccaaaactgacaaatgggatctaattaaactaaagagcttctgcacagcaaaagaaactatcatcagagtgaacaggcaacctacagaatgggagaacatttttgcaatctattcatctaacaaagggctaatatccagaatcaacaaggaatttaaacaaatttacaagaaaaaaacaaaccccatcaaaaagtgggtgaaggataagagcagacacttctcaaaagaagacatttatgtggtcaacgaacatatgaaaaaaagctcatgatcactggtcattagagaaatgcaaatcaaaatcacaatgagataccatctcacgccagttagaatggcgatcattaaaaagttaggaaacaacagatgctggagaggatgtggagaaataggaacgcttttacactgttggtgggagtgtaaattagttcaaccattctggaagacagcgtggcaattcatcaaggatctagaaccaaaaataccatttgacccagcgatcccattactgagtacatacccaaagtattagaaatcattctactataaagacacatgcacatgtatgtttattgcagcactattcacagtggtaaagacttggaaccaagccaaatgcccatcaatgatagactggataaagaaaatgtggcatatacacaacatggaatactatgcagccattaaaaaaggatgagttcatttcctttgcaggacatgaaactggaaaccatcgttctcagtaaactaacacagaaacaggaaaccaaacactgcatgttctcactcataagtgagagttgaacaataagaacacatggacatagggaggggaatgtcacacactggggcctgttggtggctggggggctaggggagggatagcattaggagaaatacctaatgtagatgacaggttgatacgtgcagcaaaccaccatggcatgtgtatacctatgtaacaaacctgcatgttctgcacatatatcccagaacttaaaagtataataataataaaaaaaagatctaatggctaaacctatagaaactctagctagacctgtggtttctattccttcctgggtataataataaaggctcacatttattttaagtgttacatttttcattgacattgaaatgagactcccttttcgactaatcggctgctttgatttcttcaccctaaaaatcactcttcaatgttttccacaattcttcaacattagtaataacttcctatatagtatctgtggtcctttttctttccccagtgtgatatatttatcatctattacacaaacttcctcttttgcttcctcccttttcaccaccagctctaacatcttaaattttcatttgacatactgcttacctaaattatttcatgtgtgttcccatccatggaaattcatttttgtgtgacataaatccctaccctactctatttcacagtaataaaactttatactgaattgccaaagagataggtaaccaaccacgcagtttaaattaagtgcaagatacacatgtttgaatattctgctctctgtctaagatgtgtagagacaggtcctgtttgtgtctgagcattctgtcatcttattcaaactgttggagttaaatcacctaagaactgttttctcactttgattcaaaagtaacttctgctatgcaaaaaaagcacagttatgaaataatatgtgtattaaaaaatctcaaaaataatgattagagtcacattcagtctgtgaaaggagtagctccatgacttgagcacatgccaatgagattagaactcatcgggggttggcattctcattgattgttgtccctctgtaccttcaatggtttccagtccttgtccaagttaacctttgctagttgttgtagccatggtaaatatcctgtttattggattttattagcgttttaaattttgacatttggaaaagcacaatcctccttctttttcatcctgtcatctttagtgtataagtgtccaggctccttccaattttaagtttctctttcctagctttagaagattataattttggaaagtcacaattattctgctagttggtggccagaacatatcaattgcatgtaacaaaattttattcagatgcatcattcatacattttaagtctcacggtttacttctttcataattatttgacatttttggtgaaataagtttagttctgaatcacccattttgttatgttgattctccactatttttggcgatacaatagtaataatgttagacatttgtatagcagtgtaaagttttcaaagtgcttccacatacacagctcttatttgcttctctaccttaggacataagcaatgtggtgttatacccattttacagataaagaaacacaggaacagagtattactttggatcacacatggtaagcctcgaggacagaatgagctcctgtgctagtgttctttccattgcatcgtatcattagtaatgtttacttacacctacatacttactgcttttcaaatatccagacgtcatctcctctactgtaccactctattatcactcgtgtcatattctgtttttatctctttgctaaggctatacccacccttccagttccccactgccctcattagactctgagctgctcgagaaaaatgattcatccatctttgtatctctagacccaagtaagatcacaccacatttttgccaagtctctcttgtgctataaatgttcatcttctcttagttgtaaattgctttcaacccaccttttttttttttttctaacttttattttaagttcaggggtgtaagtgcaggtttgttatataggtaaacttgtgtcatgggggttgtacagattattttatcaatgaagtactaagcttagtacctattagtaatttttcctgattctctccctcctcccatactccatgctccgaaaggccccagtttgtattgttcccctctatgtgtccacgtattctcatcatttagctcccacttataagtgagaacatgcggtatttggttttctgtggttttctttggttgctgtgttagtttgcaaaggataatattaccactgaccccagagaaatacaaacaaccatcagagaatattatcaacacctctgtgcacataaactagaaaatcaacccataatttttaagtttatgttataaatattagtattatctgagaggaaggcattacatccataagcagaaaggtggaaaaatcaggagagtgagtgatttatttgagagtatctggtttgttagtgaaagagatatgaaacaaacccagggctcctcatacctaggctacatctgtaacaccaaagtccaatgtactggtaccaaacagactggcacttgtgggatgctgtgtaagcagcatggacagtattcccttatccccagtgcaggctacagttgcttaaaagaactatggaaaaccggacattttgttcccttctaatttatctgtgttcctgtagccatgtctccacttctaaacgctaatcacttctctaggtgagcttaagtacctaattattaagagccctccaaatttctagtgtcatcttcaatatagttagtgccctttctgtcccatttgccccctgtgcttggcactgaatcagtatagcaaatatccctaatgaagaatcatggtacagggttaaatttacaaattaagcaattcctttagtttttatgtcaattccttttatccttgtatccccaccctgcatttgcttaaaattcatcccactgagaagctaaaaaaacaatgctactatgacgatttaaagagaaatactgaaccctaggactttttcctgagattcttgttacctgtaaactcttgaatataggatcagattacctaggcttccagggaatagtaagaccatacattagcagatttaatattaatctctagaatcccagatttacttcttgtccaggttaaatgcccttttgattattttagcaaaaaataatacaaaaaattgattacaaccattaatggaggcttaaaatgttaactcccatagctttaacccagtatctatgattaaatgcaaaaaatctaagttaatgcaatgttaaggttgagcttctaattgcacaaaagtcatgaaatttaaaattaaggtttctagtgctactctctgtcatttctacaacattcctccaatggttttctacaatatatgtttcatttaaatgtgtgtgttgtagagttcccaggaaagaacataaagcacaacagatcaggattcaacttgtggatacctagttttacataatcaatatggctggaaaagtgtgattcttttttaaactacaatgccctatttgagtgataaccatattcctgtttacaaatttgcccatttcctctaaaaatccttgaatcttcacttctgattacacactagccatcccctagagaaggaaagagcatttatgtaataaacaaaccaaacaacctgtggactgtgatagtacctacagaccttttcttcaacatatgacaaagcatattcatgtgggattaatgttgaaagagtaactcagaatatttaggtttatgggtgcatctagcagaacaagcaaaggtgaatagggactggaatcctgttaatactattaataggactagctgaggaaactgtcatcaaattattaaacctctctgaatgttattatcagagtaagaatacctgcttgtaggattattaggaagaacgagtgaagtaatatatgtaacacatgctctttaaaactctcttggagtttatagtaatagatcaactattactattaaagaatgagtaatcataatttaatgatcatctggatgtctacaggtattttggaaatatgaaacaatgataatttaaaattcattttattgaaagatacctagaattatttttttcacaatagtttcattaagttaggtatttgtttatagcctactatggaatgcccagataacatttaatacatgatgcactgagctgcatcagctaactctgaaggcaggtgagttaaatgaattcttggatattgggctgccatgcccaatattttcttcaaattttatgaaacatttgtgtctaaatagaaaatgtgcttgagaaattctagcccaacatgcaatttagagagaaagttataaatcataaatataagagcttagagctaaagtgccacctcaaccataactataataaaaactcctaagtgcattctggcaggaataaataaaaaatggcaaagcctgttgtggacggtgcagagcccaggaaggtaaccaagtgagtaaacagctaaggcaggattatcctcatttgggaggactccattccagacaggaattaaagaggaggggctggggaagggagaatggaggttgtgggagaaagtgtttttgcatttgaaagcagctaagttaccttgtgtaatgaaaaggaaatttgtttttttcctttcaacagtaatctcatttgaggtctagcagactgctacacaaaagatacatgtgttctacctacttggtttttctcctctggcagtgaggtacacaggaagggttcaggtgaatcagaaccattcagaataacatagtcaaattcctttccaaaggtttaaatacctattctttaatagctttcttcaaaagactggtaacttactgcactgttcctggcacattcacaaccaaaatttgttcctgggagtactataatacgatgcaacaaatgggtttaaacgaaagctggaaagatctatactgaaactatgaatcacaattactgaaagcaaaaaaatctcatacacatataatatccagaaaaacatacaactgtcccttggtatcctcgagggactgattccaggaccccactgcagatactaagacttgcagatgctcaagtccctcatatgaagtggcacagtatttacatataacttatgcacatccttcccttatacttctcaccatctttaggttacctataatatctaatacaataaacactaggtaagtggttgttatagggtatttttaatttgtcttttttttggtatattgttattttttattgttttttttccaaatatttttgatgtgtggttgattaaatctacaaatgtagaacccataaatactgagggctaactgtataaccaataatttctgagtccttttgtctctccctatgttaaagcaatggtgtagatgagatttctctgaatagaggggagcagctggaccaataagctgcattatcacttagagttatcaggactatatcaactgattcaagccttagcccccatctccgacttgctgtgatatgcaccaagttgcctttcttcttggtactttcctttcttaacaacaactagtaaattgactataaaacccttggctactataaactctattagaaaactggctgtttccagcatgagccaaggactctagctttccatactcaaagatttatatttctcaagtttcttaacaacattggcatatatttattacaatacagtttatacttttaaaatcaagcaaacagttaagattttaatggtcataaaaatgaagaacgcattggctattttctgagtagtgaaaaagttctcttttataatagcttaactcaagaacttttgaagtctttttcttcaaagatttttcatacaaaaattacctttgagagtaagcatgaaaaaatctcaggaagtaggtaagtattgttaatttaaatgcctcccttttcactccaggaaacataaaaccaaatgacaaagtacagatgatttattccacaactattcattgagcacctactattctctggcactgtggtaggcagtgaacaactctgctttaacagtgagaacaacattcttatctcctgtgacccttaaggaaagactagctgtagttagacttactggatttggtcataaagataaattaaatataaagcagtgaccatttaagtttaattatgttaaagaaattttgaaacaatagcttatttaaatcatttaagtatttgtttacaaatttttaccttctttctaaaatgccaagaattgccaaccatgaaattatgaaaacaaatcaataaaaatacaatgatttgaagaacaaatctatttaagataaaaaggcacataacctaacaccaataaaattacctgtagcactcttaaaaactagatttcttctttctttctttctttctttctttctttctttctttctttctttctttctttctttctttctttctttctttttctttcactttctttcttttctttctttctttttttttttttgacagggtctcactctgttgcccaggctggagtgcagtggcatcatcttgggtcactgcagcctctgcctcctgggcccaagtgatccttccacatcagcctgtcgagtaactggaactacaggcacatgccatcactcctgcctaatttttgtatttttttgtagagatggggttttgccatgttggccagggtggtctcaaactcctgagctcaagcaatccacatgccttggcctcccaaagtgctggaattacaggtgtgcaccacaacaaatggccccaaaactaggttttcaaatatgtgagagtatctctcagctatgtcaaaaatcctatgagtcattcattcagtgtttatttaataccaaaacatggaagatagtatgtctaggaactaattttactccaacaataaatctagaagaatgagtacctatttcatgtggttatcatgaagaaactctgtcagaaaactaaaatgaaatggctcatgaagttgacatatgtatgaaaatataagaattctgctcacacctcttctttcttcctgggggcattatccatgagcatcatctctgtatatgaaggacggaaaacccgctttggatatgtatgcttctgggtagtctagtcaaaaaggaatatgaactcttttatctctgaatgcttccaaataccagagaagaatgatttatggagttctgtatatgactaaaagagctgctagtacttttagagtattcattctttctttattccttcttcagggtgatctggaaattgcccttcccaggactttctgtctctcatataaactaccatttgtataccactttttaggttgcaaaatgctttcacatgtattgtgcaatttagttaaaaggcatcagggtgcgaggatcaagaacactggctttggtaccagagacatcagtgtttaccaaagctacttactagtggtacaccattgtgtgagccacttgatcactttaagcaacaattttctcatttgtaaattagggataacaatatccaccttgcaatataaggtagagattagcaatagggcagttaaaatgttattatgattaataacccatagtagggacaccaaggacttctcaatagtctgtttctcttcatcaggctggaggagggggtcttcacagttacttatgagtacatattacaagcttctagttaaagtaatggcctcttcaaatcttagatctgaaccatcttcataaaacagttctttaattcatggccaaaaacatcgtttccatatactctcagagacagagtccttttggagcaagatataaagtttaattctaagtctttttttaaccccgaaactattttccctgaagcaatccatgtgctgccatcagattttattaggtgggctaaaatagagtcagaaggagatttctttacataatagctgtccctacagaaacttgagacagtcagcttaaaaattatttttaatgaagaatttttgagatccataagtacaggaaaaattttgatggtctttctcccttactgattcattgataattctcaaacattgggctggcacaactagagtaaatcggtacatcttacacagtggaaagcggtgggtgtagatgtttttggagccagtcagtctctggcagcggatagagtcacacttgtgctttgttgcccatttacatcttcagaaagcagcctgggtgggcatgcttatcaaatgtgctcatttaaggataaacccatttgaatattataacaacatttggcaaacttcctctaccgaatggtggacctggcccactacctctgaaaactattgcctggccaggcaacataggtcctttgactttctttacatggtagaacacatctgagaccttccaatcaaacacccaggaggagtcctgagtgctttacctgttcctcaagcattctgaaggttctagtctggactagtgggttatggatatatggatatgcagtgagtccttccttttgcaacatacaccttttttttttttttttaatccagactggagaattcaaatgccttgttaatatctagtggtcacctttggcatgaagaagtcagcaaacatttactgaaaaagttgcacgtggagaattctgtatcataattaaggagatgccctccactccctgaagatgtttataattcttgctgggaatgagggaaaaacaaaacctatacaggcaaaactgcacagcacttatagaccaacacaaaagtgtgtacacacagtgtacaaagacttaagcagagcaaatagggttaaaaaaagaatttggaagaaagtaatggatatacattttccaaggtgagagagaagaataccatagagtggagaaagcataaacaaaggcatggaaatgggaactggaaagcccaccaacttggctaacatagagaaagcagagcagtaaagagtagggggtaactacaggggcatggggatgcatgaggaaccagtttgtaaagattaccaatgctaagccaaagctcttgttcattccattccagggaaacagaagttgatggagaccttggagttgggaaagaaaaggaggccaagaaggataactggtagtagagtggccttacagctagatgaggaattcggattctagtcttcaggtagaaaagcagcagtataaaatccaaggccaagaaatgagacatagaaaattatgtgtgggagcaggtatcctagatgcttaaaaaaattgttttgtgaagatagtttgaaggaagggtggcctattcaagcggttcagaaaggagataaggggccacttggtctagtgtcagcccttgaaaataaataaaagaaagaggctgaatgaagagatattactgggtgagaactggcagaatttagtgactgactgaatggtaatgaagggcaaaagaagaaaagatttaaaaatgatcgtagtgctggggcctcaggaaagggtcctatggacagtaattgaaaaagaaaactggtggctagagcagaagatgctctggtcagtggtagagcatcccaatgattaaggggtgtatgcatgtgaatgcatgtgtgttactataggcacacagatttaggagtaatacctcctttgccctaatgttacataacagcttacaattttctttcaattgaaatctttatttcaagtatttattaagtgcatactaggtgtaaagtttacaataagacttgtgcaaggtttacaataagaaaacataaaaaagttctattactgaacagaaactagtttaaactttactgcaacattttttaaagagtgtattttcatttttatattaattttctattatttgtaattcttaggccactgacataacagtgctttcattagtgctagatatgccaccttgacacaatttaaaaatcaataatttttcttagtgtacttggatatcttccttttcctaaatagtggttatgcatttggatgaagccagtgaataagatggcttttggtttaaatttgcacccagatcagtcctgatagaaggccatgtgtttctctgtaagagacacatgtgcatgtgcatattctctgcctcactcagattagccttatggccatggtatcagaactgcaaatagttatattgtggattctttcttgtttgtgggtgacaggagaaaggaaaactcacactttttttgaacaaagcaccatgtagatatccaactgaagtgggctctgttcatcctcaattcaggtgtgatgaaaacctacagggagttgaccttcagtactgaccttttacattatctcatttctctcatgcaacttctgtctaaggatgggaagagacctaagagatctattagtctcagaattacattcatctacaggtgtgccaaaaggatatcaagttttaaaaacacaactgcactatttcttttgtttttctttttattttctttttttttttttctttttgagacagagtctcactgtgttgctcaggctggaatgcagtcgcatgatctcagctcactgcaacctctgcctcttgggttcaagtgattcttctgcctcagcctcccaagtagctgtgattacaggtgtgcatcaccatgcccaggtaatttttgtatttttagtagagacggggtttcgccatattggccaggctggtctcaaatgcctggcctcaagtgatccacctgcctcagcctcctaaagtgctgggattacatgcgtgagccaccacacttggcctatgactggactgtttcttaacattaatataaagcaaaggttgcataaacaatggatgtaggaagctcattccttcataattattaagaactgaaaaggtacattgaagaaaactagccatgaataagaaaataacttcttcacagtggttaaagagaaaaggtactgaaaaaagtaaacaaacatatgaaagcctcttaatatactaaggtattactatatatatttctgacctttggctactgagaaaatgtgaaagatgacaattctatagctattctatataacggcagatgctcctcttattccaggaaacaaaatccttttatgacatttcactaaatatctaatcaaagagtattttatgtgctcatttcagatagtctcattcacttgcccttataactttaaatgagttcttttcttaagcaggccagcttgtatattatttatgataaaatactttctttaagatggattcagtgttaattttgtactatatgacttagtacagtgggacaattacatataacacttcttctatcagccctatgtttctatgttctttattaagatattatcaaagtaatagcaaaattctgttaaatgttcaatgtatatctttactgctaattttttttcaacatggtaatattactggtaccacagtgactcctcatatcttgaatatatgcagtacaattcattctctactagcatcaatttctttttgtaaacagaaatttggctttaacacagcaatttccaccaaactatataagtgctaatgatgaccaatttaggacataaacagtttactactgtcctttgagcctctctcttttttcatttctctaatcatcacactaaggattttttttctagaaagctatgggcagagttgatttcacagagttacaagttgacctttttcttttttttttttttttgactgatgctgttaatagagttttggtgactctatcagttaagaggtataccttgtacctgacattttacttgcttgagcaactggccccaactaactgatttttaatattttgcttttctgtttcctcaattttccttccataaaatattttttctacttctatataacttcttttttatttttttgagatggagccttgctctgtggcccaggttggagtgcagtggcgcgatctcagctcactgcaagctccacctcctgggttcatgccattctcctgcctcagcctcctgagcagctgggactacaggtgcccgccaccatgcctagctaatttttttgtatttttagtagagatggggtttcaccgtgttagccaggatggtctcaatctcctgatcttgcgatccgcctgccttggcctcccaaagtgctggaattacaggcatgagccactgtgcccaccctataacttctttatttattttttcttcccttatcaaattccatctcatttttcttacgcaattaaaatatttcctcactacagtttgggtcagcggtcagtcatatttacatcactttttccatagtttggttgatgatgtgcatagagtatatgcactagccaaactgatccacattcactgtggataggctgaagtccaaattgtaagctgatttgtcaacagctttgagtaagcctgatgccagacaatattttaattcttcagtgatatttcctcttcacttatgaaggaagccttgaagatggcaagttaataagtgcattgttttaactctgtaaataatgctttttggggggttgtctttaaagattctcatttactttttataaagaaagttataatttcttattttctggttccattcttgatctctttattttccttcagtttgtggatttgctctacttttaaaaactcataacttatgagtaattttacagatcccaagatatagtttgtttgttttttgagacagggtctcactctgtcacccacgctggagtgcagtggcgtgatctctgctcactgcaacctctgcctcctgggttcaagcgattctcgtgcctcagcgtcccgagtagctgtgattacaggtatgtgccaccatgtccatctaatttttgtatttttagcagagacggggttttgccatgttggccaggcttgtgttgaactcctggccacaaaggatcggcccagctcagcctcccaaagtgctggaattatacacataagccaccacaactggccaaaataaatttttttaaagaggatactgagcatctgaaacaaggggggtttgtagactcacaaggattaaaaattatttcgattgtctttaaatcgattgttttttaatcgattaaaaatatattcgattgaatatagtgatgcatttatcagtctatcattctgtaaatagtatggaaaattctggaaaaaaattcctgttcacaataaaagagattcaatttgcgtaacgatatttactgtgtgcctactgtgtcctgtcctaagacacagtattaaagttctttcacttaaagagttcatacctagcagagggattagacaaatttatagacaattatgcaaattaagtaataagctttacaaaagaagtgcacaaaaatttattgtgggcgggtggtatatacaagtcaatgactttcgttgcatgggagagctaaagagaagtaagcaataagggcctcagaaagttagaggcatttgggatgagcctttgaggataggtaatatttgatatatggaaatgaagatagagatatacataagcaacaaagtgaagaatgatagattggaagtgggctattcaggaaaaaatgcttttctttggaaaccatggataatatttcagcttctattcttataaattagtctcagcaaagttgccacttatcatatgttcaatatgaagtattttccttgcctataagaaacactacaaggatgtgagtagaggtgaaacatagagtagacgtgtcccaattgtaccccagatgtgtttgtaaacttctaggtatggtttccaaagaaataaagctcacagaacttttattaagaacacttttatttctataaataaatggaaactcatcttcagctaaaaatatagtggcggctcacatctataatcccagcactctgggaagcccatgtggggggatcacttgaggccaggagtgtgagaccagcctggacagcatagtaagactccttctctacaaaatattattttaaaacattatttgggcatggttgctcatgtctataatctcagctactcagggggtgaggtgggaggatcatttagcccagaaggtggaggctgcagtgagtcatgatttgtcattgcactccagcctgggtgacggagcgagaccttgtctctaaacaaaacaaaacaaaacttggaaattctagatatccaggtatttattcactaccacatagcttaactgtatttccttattattttgtctctagctgaagttctctggaatggtcatgaagagagaaaacatcaaagattaggaaatctatcccaaaaagatcacaaaatcaaggacagtgacacctttttgagctttttacttgactcttcctgtttttttttttttccacttcccttagtcattcactaatcagttctgctttagaaccattaaaataatagaaaagttacagaaacttggtaaaatgtttctctggcctatttccaaaccgcccaaaattaatgggaaatggttaaagtcaaaaaagctttttctctgacatggatttctaaacaatataattatggttcactccatggttatgagctttgggagctcccacaaaaaagtctttgctgcagatgtggccactggctgctataccaggcaatttgattcatgtttgttgttgttaaaaaaatatataaaactctcttatgttggattaagaggcttttaagaggaagctagacagaaaggccaggtctctctctatttgctcattcatgacaaaggtggaagcttcaaatttgtgatacatgtgaagaaggtgtctgttacttcgtgttacatttttgccttcagaattattgttttcaatcattctattttatataaatgcacaaaaaataagtccaagctaaactagtgatgctgggtcactccaagaagtgtcctcaatatagcttcacaaatttacccttttctctccaaatccacgtttatttcttgagacagttatatgatgttttgccaagaaagcaactgggagcaatgccttatgtttaactgggcttttagatttgagaagcaatccaatccaagacttcatgataagacttccacagcaattggatattagtgacatataaggaccttaagaactccaccattttatactctatataaatgtatgatgtggtacacaaagtattaatcaatacttcatgagcatagtagctctgtttataccaatttctagcaatgtacattaggcaattttgtagaaaaaatataataattgaaagtataatttaacttccactccatgaacacttagcctcttcataccatcctcttccaagcatttctttggtccttggaaaatcagtgaaaaatctgaaaaattgggattttgtgtttgattatatgtacatttactacaagtatactgggctttccttttctgatgctatagagatgaactatagctttcctaactcagtcttattattagccaggtccagtttatattagttaaaatgaacatcataaatttacagtataacttatctggtacattccttctattgtagtttgaaaatgtgccattcaggactgaaatgacttaaacataatcagattttatttctagagaagtaaagtctatacttctataattctgtgaacccatcagcaattaactttgtcccagtagaattaatatagtgttcaagttcaggattgagtagatgagaagaggaaggaacaataaaactcattcactcccatgctaggttctgcaaaatagcttccatattcccataatgtgatatttatcttccttataatagcacatttaaagtcagtaaccctaaaaatctcctacataaaggtttgcatctttccccttaaaaatgtacagatgagcttgtgataaagagatgatgtctcctgccaaattgtaatatcatatagaccagttccaggcaaagtattgaagaagcagtcaaaacttcatatacctatctatccttgtcagcctcacgtattcatggatggggtcacagcttatccctttattctttttggttagaaagtctttccagatgaggtcatcattttcattactctgtttcttcctctctcactagagtgtctttctaaaggaaaccaaggaccacttcagtgaaatattgaaggcaggggaggccctaaatgattaaaagaaacaaagctttcccatagcacgtgtccttttctttgtaaggagatgaggtaatatataatcttcccacgttactaccacaagggcattttgtggcagggagagatggatttctgggagtgaaatccaactgcaaagcaagggctattttcagaagggcttatcttcaatatcctcatttcagaattggtctctttgctcagagcaataccttgggcaacactgagaactcccatctctaaggtaagaataaaagttatttcctcattgatggaatatctgatgaagaaaaaggaagacaaaaaacaataaattattctcataaaaggtgatgcatatgaataaatgtcaaatccttctagtatttctcatgtggcttgtacacaagacttctatttgatctttggctctgcagtttctaccactagatgacccacatgtgtaatctggataggcagctagtttgcttacatataaattaaatagcctcaagtgtcagcagatctctgtatctttttaatatcccccaaactgcttcaagtaggaacagctacaaagaaccttaccaaaggacatggaattcacacttgccaaagaaatcactgcacgtgtaaattagaaactaatcatcacttcctctctggttacagtggcagctttgcctcatagtttatgttgaaatatacatttttatgaaatatttctcactgtagtcagcatcaatttaggagtatcaaacactaattcccagctccagcataccagaaaactagagacagagaagtgcagacaaagggaattgacaaaggcctggacttttcttatacttgaagaagctaattgtatttgtaaatttctggttaaaaacctgacaattatcagatctgccactgcaaggctattcctcaatttcttcatcatatatttttccctaaagtctctcagagaagtaaagggcttctagagatgaaaatgaacttgacaatcacgttgcaactcaaactgatcttgattcttttcgtcactttttaatttattgcagatggtgtaaatgggatgtttactggttggcaggtaatgagtcttgttgtagataatagtgatggacagaatctcacgcctgtcgacatcccagcatctcagcagctatatatggttatcatccattgctttgaagcacatataatattgtgacaggatgcacaatatttcccccatagaaacgatgattggtacacctgaatctcactagttcacatgtcatttgtcctgattccatcctcactgtccacatgagtagacattctaagatgtgatctaatggaaaatgtaatctgtttaaacatccaaacactcctcttccaaggtatcaccatttatcacaactgtcagtgcccctgtggaagagtaatgaccctcaggcatgggataatgctccatagaggccttatgaatgccactgtgaaacacagaaattgaccagttttcagttgggctggtatgtgcatcatgaaagatctgcacttactcactaaattacaagtggctgtttaccctttatacaataaagtctaggttgggaagccacagaccctgctgacttcaattgtcccaaacatgtgagtactagatttggacctgcctttgaaatggacttaagcagcttgaaactggaagttggatcacagtcattcaaaaatacattgggagataacataggtgtcattgccttccacttttttgcctttttaaaaaatcctctctatcaatggaggataacaacatctcactatccactattagcaattaaaaactaaacagggtaagcatgccagtgaaaagttaactatttgtttccttcttgtaagcttcccttcatccagaagaaaatctggatctggatctgttcatatattgtttctacaaagcagaacaaaggtgaacagttatgtggtatgaactcatgattttcaggtccctcccaatgggtccatttcctcattgacgatttccttgaagtcccctgtaccttcccaatcttatctacattttctatgaagtcaccttagataataggatcacttgcactctaagactgtttacatctcagtaaatgctctatcactatgaaagtttcatctaaaacatatctattcctcagtgctcagacaccctgaagatacccttcaggatgtagcatccatatgaagtcacaaaataccagttgatcttcccgtggaaattgttttccaatctgtatgaattgaatggctcaactaaataaatgaagaaaatgaaatattttactcacagtgattcattccatattaagaaaatacactaagtaatgaatggcccctatgaaatcattacagttatgagcatcttttctacttgacagatctctgttcccctcgcagatgagttatgccaacctaactatacttttggtattcacaatattctgattattagtatctccaaagatgggacttaagacactttcctgagaagagaaatttacaattagatacatcttaacaattaataaaattaatgagataatgaaataagaagctctcagtatactgctgaggatgcagaaatctttttgagaattaggaatgttctagaagacaataaaaaagatcagattgtgaactgagcaaaacaacctttgatgtgaagtgtcagccagaaatgtcaatccaattcaagactgcatacaaaggggcactgtgtctttgagctgagaggtattatgttacctgattatcttctctggaagaatgcattatggtttagacacttttattacctgaaagatgtagacaaattagggaagattaacaaccagttttattaggaagtagcagatgagctggtgtgaatggtactggttgttatgagttctgtattctcttttcagctttgatatgctctcatgtgggaatagtcatccttgaaatttagataggataatttatattcttttccccagagaaaagacagtttgggaatgaaagggaggggaagtgtttaaaacagcacaagaacctgggataacagaagggtcagaaattctattatagaatttttcaactcccatttacaaaaatacaaccaacaataaccagttcttaagcctttatttgaataagctcagtacatttagtatttgcagtatgtttttcatatatagtacctaattgtttttggtccacagaataaggctattctatgatactatgttattatgttcatgttttcctggaaatataatttgcaaggtcattctaggaactctgattatgaaattcaacatcactttaagtcagttaccctgaactctaatgcagtttcttgtctcttcatacttaccctggagctataacctatagtcttatagaagtgcccttttcaaaaaggctcccactccttgccttctgaatgactgtctagatatattttcacctgtaattgcatactacaccaaatttgcattatatatgaatgtgattgagaaatgattaagataattgtttagtttattagtgaaaataagtggtatataagctaaaataaattattatttttacacatggcattattcctagttgtatttattatgatttaccatttactaaagtatttcagttggttgacaaggaataatagcactaaacttccttcaagcaatactggtgactcactacagccctaatgttaatacattccctcagacttaatcttttaattctattgggaaacacctataaacacaacagaattttttccttttctgatgttcattcaaattacattacctatttccaccattcagtgtagtaatttctgggaactaccttgaggggtggatggtggtaaagaatcaggacatttaaacttctattaaaaagggacagaagaagactttaggtcacctgtgatcttaggcagctttcaggaaacagaggaagcacacttgtgatgaaccttcataaaattggcccatattcccaataattcccttacctattgagattcctggttgctaaggactttatcagttacttcaacaatcctccctccccgctaataacagtacctcatttgcgaacaatactggactgtactcacaattccttttccccttcctttcagaaagaacacttttacgcccctaaatagtcctataaatggccaaagacataggacatgctacatgattcatctcatgaatcagtttctgttctcttggctgttcaacaaaagacatttcaaattctccacgaggcaatgtattacactgccatgagattaatttctgtcttcaactttggacatttcttaactattaactgggattacttcctttttgctcctctacaacccattctctacacagaaactgtagtgatttctttcaatgtgacattagattctactacaaaaatcaccaatggctgcttactgtaactagaataaaattcaaacttctcactctacagcctatatagtctggttcctgattccttctctgaacacatcaccagtatacttttccttattcactgacctgtcataattcacatgcctagctcacttgagcctcaaggcctttgaagttgctattccaatttgcctgaaatgattttccttcacatcttcatatggctagtttctaacatcattcaggtctcaaccaaatgccatctccttacatgccatccgtgtgagattttactcttactttcttcatttcattcttcattgtgtgttagtgagtttacatgtttattaactatctcccttaactagaatgttccagaaggaaggaggactttgtgagttctgatcactattgtatttccagtgtctggaatagtaggtgctcaacaaatacttgctgagtgaatgaataaattaatgaccaaacagtaaataaatagtaaacaaggccaatatcaatgctctttattacagtagttatttaaatgtacctcaaaatgctctaaaaataaatatgtgctttccctgcacattaggattaaaagtactcattttactaattaaaagccaggacctcaatttacattaatgactggtccaagatcatatggtaaatacgtattgcacaattctggtctgaaatcttgttagcccagtcagtcctacagtgatttacttagaacacaattgtgaaccaggtataattaatctgaggtccaccaataggcttgagggggtttgtgaatcctttgaaaaggtattgcaccctcttttgggaagagggtccatagctttcatcatattatcaatggaagccataaactaaaagaggctgggaatctctttaagcaataccattctgaaacaaattattcttaacctccctaggtagattggaaggctgctggcttcaacattttctgtagagaaggaacacctatgaaaatcctatcactggctgagtagacatattttcctttccagcaccaactctggggaatggtgggcctcacaggctggctaacccttcttggagttcacgggaaaaagatgtctagttcaaagacgatgagaagggaggtatcattctaatcatgtggaaagcccactgtgcttttagtttgtgtttgtagcattcttagcttaatttcagggatgttattgtagctgtgaagattagataataataagaaaaactaattcttaggcaccagacagacaatatgaaaaaaatatataattctaaatgtaggtcaaattttatatttatcagcattgatgcagtgttgttttggtctgttcttaaatttttgttttatgaaaaacaatgaatgcaataatcttctaatacagtgattaagaaacagtgtatatttttccacatactatcaaagcagagtaaagagtgaattttgccatgggaaatagtgtattgctacagtaagtaagaatattaagtttaccaagtttttctagactgaagacttaacaataaataaggcacatcttccctgtaaggtttctcttgagtctgttacttttcagtagatgatgatgatgacagcaacagcagctaacatttgttgcttattatgtaccaggtcctgctctaagtgctttacatttattacttcacttaatcctcccagcaactatgtccatgaattaggtattattattatctattcttagagatcaggaaagtcagatgaggggttatttaacttggtaatgaggggtaaaaccaagattcatatcccacctgtctgatgccatgtccaagcctttcaccactacactttcctgtctccctctgtggtagtgcagggatactttggagatgtaacacatcttaattaaaaatactttattgctgaaaagtgctcaccaccctctgagctttcaagattaccatctgagtggtaatctttttgctggtggagggtcttgctttgatgttgatggttgctgactgatcagggtggtggtttctgaagcttggggtggctgtggtaatttcttaaaataagacaacaatgaagtttgccacatgattgactcttcttttcacaaaggatttctctgcagcaggtgatgctgtttgatagcattttacccacagtagaacttctttcaaaattggagccaatcctctcaaactctgccatcgcattatcaaatgagtttataaaacattctaaatattttggttgtcatttcaaaaaatgttcacagaatctttaccaggagtagattccatctcaagaaactcactgctttgctcacccataagaaactactctttacctgttcaagtttgataatgaaagtatgaaagtacaacaattcagttacatcttcaggcttcacttctaattctagttctcttgttattttcatcacattatgtacagttacttcttctactaaagtcttaagtgcctgaaagtcatccatgagggttggaatcaacttcttccaaatgcctgttaatatttatattttgaccttgtcccatgaatcacaaatgttctttatgacatcgagaatggtggatactttccagaaggttttcaatttactttgcctatgtcgatgatagaaatcactatctacggtagctatagccttatgaaatttattttttaaatataagacttgtaaatcaaaattaccccttgatccatgggctgctaatagatgtcgtgttagcaggcatgaaaacaacattagcctctttgtacatctccatcagagtttttcggtgaccaggtattgtcaatgagcagtagtatgttgaaagaaatctcttttttctgagtggtaggtctcaagagtgggcttaaaatattcagtaaatcatgctataaacagatatgctcttgtcctggctttattattccatttatagagctcaggcagggtagatttaacataattcctaagagccctaggattttctaaatggtaaataaacattggctcccagttaaagttacctgctgcaccagctcctaacaagacagtaagcctatcctttgatgctttgaaaccaggcattgacttctcctcaatagctataaaaaccctaaatggcatttccttccaagtagaagactatttcatctatattgagaatctgttgtttaggtcagccaccctcatcaattatcttagctagatcatccagataacttgcttctctatcagcacttgatacttcactttgcacttttatattatagagatggcttctttaattcatcttcatgaatcaatctccactggcttcaaacttttcttctaaagcttcctcacctctcttggtcttcatagaattgaggagtcagtgccttgctctggattaggctttgtcttaagggaatgttgtggctggtttgattttttttttttttttgagacggtgtcactaggctggagtgcagtggtgccatctcggctcactgcaacctccgcctcccaggttcaagcgattctcctgcctcagcctcctgagtagctggaactacagacacgtgccaccacactcagctaatttttgtatttttagtagagacggggtttcaccatgttggccaggatggtctcgatctcttgacctcatgatccacctgccttggcctccaaaagtgctgggattacaggagtgagccaccgctcctgtttgatcttttatctgcaccactaaaactttctccatatcaacaataaggttgctttgccttcttttcattagtgttttcactagagtagcacttttaatttccttaaagaacattttctttgcatttacaacttcattactgtttagtgcaaggggcttagctttcagcctttctgggccttcctcactaagcttaatcatttttagctttttatttaaagtgagagataacgtgactgttcctttcacttgaacacttagaggtcattgccgggttattaactggccttatttcaaaattatgtctcagggaacagggaagtcccaggagagggagagagatgaaggaacagctagttggtaaggcagtcagaacatataaaacatttattgattaaatttgtcatcttatatgggtgtggtttgtggcacctcaaaacaatcagaatagaaacatcaaagatcactaatcacaaatcactcaaacaaatataataatgattaaaaagtttaaaatattgccaagaaccaccaaaatgtgacacagagacatgaagtgagcacatgctgttggaaaaaatggtgccaacagactcaatacagggttgccacaaactttcaatttgcaaaaaatgtaatgtctggaaagtgcaataaagtaaagtgcaatagaaagaggtatgcttctatatcctattttcaatacaaagatgctgggtagccaatttctaccactgtctttgtctatttgacaaaactttcccatgacttttatactgttaacttttttgaatagcagatgagacacatacttgcatcctcaaatctgcaaagacaccttgggccagtttgaaccgaatcccatttttaactgaaaatgatgaaaataaggtacattattagcctgaactttgcataactctaaaatgtattaatcttcggtaaaaattttaatcttagttttagaatcctcatgaagtacttagaatgtttaaatgagataacactgggtatattaaacattatgaaattgccatttctgtagcttaaaaatggtcaattgttgccacagtcaagtgattaaacctaaggtaagtaatcaacttaccttattaagttaactgctattgttgtaagataaattattctcactctacaatcctccctccctgaaaacttttctagtctggaatgtactgctgataactagtgctagggacatagggttgaacttgcccatgattttaatttgtaatacataggcttttaaaattcatatcatagcaggtatacctccaaatgatgccacaaagacagcctagaaaatgggccttagaagattaagttaataaaggcttattatttttcctatagctggatgtactcttaactagataactttcaatagaaatcaagttcatgaagcaggttcatgggaactgtattagtttcctatcgctgctgtaacaaattagcacaaacttatagttctggaggtcagaaagtcctaaaatcatggtatcagcagagttatgtttttttctggagtctttaagagaaaatccctttccttgagttttccagttattagaggccacctgtattcattggctcatgatctattcctccctcttcaaaaccagcaacgcagcatctttcaatctctctctctctctgacctctgcttccatcaccacatctcctctgtgatcctcctgcctgcctctttcctttaaacggcccttataatcatattaggcctaaccagataatctggcataatcttcccatctcaaaaatccttaatttagtcacatctgtaaagtctctttgccatctaaggcaacatactcacaggttctgaggattaggatgtgaacatcttcggtggggtggggaggggggcattaatctgtctgtcacagagaccgaaatattctaggtacccaaatttcaaatagcaagcaagatggtatcttatttctttaaacctcatagcatggtaagctgcacagacatttttacatataccctcataatttttaaggagattgtgatgtacaactctccagtttctcttctggcacaagtgtgtggaaatcatggtcttagctttggtttgtagaaccagattttactcctttacccagttttagtcaatcccatttatatttaaatttgtcctttttgagcattcatactgctatccttagccaaagaattattagtacagtaagtgctttctgcacttccttctcctaactctaggaataaaaggcacacgtgtttagctgagaaccaaccaggacagaattctagcacttctcattacatctttcttgtgctcttccttcaggcactacattgacatctcaataagcaaataacaccagcgttgcaggtgttaacaccaatgactataccatgagaaattcccttatgtcacgccttgcatgggtaaagttaactcaaatgtcttccttctcttacctaaaatatctgcttgcctgacctacatctcccttgtccattgtttccaatgaacactaacccttaaacatttaagcctcatcagcacatgcccatcataacagcataacatccttgtcctgctggaaactattcagcatccagaggaccatctttatgctgataacactaaaatataaaataatgccaacagctggtgctacaaatggcttttaaaaacgatgttcattcactaaaattcctcttgctacttttgacatgaaacacgcagtctctaattattctgatcaagacggtgaaatacaaaaacaaactttaattgtgtttaacagatatttaatcaggactcactgaactacagattaaagctgaaattcataaaccataattacccgattgtcgcaatcttttggtccacattctccttccgtctgggcgtctggcaccttgccccgaatttcttttactgtcttctcagcttcattactgttcatgttttccagcagagatttagcacagattacaaaatatctgttcttggcaactttcttcattagctttttctccccccttgcaaaaagtttattttcttttttctaccagagtagctggaacaggcatacgtttagggtgctttgatgacacaaactaattatatagttatcaggagataatacggtagcgataactaaagttactacagttatcatgtaggtatcatgcaatttctccagtataccatgcggtgtgtcccagtcaccacgtaattacctaatgtcactactgcattgtttcatggaaaatgcttatctcaccccaacaaaaccttttctgccacatttagagaaaaaaaaagaagtgaaattcttagttctcatatccagtactgctcattcccagtaagatgttgtcatgcaaatgtaagggaaacacctgccctctcctgaaaatttgctcttacagggagcaaatggagcaattattattattattttttcctgcttcactctttccaggtaaaagaagtaattaccaacaatacatacattttttctttttttttctttttttaaaagaaaccaatccccctaccgacccccgaaagaaacaccctatttacttaggattcgtttagtctggcacttcccccctatactctttcctttcaaatttcagtcactcacatttgtttttcctagaattatggtgtaaatcattcttaacaagctaacttgaaacttctctcactcagtagaaacacaaaatgccactgtaattgaaacacggaagcttgaaactctttctaaccagttcttttgggccactcttcagaagggcatgccgagtttccctcacagtgcggtaacccctgggtcacacagcgaggataacatcacagaccaaggcaagaggataaagagaaggcactggctaaagaagaggtgggtggttcctttattccccccagttgggcagtcaaccctatgaagcaaggactgtagttgctacttatttatctcaagttgatggcttgaagtctgacctcactaagacctttagatgtgacataccacctgagagttccagtttaaaacaggatgtagcagcttcctttgcagcacaagttgaaagctatttccaattctgcttttattagtcacctcccaatctaagagctgcccattcaattgtacacttaactcatgtcggggtaaaaagcacctccagatttagaagggccagaaaaattgctatcctatcctagcacattgttcttcaatcacacagttcctctaaatacagttgacagcctttgagatgcaaaatgtatcactttaatgtagtagaggtccccttcactgcattgccaaatctatttagcagaatcttcttggaataatctgtccctagacctgaggatgcacagtgatttcaagcattttaagctaatgataatggttagtgctgagaacagatgtacctggctgtgatgtgatctattccagtaggcttttatgagctgttcattcctattgacttagcattttatgtctgtgcttttgcctggtgtgatggttgcataggggtgtcatgtgtgtattttcctgatgtgtgatggctgcacagggggctgtgtgtattttctcagtgcaatggccacacagggtgttatgtgtgtgtttgcctggagttatagctgcacatgttattgtgtgacttttctctctatttgatgcttgctcgcagggtcctatgtgtatctttttcttagtgtgatggttgcactcaatgctgtgctaatgatggacatttctagcaattatctatctacagggtcctcgggaaaaaaattgcagtgaaatcaataaacagtgctagacaggcccttgtaaatatgaaatgacaccatgcataaatgccgtttcctactatagcatgttaaaatccaaattctgttatgttattggcattgggataaaatttctatggtccctccatctccttcatatattgcaatcttttgggggaagttgagattactgctggttggagggcttttacacatgcatctatgtaatactactttttgctacattgtcctacacatcatctcttatactccattctgacttatcctggcataatagctgatattctaaaagtgaatatgcctttcatttattccttcagtctcaccaagccctcccccatataacccctacatcacacatacaaaaccccctcgcttgcctccctctctctagtttctccgtatccctcctgtgttcaccaaacggaactgacaaaggaaacaaccaatgaggttaaaatcttttgaaacccctggaatacagatgagctgggaggcatctggaaacaaaaccagacacttgaaatcaaagagacaagtaaattactatcctaatctaggaagaataactaaaggtgtcagtggggttccattgatagcacttggctctgggccagaatgccaagggttcaaactccacaccagctttgggctcaggcccaagacttgctactgcagggtgcagcagcatgtgcagcagtgttaaaggtgtcagccttctgcagagaggttaagtccaagtccttctgcctgtttgtcattacaccccagagagacggagagataaccctagctttctcttcgctgcctttctcaatagaacaggctgaggaggaactagtgctcagcagcagtacttgctagtatgagtactatacaactaattagtaaaattcccctctactgataaggctgcttgaagtatgcgcaagaaaatccactgtccctctccccccacgaaaaacctgatgtttgtcctaaagattcttccatcaatgcaaagagctaagtttggaaacctaaaaccatgtgtctaaaagaaagaaaatgttttcattggaacagcttacatgtctggtacacttgcataaaaactatcgcatagcattttagagctaaaattgctataaaatgcttaatacagtaagagtaattatgagattttgcatgcacagctggtatacaactagagtctcagccacatattcaatggagcatgggaaaaccatttataaaaattcctggtatgccagtttaactcaccatcaacagcctatcaacacttcattctttaagtggatagggaagatatttacctaccaaatgctttatttcttctctcatggatgttatcaatacttgattcaaggaatttgagttattacttagagagtataaatataagctgttaacaggacatgaatgacctgaatgcaagccttctccactgagtgaagaagttacaatgatagtagtaagtaatgaaccagaagaccaaatcattaaatctacttgtatcttccctttttaacctccgctttttgctatatcttcacatattcttatctctcttcatttctctaagattcaaatcctcgggtgagttcctgggtactctggactcccctgccatagcccacctggccttgccttcccctgagtaacaccctgaagacagagctcttcgtttacattttcccccaatcaagttataacaggtatttgttctccattccctttagttccagctacatcacttgaaaagaaactgatttgggtgagttgttaatggttaataataatttaataaagtttatttcttgatgaaaacattgattttaagagtcaaatgaagaacctctttattgtggtcttttaggctctatggaaaatgccataataggtgagatgattctaatcagaagcattgatggatgctccattgcacattttttagccataggagccagtggatagatgggaattcccaggtggacaggaagtttggggtcacaaaggcagcatgacacaatacaaaatgaatttgaacagaatcaggaaactcaagttttaggaccaacaaactttgccacgaagtgtttggcagacattcagtttcttaacctgagaaatgaggcaggccctgggatcagaaactctccatgatcctctctggctcttacattctatgactctctgaccgcagatcagtcaggtctcctggattagctaccacctccagttaagaactaatagttctgaataaagatggcggtcattccacactgagccaacctaactaaagaggtgttgatgtccataggtgagttttacctgtctgcctacaacctgcatacactacttttgagttggctcctttatgctatacagatatttcttagcattttgttttccctcatttacttaattcagcaaacatttaatgagcactttctatacatgaaacacagagtcgatcactaaggacaggactgaacagggcaccatctctgttgcacagatgattttattattcttgtccattctctctctctctccccaccttcacttttatgcataaacacatacttctagaactataaaagtagtatagaaaaaataagaggaattagacttatctgagccagtctgaaatactgtttattttaaacaaaagaatatgataataatttgtgttggcaaaatatatgcattcaattacgcacttcaatagtataaagggtatttctcaacatgtattttgaggtcagtaatttgcaataaggataacaatttgggggaaagaagattataaaggtaaaacattcccttctgtagaatcctgataaagtcctaggataaaatctgtgacttgtgtaaataacctctgggaaagtgagatcatagaattttttttttaagtttttgtttttcctctaaggattttgggttcatatccctccaaattttatttcctgacttaaaaataataactgccacttattgagtaaatattaaattccatgcacttcaaatacattatttttataaatacagtatgaaatacaatatattaatatattgtataatacaatatgatatattataatacattgtaaatattaaattcaatatattattaaagcaactctgctagatagatattattactctaacagacatgaaaactgtgggtcagagagctgaagtaacttgtcaaagataattcagacagtgtgcagagttagaatttaaactcaggtctgtatttgtctatgcaatatggctccataaccatttcttggttctgctgaatctaactttattttaaaaatgaataatcttgcttgaatgctttgttagcaaataaggaaagcaccctttttactcttccttcacattcattcattgcattacatatagtacaatgaaaacaggagatggttaagattttttcaatgcagatctggttgccttttcatattgatttggactgagataattaaatttgggctctcaatcaaagtgaaagaataagctatttgctatctgaataagtatttcttattaattgatcagacatggataaggtgtgttattacaactatatttgtaaggtatgatttatgttgttctactgcatattactctgtgctgtttttcattttcttgcactttggactttttgttttgtttttatgaatttagtcacagttggttgtgtgttgaactttgtaaaaatgtaatactaaggaaattaaaaaaagaaagaaaatattttcaaaatgatgtcaaaatcaaatctacccctcactaatttgatttgtaggaaatggagaacaaagtattagaagcagaatgcttttaaataatcctaattacttcaatgtgcaaatgcattgactaaatcgaagcatgcgtttaacactttgcacttcaattgtgcttattcatctaagttctatagatagcaattctataaaaaacaagagatatagccagccattccatagttattgggggaaaactattgttctaaaattcaagcttacctctcaagtcagcccacttttggactaacgcagatcattaggtcaaagaactcaaaataacataatttactgtaactactcaggttttcccaattgactctgccttccctattctttttttctgccttcagcggggtggggtgaggacgtggaggaaggaaagcttctgttaacaaagccacagagtggaagcagcaaggcttttggtagtcaagccacacagcattaagcagggccaatcttaaggaataatgccatggggttagagtggtttgtgatcaaggctgagatggagtcatgatggcagggtaacttagtacctggtctaggaccagctgcatcagaaccacctgctgagcatgttaaaaagacacatttcagggtctcactccagagcaaaccaacagaattagtatctcttgaggtggaactcagatctccattttaaacaggctccccaagtaattcttatgctacttaagcctgaaagcactggcatatgcacttaagctctctaattctatatccagcgacagccctgctgctacacctgtatactctgtcccagtcttcaagacatatgtgcaagtccaactacttgtcctgggaggcattaatgctaataataatggcccaagggcttagctaggcatgatgttatttgacatgcagtatctcatccaatccccacagcaaactacgagacaaagatgattactattctcatctttcagatgagaaaactgaaattcagagagacttagtaacttgttctgggtgccacaataataactgaaagagctctgaagaactatactactgtactttaactcagccctgcagaaaaatatcttgaaagatgtttacttctaaaggtgttcataacttggtgatatcattattccaaagaaacttgcctagatgctagtaagatagattatggaataacacacaaagtgtaagcatttctacccaaggaacttttccttagattatttcatagagacttaaactctcaaaaactaggctaagaatccttcattagttcgttcaacaattatgcactttgccagaacctgaggtatacaaagataaacaggacatagtctctgccttcactagacttacagttctgaaaaagagacaagcttgtgtacaaatggttctgggttaacttatacagtcagtggaggcctgagggagagagagtagttcattctcctggcagaaggaaaagagggtgaggtctgtaaagttttagttactccagcactatgccattggctaatgtaaggaacttagattttaaagattatatttttacttgtacagttttgttactaaaggggcagactaagttacttgtatatttcgagccaataaaactttatctggttcattctctctggcatcaaactggttttcttttttgggtaaatttctgggtacagagccaagtaagttgttatgtttattcattcttacacagagcaaccgagattctattcttgaaatgagtgcctaataaattttatcagtagtactttattccacccaataaaagtggttcttccttgacatactgtgtcctttattttcacttgtttcaattactcagaatgctattattagatttgcatattttcataagagaaatttagaaattacaaatgattgaaaacaaagaacaatctagattctttcctttgtgataagagaggatgatcccatatacatgtaaatgtgctttgagtatgttaatcttagaaatgactgaagaaaatgacattctaaagaaaatgagggccaggcatagtggctcacgcctgtaattccagcactttgggaggttgaggcaggtggatcccctgagctcaggagttcgagaccaccctaggcaacatggtgaaaccctgtctctactaaaatacaaaaaagtagctgggcttggtggcacgcccctgtagtcccagctactcgggaggctgtggcacaagaattgcttgagcctgggaggtgtaggttgcagtgagccaagatctgacacttcattccagcttgggctacagagtgagactccaacaaaaaagaaaaaaaaaaaaagaaagaaagacagaaagaaagatgaaagaaagaaaagaaagaaacagagagagagaaagagagaaagggaaaagaaagaggaaaaaaagaaaaaagagaaaaaggaaaaagaaaaaagaaaagaaaagaaaagaaaaaaatgaggttctggaacatcgaagttcaggctaatcacttaaggcaaaggtacaaggatccaaaaaagaaaaagaaattatgaaatatgatatgattcagtttggggaaactgaaaatctatgtatcccatattttagtaactgaataaattggaatcatacatgtattcttttctaagttgaattattaccaaatttgagattcagtgtttagattatttactgcttgcttaaaacttttatttttcaaattatcagagtatttttcaagcattaagaaagttcaataaaaaggcaatagaaatatcaagtaattccaccatacagagataactcctctttacatttgaatgtattctcttacatcattatcgaatactttcatttttatatttgggattgttttaggtatatatatttatttgtatcttttggaccaggaatttttagttgtgttattttataaacttttcctaataaaatattgtttaaaataactttaagaactatctaatttgcatatatgatatgtggtgatacatatggatattcaataatttaataatttctcgaattttgtaatttaagattttaaaatcttttttctcttttataaatgacattgtgataaacacctctgtacctaaatctttgtctgagattctatttcctctagacagatgcctagaagtaaaattaatgggtcagaggacatatttttaaagcaaggttctggataacataatgctacattactttgcagaattttgtgtcaatatatagatatccactatcactatgagtgtctatttcactgtaccattaccagcactgaaaattactatttttcataaatcatgactttgaatcctagtgaattatactttttcatgtttattagatatttgtatttcctttcataatttttctctttatattctttttagccattctatttgactgaacatatatctcaatatcttcatatctgttgcttcaacttcatttctgattgtaacaccatagtctgagctctccttaccttgctctgaatgatggcatcatgtctgcctggtctgtattccaggtttctttgattctgatttattctgcacactgatgccgaacagttattttgaaaatatgctttcatcatgtcagtcctgatcaagaacctatgacagctcctggttatttatctatcagctacattcaactgcctcattcaggggaaaattcatcccattcttggatattcccttatgagttctgttgaataatttaggttattgctatatggaccctatatgcacttacgtttttataagtgggtatttctatataaagacagggagacacaatgtggagtactagaatacaagaactggaaagggctttaaagtacatcaaaaccaactgtctacatttataaataaaaaaaagtggcctacagagtttaatgaactacccatggtcatggagccaattaaatgacagaactaggactagaaactaagttgcattattctcttttagtgacttttagatagagaataataaaagtcatttttacaatttaaaaaatagaaacagctaggaaggcagtttaatttcaatctgttgttatgtataaaagattgttaaaatcatgccacatagaaggcttgagtgttcttttaacatgaataatatgtacttcttataaatcaatcaaatgtatcattagaatttccataaaatttgcacatctgcaaatgacctagtttatttatactttgctttttcccttgctaatctatattgttttatttaatctgctttgccacaataaaagcacagtattttttatcctagcatattgcagattttcactaagtttcttaatcatatcaataaaaaatccaattttcccagcaaattcatataaaagatttcttttgactatagttagggatttgaagaactacctttaaaaaataaaaaaaaaaaaaataggaactacttcaaaatgcctctatttaaatagtaaacaacacgaactattgtggaagaatgtgggctgtcatccatttaatatgatatgatgattgctatatatattcaagaatcccactgtatttgccaaatgaaaacttaacggtagtcactggtttagaaacgagagttaccaaatatatttattatttgtggaagaggggtagggcataagaggtaaatgtggaaatagccatgaatggacctaactttgatagaagctcactgatttcaaagggctgattaacaaagcatgtgtttgcctaacaaaataattgacagaaaaggtatttattaaatcataaggtgattcaactgtttataaaatacaaggtttaaacaaaatggtagttcatcagcagcaatgagagctcagctatgttttctttctccgtgtgtgcatgtgtgtaaccaaacaggtccaccattcacttaacactcaaccaatatttattaagcacctactttgtgctagaaaccctctactatccaaaataagtaaccctgttattttgttacagaatactcgactactctggactgctgtaaaataaaaattaataataatttagccgggcgtggtggctcacgcctgtaatcccagcactttgggaggccaaggcgggcagatcatgaggtcaggagatcgagaccatcctggctaacacagtgaaaccccgtctctactaaaaatacaaaaagaaattagccaggcgtggtggcgggcgcctgtagtcccagctactcgggaggctgaggcaggagaacggcgtgaacccgggaggcggagcttgcagtgagtcgagatcgcgccgctgcactccagcctgggtgacagagcaagactccgtctcaaaaaaaaaaaaaaaaaaaaaaaaaaaaaaaaaaaaaaaaaaaaaaatgtatacctgatataaggtgttataacaaaaataataaattgagtgataagaggagacagatgaaacagcatcctaaatttctcatttcatgtaggatactacttcattaatgacaataattaaacaggcttgaatgtttttcagaaaaacaacagtgattattaccgaaagaataaactgtactttaaaacttcaaattgctagattgataaaagctaaaaaggtaatcacacatcaaaaaagacagagagtgagagtgagaaagtgagtgagaatagaccaagcaagcataaaaacatagaaaatataaaaaagatttatgagatagtactagatatattttttataaaacgaatattagttaatttaattaacattaaaaataataaccataataatgttaaaagataacaaaacataatttaaccataggatagcagtttaaggacactagctttggtagcaaaaacaggattcaaatattatttctgctatttacttgttataatctctttcctactggtgtatttatttagactatttacctcaactttctgctctaaaaaatggaaataagaataactgaacgtagaaaggattgggaaaaaataatatgtaatgcttagtgaccagcacaactaaacattcaataactgtaatttgtaatattatgtgttttaaatgatgtatctaactatgtacccatataaatttaaaaaaaaagaaaaaaatagaaaaatggtgctgatagattttctcaatgcagagttgccacaagccttcagtttgtgaaaaactcaatatctgcgaagtgcaataaagcaaagcacaataaaaataatataaaaaacataataaagagagataagaatcaaaggagtattgtccaagatgtattgttaccttaaaaattccgtgaaatataaaatgtgaaaatcacagaaacacagtcagacttaaaaagaagatgattagttacagaaagctactaaaagcagcccatggtgctgaagccataggcctgctgaaatctggatctagaatcacatcgagatacctagaattccagctctttagagtaatgaggtcaaagaggctccatttgaaatggtggacctgaacctggcttactactttatcacgaggctacaaaaatttggccaactactgcctggggaaacagcttatatagggctgcaggacctgagagctggaagaataaagatacagcattatgataaaatattcatataagaatgaagctgaaagctaccattgtaagatctggattgggactgagaagatccagataaaggcaactgtaaaacccctagttagggacatgtgaacaaaacgaaacaaacaaaacaaaacctgtaaaacaaaattctaaagcataaccaagtaatggtaagaaaatcaataattgtaacattcactccagataaatttgattttatgaaattatctgacaatgacctcagcatgaatatgcttgagatgcttagtgataaagtactcatacctaaaaaagaacaagaaatgattaaagatagaaataaaataagaataggtgaataagagtaaaacttaatcagaaatcttaaaaaattaaaaatgttcattaatataaaagtacaataaatgaaataaaggaatttcaaggaaagaattgagtgtattggaaggtaatgttaaggaattcactcagaaaaaaattgtagcaagaagaattaattttttgaaaatgaaatagcaattgagatactaatcagtaagctgattagaaaataccaatgtttatcttataagaattccagaaaaagaaaatggaagtaatgacaaaggaacaataaagaaaaggataatagctgagaattttccaaaactggagtcctgagattaataagtatatcctgagttcatgactaataattcaaaataaatccacgtccagacacatttcagagaaactacaagatatttaggatatagaataacttttaaaagctaccaggagaaaaagcagattatttataaagagataaaaacagattgatagatttctcttaattaagaatagttgacagaacaatagtctaagatataattgagtaatgtctttaaaatactcaacaaaaaatacccagataaattgctatttaagataaaaaacaaaataagtacatttttagttatatgaaatatatgtattacccaaggtcctcattaaataattactaaaaaaaagtaacaagaaaagtgcacccagaaaggaagccacaggatctaagaataatggtaggcatagtaatatctaaaaatattagtaaatataattaagcattgattatagacaacagtgatcaccacttttgaatatggttaaaaacaaataggtaaaactaaaacttcatacacaattatagtaacaagattgatacttaataggtaattaaaagatgctatgttaaccaccttttttatactaagaagaaggtcagaaatactaaaaggtcgattttatattttcttagaaaaatacacagttcagtatacacaaaagaattttagaattagtgctaaagaaacagataaaccacctacagatttcaagccagaagtaaaatccatgtaccagataaaatcacaaaataagctaaaaaaagtttttcaattaaaaccacataaaacacatcattttattttaatgcgtttaaattcagaaataaataataaaaatagagcaaatatgtttacaaagtaaaagcatacccttctaaatacctcaagggctaaaaataaaacagatattatgaaatatttaaaattgaacaaaactacgtatcaaaacatggtatgcacctaatgagaaaccaggagaaaaatttagagtctgaaattcatttttaaagataataaaaattattgaaagtaaaagggtaataattcaattcaagaatctagaaaaagaaaaatggcctaaaaatataaaaaaaaagaaggaatgaaataacgctaatgctgataaaagcagaaagtaatgatttagactacaaataaataataaagtagataagcagaatcaaaagccagtttttgtaaagaagtaaatgaaacagaaaaatgtctagtgtctaataaaaaaaagcagaagggtcaaataaatattaggaataagaggggaacataaggacaaaaaattaaaaatcataagaatatataaataactttgtacaaataaattgaagtataaactgtgaactgtatttaaaaaaaataacttcccaaaattgactagagaagaatcagaaatttcctctgtggttattggtttattctgatattcaagtctgcctacctacaacctactgatgaaaattaccaagttcagatgacaaatactcagaataaaaaatcccaataatgtgaaaactgtttaagatatagaaaaaaatgaaatgttactcagcttattttgtgaggccagtattgtcacagcaaaactctatagtaacagttaagaaaataaaatttaaagattgatctccccatgtaaacatactacatgtcagtaaattaaactcaatagtagattaaaaaatacaccaagagcaagaatattttttccaagaatataagaactgtttaatatcaggaaatgtattaatatcttataaaatattaacatagtagtggaaaattttatcatattattgatgcagaaaatgcattagataaaatttaactagtatttctgattaaaaacacttagtaaactataaatagtttaggaacatattaagaacttccttaatacaataatttcgatttctcaaaatcccaagcaaatgttatgtttctaaaacatttccattaaaataagaaacagaatagatattcttaatgtgactatcctattcacactatactgaggtttagtaatgcaatatgacaggaaaaaattgaacatttaagaattagaatttaagagaatgactgtcattatttactgctgacatacatgttgctgtagaaaacttaagagaatttaccagtttagttattcaaagtagtaagagagctcagcaaagttgctgaatatataacaataataaccaataaacaatgaaatggaaaacagatatgaatataataatgtaagaatctaagttatatgaggaacaattttacaaaataggttcaagaaatttatgatggaaattttaaaacatgattataggatatgaagatgatcacaaatagagggatatagtatgtcactgggcagcaagacacattataaaaatgtcaattctccccagattattttctaatgttaatgtaattacaaataaaattcagcaagacttttgccaaacttgaccaactagccctaaaactcatattgaatagcaaaagaccaagggagctaaaagaatcttaaaaaggaacaaggtagagagacttatcttaccaagtaaaaagaatattataaagctatggtaattaagggttatggtgttagtacaaggatagaaaaacagtccatcggatcaaataaagatcatataaacagatttgatataggcaaaagatggcattataaattagttaataaagaatgactaattttttaaataatgctgggataactgggttatccatatggaaaaagaataaaatagggtgcatgtagggtaccagaaccaaaaataattccagaaggattagagatctaaatgtaaatgggaaatctttaaaactgttagaagaaaatacagaaaggtaaatgaccttggcatgtgaaaggatttcttaaatgacataaaagcacaaattatgaaggaaaatatcaataagcctagttgagttaatattaaaagctttataaaaacaaatactactaaagccacagttaaaagggcacctacaaattgggaaaaaatctttgtaatctctatggcccaaaatatgaaaatccagaatattacaacaacagcaacaactaataccaaaaaccaaatcaagccaaacaaaactcttccaaaataacaacagcacaacaaataacccaacagaaagatggacaaaagatgcaaattaggcaacacagaagagaaaatcccaatggcttacaactaaaaaaaaaaaaaaagttaatgagatattattcaattccgatcagactgacaaaaattttaaaaagtctgaccatcacaaatgttgtgaagcatgtggagaagctctcatagattgttactgagaatataaattggtacaaatacattggagggaggttttacaatacctagtaaagttcaaaatgcatatttcttaaagtttagcatttctacttctatgtatatatgtctataaaaatgttaactgtggtcttgtttgtgattgggaaacaattaaaataatgtccaacaatgagagaattgataaataaattttagtaatacatacagaagaatacatttcatataaaccaaaatatatagcttatgtaaaactaattcatgatgatagaggttacagtggttttgcttgttctttaccttttgttaaaactttggaaaatttcaccttcaaggggcacatacaaaggattcttcttaggtattataaatattctgcaccttgggttgggtgttgtcacatgtatactcatcaaggtatacacttaatttgtctaattcactgtatgtaacctataataaaataataaaaaataggttcagaaacaaatgttccaaattattaaacttcgtttaacctgggttctggattcttgtatttcatattatcctttatacttccatgtgttttaatttttttttttttttaaagacagagtctcactctgtccaccaggctggagtgcaatggtgccatctcagcccactacaacctccgcctcctgggtacaagcaattctcctgcctcagcctcccgagtagcttacaggcacgtgccatcatgcctggctaatttttgtatttttagtagagacagggttctgccatgttggccaggctggtctcgaactcctaacctcaagtgatctgcccactttggcctcctaaagtgccgggattataggcgtgagccaccatgcccagcctgtgttttaaatattttacattagaaaatgtataaggcaaacaccatagattttcctaactagaattaatcgaggtaaaggaaagcactagtgtcatcttctcttcactatctctgataatagagcccaatattagtaagcacttcacagccaaacatgcctacaaagtgattattttgttgaatcaaaagcaaaagttttcattcacttcttgactgactatagaatctcaggcttccttaagtgagtgaccagagggatatattgttgatatagacagatgctgccaatgcacaaagatcatccatttaggtttttcagttgatgaagtgaggcatgcattgccagactttacttacatgaattaacagaatcaacaggtgatttggtatcagtactgctattggctggcgggtttcacctctggtttcagaaaagaaagagatgataccttttcaatgctgcatttcaagtcaaccatatgaaaagcaaagttttattccagtcacttttctttctctcacattgtggaagaaaagtgccagccactgctactctaaccactaaccatggtacagatgtttgaaaaatgtgaaacagagaaatgaaacaaaaaggaaaccctcaaaaattaagtttcgcataagtgaaaaatacagtatttatgtatcataactgcaaaaagatcaatggacttttttctcatgtattaaacaaaaataaacacaaacattgattttttgacttagtgttttgttgaaaccaacaattacaaggaccaactcaaacatggctaaaagtgggaataaaaataagatttcttttatcctgataaaagattttttatcaccaagaacgttacagtatgacctacttaagtgaatacttattaaagaaacagattcatttaaaaaacatgtttttaggtaaataggaacggtgcaagtgtttctttgaaatcttacaaaagataaaaattaattgaactaactaaggttccttaccctatgcaaataagaaacggcttagaaagaaatgtcttcaaactgttgaaatgtatattccttagttggtgtaaccaatgtgaggtctcagttactataatagcaaatgttctattagatttaagcacatcagtgcaaattattaaaatgagactgtctttgtttaaaataaagctttaaaaaatgtaatgtaatctctgagggagtattgcctgaaatgaaagttttaggccgagctctgccacaatcctattgcgcatcttggttcatctgattaaacatctttgggtctcaaaattcacatacattcacatttctaaagtgagtgtgatataaagtcatagcttgatcatcaaactcctttctagccctaaaattctacgtatctaatgagattaatttatcatgaggtgtttttcttctttcctttgttaatttccttacaataaatagacaaataaatgatcaaataagcaaataaataaatattaaaaagacatacacacactgatagctatccatctgaataggaagaaagacttttttttgtttgccattatctatcccctaatgtgtatttaaaaagagagctcccacagaaaagatttttatttttttctaaatcaaaaatagtgtatcatttatttgccatttaagttctactaagaaggaaaacacaaaatcattatggaaatcctattaggaactttagaaagaaaaagctgatgaaattccatttacaattcaaattgttcattcacgtatttccttttgcagaaactttaaatgctgcctcaaactatcttcacctctttttccagggacaatatccctaactctgttaaaaaaaaaaaaaggctctcttctcacacccttcccacctgtcctctgaggtagttgttccacaaagctaaggtatagattacatcaagagatatttgggatgggagtaaaacatttcaccctggagacagtaatgtgtgcaatttgccaagtctaaaagaaagttaagcctcatcaccactttggcaagaaatgtggttctcatggatggacaatgattatcatttttacacagaacttttgaaaatgaaagtacctggggcaccagccagaaaataagtacgagaatgcaagttttttgcgtcaatatttaaatcagacaaaacactatcagtgtacccttaacagacctgaagcgtctagaaagaatacaaggcagctgacaccttggtgaataagagcagctcagttttatgaaaaggccaaagtcttagggcaaactctctgttgttccaagtgctgatatacctatggcatcaacaaaggcaaaacaccatagggggcaataggcaaggcttctcttacaggcaaggctcctgttaaaggctgggaccctctggactacacactcgaggaaccccaagtgtgggtccctgaggggaggaagtttcctcaaacagaacggcgagaggctgaagttacacagtgtaggagtactccctgctggcagctgaggttggaaatgaactggtgatgtcctagagagggctgcttaaattttctatgaggaggctaatggagataacagtgctcttgaggggacaagagcatgggtctgattaggtttagataactccagatattatgctgagtgaggaggaggttaagggaagctactgatgacaggaactccaacaattgacaaaaactatgtgtagagctggtatatacaattttcatttaagtttcccatctcatatcattctataaagcatacacagccgtatgtgcacatgtgtgtggggttcagaggatgcaggaagaaatctatttctgtgcagttcattttacccctgcaagaacaatctttgaaaccgtctaatgtattcacatttatgttttacaaggaatcccttccatacttctaatggacctgcctggtatgccccctgtaccactatacctaatccctaggcaggtggtctttgtatgggcctggggcaaccacactggtttctccccagtgctctgctctgttagggttcttctgcataataaaatgaaggtcaaaatggcagcctgctaaaagcagcagtatttcagttgcaggaataacttgcttgtcatcaacttgttaatgcaatagtcaaacatttctctgacatgtacagtatcagctaacttcagcagataaagggtctagaacaggaagatgctgcagatgctttagctcggaggaaggcttagcagagccaaaacgtcagcagggcctgtttgttccatactttccatcgggctctgtgaaagaaatgttagattactgcaatgacaagtttgtgacaagcaagtcatttgtgcaactggtgcgctcctgtttttatctgtttaccattcagacttgtgaatgccatttcaagcacttagaggatttctggctcccattaaggggaaatggttcctccatgtttagaattttctacctcaaagagaattactaagcaattatttgttcctgtggtcagtgtcacacaaaagcactcttgagttgtttagctggactctgaatcatgaaatgaagtcctgaagactggatagcttggagcatcaaaaatttcccatctagtttattggaatgactacaaagcaagcctgtgagagacaataaaattatggccagcttgaaataccttgcccttttgctctgggatcatatatcaaggccatatgcttcaagccacataaactcacttgtaacaagtagatcctgagaagctaaggcctggcgatgtcacactgacatgtgatttagcatatgactgttttggtgacaaggaccactttagctgttgagaagagaatttccactgacttctctctataccttgtgggtaactatagggtcaatactaatccagagaacattttaactgtggtaaaataaagtaatataatatcaaattaataactagggccatcctcactaggctgactttttaatagtgaatggagaccctggcagatttgagatcaagaattcaagatcctctcattaggtccttcacctgaagttgctgagtttcttcaagtcattttaacctcctgggacgaaggtagaaaataacagcacatgttcctttccatctgacataaatggtctcagggtcaatattacaaaagatgaagagtgccttcagactcaagaacaagaatgatactctctaaacatcatttattctttctacaattttacatttttgcccattgttggtactgaatttatacataactctaggtataactcccttttttttttttttttttttttttgagatgaagtctcactcttgtcacccaggctggagtgcaatggtgtgatcttggctcacggcaacctccatctcccgggttcaagcgattctcctgcctcagcctcctgagcagctgggactacaggcacccaccaccacacccggctaatttttgtatttttagtagagacggggtttcaccatgttggacaggctggtctcgaactcctgactacaggtgatctgcccacctcggcctctcaaagtgctgggattacaggtgtgagccaccgtgcctggcccaattctaggtataactcttaaagaacataacagaatgaggctttgaagcagacacagatgtacactatctggggaagcaagtcaaagccggaacaggtggaatgtcaaggactagacaaaagtaatgatgtaaagtgaagcagagcttagaaagggctactagagaatgttacagaaagcgataatagtactcattgaataaaaattttattgtgaatgatcctgtgccagacactatgtgtattatacaatttacatgtgtaatttaatcattacaataattctatggcatatgcatgctcaatattttttcagatgtgagaactaaaatgtagggagttaagtacttcacaccataaatatgtaagctgcagagatttgaaaccagttttccattgttccaaagcccatgtactcttaaccatagaagaacgaaagtcatttccactgcctccagaagccttttctctcttgcttactggaaaacatttcagtctggaaatacaggaattcactaatttgatacaaaagggccagtgagaagattctagctctatctgtattgccatccttgttaggcctctgagaaagctgagtttcatcaagatgtcattcctttctccaggcctgacctattcctactttaatgcactggggaagaggtaagtgattctaacctaatcacatatctccgtgctatgaatggagggtgtttggcggcatctccttgtgtccatgacaattcctttctctctcttcatgtgtatagcctttagttcatcctactctttgctcccatattacttccagggggccttcttttgtcacttgtctgctattctgttttaggtgggggaaggggcggacagctttcttaccatgacaaggatcactgaaacagtctcaacttcaaactttgcacagaatgtatcctttgttcggtcttctgctttgtttctctttaatgatagctttgccatgagtcccattcgtatgtaactcagagctatgcaaatcaagctggtaagcaagcatttgcagttactcagtcttaaaatgaatatgtgtccaaccagtggaaacctgagtgaggaatgtctcctgaacattatgtgtggaatggctcctttccttgatgggtggcaaataataaactcagtgagatctgcattatattccctggtctcttttagtgtatgctcagagtgggtcacaagagtggttttagcttatgtaaaattttttcttatagtatttccaattttttttaacttcttgatgtctcccaaacacagaattcttaatagctactgaaaaatccccatgcctgaagaatcctaagatcccagggcaaaaatatggtaaagaacattaaacaacccatggtctgggtcttaatctggtgctcacagtgatcattcagtctctgctgcataccaccagggcacggaactctccactgtaggatacttctttctgttctgttcttccttatgctgaatcttaatccatattagtctgttctcatgctgctatgaagaaatacccaagactgggtaatttataaagaaaagaagtttatatgactcagtttcgcatggctggggaagcctcaggaaacttacaatcatagcagaaggcacctcttcaccgggcaacaggagagagaatgagtgctgagcaaagggggaaaagccccttataaaaccatcagatctcatgagaactcactcaccatcacgagaaaatcatgggagtaactgcttccatgattcaattacttctcaccaggtccctcccacgacacatgaagattatgggaactacaattcaagatgagatttgggtgaggacacagccaaaccatatcataatctatctttctaaaatccccccagtgcgtctagttctttctcaccctaaatttcagttcagagcttcagaaaattattagtttaatgactcatttaatgacaacccttgtgtgtattacataccaacaactgggtttagattgtcctgccttgtccctttctcctcacccaacatgatttaaattcccactctatccctctgacaagccggggagaaataaaagccagtcacacccatttctcatttccatttggatgcaggtagtactggtggcaaagcattcttaatctctttgattttctgtcctattctgtggaaaatctttcctgacaacctcaggcatctttgattgatatggctatttatagattgaccatttaatttattgtccaagcagggacacttttgacagtgaaagggccttataaataattataccaagactacagacttaaacaagaactttcccaggcaaacttacataacaccttgcatatacttttacttcaatacccatctttttgcataaaaactttcatgtctatttttcccaccaacctgtgaacactctttagcaacagaaacatatttttacctatgcagcttcagttcctagaaaagtgcttgtaagtataaagacctgggggtaaatatgtactgacgcacatgcatatgcctatatgcatgtgtatgtgtttgaattgatggtatatttttccataattacattctgtggacctctccccttatttcatagcaaataccaccaacacatgttaacttcatatttttggagatgaatcaaaaatatttcacttaatgccataggaaggaaatggtctgagtatattggtaatgggtttgcttttaatattgacagcaacaaacagaaagtgaaatgtgataaattttccactaaaagtctactgcatatttttttaacaaagcactgaacaataagctttaatcgctttcttcacaagtattataaattgtttcaggccgtgtgcgaaggctcacgcttgtaatcccagcattttgggagggcgaggcgggcggatcacctgaggtcaggagtttgagaccaagaacggccaacatggtgaaaccccgtctctactaaaaatacaaaaattagccagtcatgatggtgggcacctgttatcccagcaggaggctgaggcaagtgaatcgcttgaacttgggaggcggaggttgcagtgaagctgagatggtgccactgcactccagcctgcagcctgggcgaaagactgagactccgtctcaaaaaataaaaataaataaataaatttatttattaatttatttaataaaaaataaaaataaataaaaaataaacaaaaataaaaataaataaataaataaaaatttcagcagctgtatccacaatttcaagtttgtagtaaatgagttattataggaaatgatggtaatttaagagtgatcctttaatctccattaaaatgttggtggcatttctattgctttcaccctcgtcaagcacatttggaagtcctggtaacttttggcagtttttttgcttctgagtaactgtggctttaagaaaaagaaaggtaaggagaaagtgcctggaaaatgtgaaccacttagagaagtcatttcttcccttctcgctgacacatgcagaccattccagaaagatatgactctatactggttaaagagcttcatagaggataatctcacaacttccctttcagtgtttagcactcactattaataacctatctcattatcaaaccttaagattttctgttgcagcatattttgtcattatcagacctcagtgaagaaaagagagaaagccttgtttcccacttctcatcacttgcttaacagctactattagcgctctaccttaacattcctttttccaagataaaaaaagtcaatgtttttgactcttccttgagaatttttttccaaaatgttaaatttaaatttgtttggaggggtttgataattctgtctctctaagatgtttgtattcagtattatctgaaatcagaacaagcatgaataagtatgtaatctatgctcataagaaatcagagaaatatctatatttggcatgcttcttatacattccactattatagctattttaaaatttcagtttgacatttcacactcttgataaactttctataatctacttctagatgctatttttcccacagaggaagtcattctttattttcagtccatcaatgacatttaccaaaccatcacggataatgaaaaatataagacttataagattcaaaagaaacaaagttacatgtctattatttcagagtcttaaatatgtggaaaaaagaagacaatcccacacaaaagaagaaacatggataagcatgctcaggtgtttggtgctagctcaccagctattagtataggtgaactaatacagctatatggaattctctatacaagtgatgaagaagtagtggatgaaatgccacttttgaggtctgctttctctcctgaagaaaactaacaataacttttatttaacaacgttttgtttattcccagttttactgagtgttcatttcagtcctccctctgaagtggttagttatacttatctctcaaattgttgttatttggacactgtacgtaaaagcattgcactttgaaagcatgcatttcttgtcctcaacatctaaaataatgatttgcaaccatttagaagttctggtatcctgttgttaatgtgatttttgcatcactcttccttgcctattccttaaaatataattttaaatgaaaattaatttcattttgaggttttgaaatgcctctaacaataatttagaatacactgaatttgccaatattggaaaacatgtatgtagtctagattatcaagccagaatccaggaccgacctcaatagcatgtcacttctatatctctcaatactgagtctcatctcctactaatcatttcctgagaattctgaagtgctggccacaaaataaataggttagaattttttattttttggtcatttgagacagaattaaaggctctgctggttacgtggagttatatcataatactagctttgccttagttcagcaaaacttacattgggctaagaaagaagataatatattatcaaggcgttgtgtcctggtatcatcaaacgatgggcaaatcgatttcattaggtctctcctaggatatttcgtggaataaaagttagagttctatgtctataacttgcaggatagaattattaaaaatggttgtatttaagtgcattttcccaaatagtgagtttccttttggcagaaaagagacaatgaaggtaaatgtgaaagtatcatcaaccacaaactagtaagctgaactcaagtataatggcaatcttcctgggtgatcagccatagagcaccatttgtgcaagagtctgaatttctatactaacttacttttaaatttcgttgaatacaaacataacaatgtttttaataagtggcttatctattaagtttatagagaaccttccactaaagagattacttattctaatctattcttttgtccaatcttttccccatttttgcccagtgttttgtttatataatattttattctataaaaatctatattatacattttctacctgccttgtctattcttatacattcacaatctattctactcttagtatataatttgaacagattcacatacataaatcaacattcattacttctgggcatataaatggttgctgggtccatgacggctgtttaaataggtagcttccaggccactatgacatagggaaaaactgaaaagtgtatgttttataattattgagtaaaagaggattttcattatggagacatgtacagctatctcaaaggcttatttttccaaaaggaacaacgacactgtcccctgggatatgtgaattgaaaattcagtgtcaacctcttctaaaaaagtagatattttgaggtattaaaaagcgttcttttattagtgataacacctcttacttggggtcgttttgagatgaaagttggcaagtagatttttcaataaggcggggtgggaatcactataaattcataaactaaaaagaagaatgacaatttattggcccaaaaataggggagagggagagatttttttgttcttttttcttttctttttttttttttttttgagacggagtgtcgctcttgtggcccaggctggagtgcaatggcgtgatctcggctcaccgcaatctctgcctctggggtttaagcgattctcttgcctcagcctcctgagtagctgggattacaggcatgcgccaccacacatggctaattttgtatttttagtagagacagggtttgtccacgttggtcaggctggtctcgatctctcgacctctggtgatccacccaccttggcctcccaaagtgctgggattacaggtgtgagccactgcgcctggcctaggagattttggaataaaggtgtctctgtgactaaaaacatataactggtcatagatagtctgtttacctctagtgtcttttggagcaagggtgtgggtctctctgttgagtggtgcctatcattaggcatcacagcaacatcaacaaaactcatctccgtaatatagtagattttacattgtgttaaggtagaccttttaaacaactccttcaagttttctgttgatttcctgccagacagtcagacagctacttcttttttagtaggagtagtcaaggctaaagtcaatacatgtgccttccttgctgagttagaatcaggcatattccatcaacacatatgtcccactgttctcatttctctcactttactatgtgattagtagacaaagtatatactaaagaaagctgaggaagttgctaggatttctaaagaagaagaatccaaatcttgcctactttaggcaaaaaacattttagtattaattgaaaagagatggttaaattgcaacccataaattaaaatgtagttccaaagtgtgtctatagtgatctacaagcaaacataatttctcatattctttttttttttttttttttgagatagagtcttgctctgtcaccaggctggagtgcagtggtgcgatctcagctcactgcaacctccgccgcccgggttcaagtgattcccctgcctcagcctcccatgtagctgggattacaggcacatgtcactacaccgggctaattttttgtattttagtagagacggggtttcactatgttggccaagatggtctcgatctcctgaccttgtgatccgcccacctcggcctcccaatatattattaaaatatattctgcaggctaattctatgttcttatctcattcctgtttcttcctctgctccagaaaggattagtgtctagcataaaacaaacagtatataataaagaacagataatgtatagtcataaaattctgaatccacagcaaaaagagggtaaggtcttagtctagcaggtaagtcttattgacaataataaaggcatgtttctaagccacccatggaaaataccaaaaatgttctctattatatcttgaggtgaagttttggccgtgtaaaaaattatggttaatgctgtgtatgttatgttttatttgccttcattctgggaccacaaaaacggatctaactatagataggggcaggagagcatttgtgtttcttcattagaagctgtgcatgttagtctaatgtataagaattaggaaaacaatactaaatctcttgatgcaggccatgtcataaatccatttatacttatataatattttcctttttcttattctttcaaccttcatgcttcttttttcatttaaaaaactttggggtcagcccttatattaccagatgatttctagtagttgaagcccttgggaaattcatttgtccatccatgctgcctagtttagtacaacactccaaagggaacttccttctaccaaaggcaatgactgattggacttaaaaaataacttctataaatatgacataatatctggaggccacatttatagctggtcaaatgcactgttagccctacaaaaggctggctcataattatgaggcaataacatgtaaatttccctttctgatgagaaactaaaggtcacataggtcctgagttgtattaagactgcattaatactgttcgttagacatttcttttctcagtctcaacaagtcaccttaaaatctatggtatatagcagatcctgagcacctacatgaaaagcaagtactcaaatgttagagacctgaattgaaatcaagattgagatccatccaacttaggagttactgctggttcaatgagtccagggaagaggccatttaatgattcctccaaggaccattaagagttccagggtattcccttggatatctggaaacctgggttacttgatctgagcatgactaaaaactgggcaaagtcttgcatgcttatcctaggttggacacagatctctaagataagactggtatttggtaagctctcatctttcccattccttcctttagagttcatattcctgatgtattcttgtcacaagatacggtcaaggttacacatgggttaagagctcacagcagtccaataacaaacatgttgctgtaatactggtctcccttgtagaccttgaaagtccaatatgctatcatctagggcagttcatgggaaagttgacataataatgcttcaattattcaatttataaatgggacatttaactgatagagtagggaggacaactgagaaacgtttgaagatgtaaatagtttttgtttcagagaacaaccttatctctccaacacagtaatattttttctttgtgtagccaaatttctctaacacgaggctcacacagaagctatagagacttcacctagaaggtctcaatggccttagagccatatatatatttctactataaaacagcaacaacaattttggcccaaatatcataacctaagcaaaaatacaaacaaaatcaaacaaacgaaaactacctagaatataatcttaaaaagtactgcctatatgccatcaccatgtatactataaaacccaccaaacttagaatgcacaatgatgtcatttacttcaatttttataatactgctttttgaagattcctatttttatacgtaatgggaaacatgacatcatataaatgaggcaggcaaacagaaaggtgtagaaggcaaatgcaagatgcctatatattgtctaccaagtgttgccagttgtgaaaggatttgacatgctaatatccattcattcactaagagcatgatggctggcaggctctgcatttaagtgcggttatcgaggcccccaaatattgacagagtgccagattctaagaaactattgatgtacacagccggccacagctccagacacctctcagacagagtctttaaatgtcacagataaatgaattttcatgaaactgagagagaggaagagcaagaggagagaaagaacacagaatgagaggcaggaaagaaacaagaaagaagaaaatcacttccataacactgacatgaaagcatgtggcatctcatctctaaagctcaatcataactccttacacaggatgtgagatcaagccttctgaatgcattgcattaccaaagcactcaaacacttttaatcatttcattgcatggtattttaaaagttaagggagatacatgttacagaatagcttcaacaaactatttctgagcaaaatacagttcaaatataaatacttcccgactcaatcctaaagcaaattaaaaaaatatatatatatataaaggcccacaggcacagataagcattggagccttctaagcagttctccatatgcataaaaggtgaaaagtcaaggtgtcatgaaatctattttatgccaagacacaaatgtgtcctctgacattttcttctccacagtcctactgaaagtagtgacccctagtgggtttattgcacgatattaagggatgccttcttccttcacctctcttttcctgcctttccacagaaaacatctgccaggaaaatatacgagtcagttacttgacacatgataacaaaagtgagccatggttataactagaacgaccaagtattccttagaaatcatgtgtaactcaatatattttaaacgtaaaggaagcttttttactttgaaagttttccatctgctgagggcagcttctcttgaccttgatacactgtgccattgaaagcagtcacactttcaaggttagaatatggcttgtttgtgcatttactgttctatactagagttgtacaatctccacgttttacataaagcgatcatgccaaggcacacaaacaaaattcttcttccaattcaaaagcacatgggtaagttttctgttttggtttttaacctgcagcaacatggtttcacaaagccctagctgcctttttactagcatcacaaaaagccttggtgtaagttatttttctacatctggctctctctgttttggatacatgggactttagcaggtatatacttggagaataaagttccatagctcaaatattcaatagaggttttgtttttgcatcaacttttcagtaatttcttagtacttttcttttttatgttaggagataaaatgaaaggatttagatttcctgccatgggaaaaataattattttccctgtctttaaaggcttttattttgaagacaaaatcagttttaactcaaatggaaattgcagtaaaatctcagacactgtaatcagtgactgcattaaaactctcaagaaggaagccaacttccatgtgaggccacaattcagccaggatcacaaagagacattatccactttgcctgtggccattctgtcattttagactgtaaaatttttatactgtaaaattaaggttcaaggaaatcttctctaactttcacatacatacacataaatatactgatttttgcctgtaaccatataataagcagagaggttttggcttactttagacataggtatagaagacacttaataaagattattaaaatttccttcattatataagtaatagtgttcaccaaatattcagtgattggttaacacaaactgtgttatacaccctacagaaaatactgtaaagttgctaaaaaaaaaaatagacttaaatgtgctatatgacaggatatgacattatatatgctcaatccctcttgtataaagaaaattagtatacatatatacacatatttatgatagataggcatatacacaaacattttcttctggaagtatatgtaagatacttttgatgtatttggggaaaataagatggagaattttacttctaattacatatttttctattctgtttgaattcttcaaacatgtttaaaatataatgccaatagggatatccgagtggtaaggttatgaggaatttttttctcttcatttttttatatactggaaaatttaatatatcatatttcaaaacggaagcatcttcaaaataattatgtaatagtaattcatgttagttacaagaaacttgaaaacactaaaaaagcatgaagtatatcaacaaacagccttgtaattctctgacccaacaataaccactgtcgaatttttgctgcgttgtgtccagtttgcaaagtctcttctgctttgtacagtgtaagtaagaaagatcctttacattcccttaacggggggggacccaaaacagctttatgtgtcatttgttctgctatataccttcttagacaccttcaccaccacaccgtttttagttgccaggacattgttgaaatagcatgctatatgtgacacctccctaaattacacaggttctttattcatctgctattgccccctgaaaaacatgatctctgtgctatttcataatagtacatggcatttcatgatggaagccatggagttgaaggcaacagtggcctcatgctccacaattattatagtatacatactgaaatagtttcgtgaggactcagaaatgttcttctcttctgaatgcacagagatgcttccctgtaaggagctctgtcttagaacttcttcaaagcctaataaagttgaaggaaaaacacagaaaggtgatatacttggtgtgatattttaagcaactgacctattaattataataccttttgatattttctttgctgaggatcattttctgaagaagggtatgaaccttctctttcatgcaaaataccttggtataactgttcatcttttaagtatcttatttgccttttggcaaattaaagaattttcctacctttgttgttgctgttattgaaaagaagataataatgacaataataatttttatagctaactcttattggttgctttctataggttgggcagtttacttacattatttgcatttaattccaaaaatacctctattattattgttgctgttattcccattttatagatgagaaaacccaggcatagaaatgttgaaaaacttgcccaatgtcacaaatctactaagaagtagacgaagaaatctacatcagactcattccaaatcttccttaagattattatctagattagggttacatgactgtactaagaggtccaaaccatgtccagagctttcttatttttctaatactatggggggtgaaggggagtgggaagagaaagagagcgagcgagcacataagattccaaataaaatgttataaaatttatctaagacttcattttcctcacctctaaaatggacagcacccatcacagaggtttatcttgaggaccagttgagataatataagtgaaagcatctagtacaactaaaataaaacaccattattgctctacaagtttccttcctttgcataatggatatgttctggataaggtgattatgaaaaggtataggcttaacttctgttgtcaaatcaaagagcaattacactataaaatctcagagaaggattcccaacagattgagatgaagacctgatgtaaggcaggggttcaggtggaggctgggtctacagatttactgggagcactctgtgggttggtaacacattctagatcctcttacctctctctcctcaggctccttggtctgaaaattcctgagtgtactacagcagtttccagagatgattgctttctttttcttttatctggttacaaagtctagtggaatttatttgcaatgatgatacttcacttgaaggccttatcccacacattatgatataaaatagttagaaattcctttaatgtgagattctcaatcagataaattcactgtgctctatttactctggatgtttggttacaggtttccatcatattattaataatacttgcattaacttcctcatattcattacattgaaaggctctgagttagaaaatatgtattctactttcttggaaaccctacactcactagtgaggcctataaataaaatgaaactttaaatagtacgaacttcaccttcaactcataactaaacccaactctgggcttaaagtgctattttctccctccagtctcatcagatataagtatatcatgttactaactgaggccaagctatatatttacacaattcacttcatactaacaacctgctgcattttgttgcttgccttttcttgaggtactgggacttactcttaaattaatgccttagtttttttttttttctctagggacatccttttacttatggaaaatattcagaaagaatggaatttttaaaataagccatctgctgcgcagacctcaagaaaaacagttatgtttgaaaataccagattcaactaatgaggggcacaaaagccttattaactgtgttagctttcttatctttagagctcaggtaggaagtaagagccgacctcagcatgccaacaggtatcaagtgagagaggtcagcacagtctacacccttatgatatagcttgaacacatcagctcagaagtactcttcataaattctaaaaagagaccttcttccagattatctcgcacatggcagcagcctgggagtccttaagacaaaactctctagttctagaacaattcaaacaaggtgcatttacattatatttaatattttgctgtaagcagacgatagaatctactcaaaactatctctatttcactgtttgcccatattcccatatccgtcctttatttctcagcttatatctttcttgaatttctaaagataagaaatctaatttattcatgtattcattatacaataaatattaagtatctcagaaaagggcaaataaatagatgatagatgattaatagatagctaaatatatagacagataatagataaatagctagataaaacagagatgagttatggcctaaagaaatggctaaggaagaagattgcatattgaggatgttttaaactaggtattgaaggatacttgggatttcaaagtatagagagcaaggagaaatcatttcgagcagaataaactgcatgaacaaaaaggtcatcacacgttgggaaaagcagattatttggtttgtgaaagagagtagtaaaaataaaactgagaaggtaaattagggttagatcacatgagagttcgagtgccaaccaaggaatattactctgtcaataatctaggtttgaggaaagcacagtcaacaactctctagctttcataatttaagtaatgagtattataatccaccaaacctctggtctttaggctccacaggggatacgttagatcagtggtagagaaaaggtcctcatatttaatgagtcctcctccagctgagattatcatgctgcatctattgaagttaatcatctcacatgatttgaacaagaatctcactagttcctaatcacactagcattggcccttcattctcaataacaagttctatagagttacctaaaggctgacactgaggctggctgagatgagagcggtgagtatcccaagcacatgtgagatgtctgtagaaagtttgacataagctgtcatttgattttgaataaagccaaattgttcataagtgattggttacttatatatgtctagttcaggttctccctatgatacagaaagtcattatagtatacgtggaactctgagatctccttacacatcttttaaggctcactcctaactgtttaggattctttgatagaaggtgtttcccagcaccttctgttatgctccctctttattgttctctagtggacttactgacttctgatatgctttgtttttatgtatgtatttgtttactttctgcctctcctctccaaatgttaggtctttgaaaacaaggattatttgaatgtgcctgttttgctcactgttgtatctccagcatgtagaagagatacctattgaaagactgcttttgaaactgaagacaaaatatagaggaaggtaagcacatattaactggtatatgggggaaaaaaggcttctgtataaaactccccccaaaaactcatatgctatataatttgaaaatatcatcagctaattatgtcacggacgaattttctataaaactcaaagcacttttaaattaaaagtatgtattttttcttcctgttactgaagtaacaatctcattctctctattttatacaaagggaaatcatggcagagagagagatactctggagtacagcagatgaattcagagcttctgactctaagggccatctatattctatgcactatttaatgttagtttatattttactaccagtgagatttaagtgctgaattgaatagagtcctagaatttgtaccaataaataatgttattaacttatgctctttctgctagcacatggccttctcacagatataagcaaacaaataaataaagagcaacacagaaagaggaaaggtgaataacttaaaggggtgaacatggttgttcttatttttaaaatccagattgttcattttcgttgtaattgtattgtattctactggcagaaagagatgagatttagtgtactatgcaaattatagtaggtccaccacagcttatcaagttctgagaacagtatggtttctttttcctcagatcctcttttacccttaaaatatcttctggattaaaattctcattcaatgaaccacatctttcaatataaaaaatgaaattataaaagtactaaaagaaaacattagtaaatttctttataatcttggcataagaaaggactttttacctataactcattatctagaagctacatagaaaagattagtaaatctgattatatttacaaacaaacttcagtatggccaaaaaatccataagtaatttttaaaagtgggaaaaacttatgcagctcacatagataaaaggattatcatcttaatgtataaatagcaagaaatacataagagaaagactaacaacccaatagaaagaaaaggctaaggagatgaacagacaccttatggaaaaataaacgctaatgacattaaacatattaaaaaagatggttgacatcacttataattttaaaaatgcaaactaaaactataccgagataccgtcttttaccaatacaattggcaaaaatccaaaagcttaaccaagcactattttatagttgaggcttgggtaaaaaggtacttttatatatgccaatggagctgctaattgatccaactcctgtcgagatcaatttggcaaaacttttcaaaattcaagatgcatataaccctttgatcaataattttatttctgagaatttatcctgcagataaacttgcacatctatgaaatgatttatatataaggttgttcactgtaatattgtttgaaatgaaaaaaattgtttatcaatcgggactgaataaaccatgatgcatttatataatggaatactgcaaaactataaaagagattaaggcagttctctatgtatcaatagcaaaagacctctaagagatactggagaatacaagattgagaacagtgtataaagtggtttaacttttgtgtaagaaggtggaaggagggaatatatattcactttttttgcataaaaagaccactggaaagttacacaaaaaaaataatgaataaaagtggttactaatgggaatagaaagagaaaaaggtggatggggagaagtgaagacgtttttacatagttttgatttttgaaccctggaaatatatagcctgcctcttcaaatatatttaaaatatatgtaaaatatatttaaacaaatatatttaaaaactaaatgaaagataatctcatattaaagtaaaaatgagaacagcatagcaatgataaaaatggttcctgagctccataaatttctcccaacttttagctaccggtgcagccaatatctgggtaaacgtggtaaaaaaaacttggcagtttggtccaaatggcgtctttggagcaaaaaatgattcaggttcttccctttgactttgtagcattcttcagatgttattaaacagttattcctttctaagctcaatcgagttaccagtaaaatataaaatgacattagtgttgcagctgtgaactagttgggatgaatccctttaaaagcctaggatgatttccatgtgttgagtggagaagacctggatgtttgcttgttgctacgtaataagaacaaaacacatttcttgaggaattttaatgtgtaaaattgtttttaaaaataagtaaaatctatttattaattatataatatttatcaatcttctataatacttaggcgatgtactcagtatgcataacattcttaacaggaggcagaatacatcattaggcagatgatgtatgttgagtacttagaagttcctaaaggagaagcctataaagacagtgcattataattaataataaatgtaatagtataatttttttgtaaaataagcaacacatttatccactagtcagaaattatagcttcaattcaataagctgctttctcatgtttgtattgagaatgccatctagaacaatctagaagccacagacaagagcaggggtgaaagctcctaaatttcctatttccgttgtcccatgactttttggtaaaaagataatcagtgaattacccattttgtgtaagaatttcttcctctgggttctgttcttattttaggcaatgattttaaaacatggaggtaggtaagtagggagtattcattcaatcattcatttgtattaattaaacaccaagtatgttctgtgtatttcgctaacattagaaatgcagagacaaaagacataatttttgcccccaaatatttcaatctagtggggagaaaggaaagtaaataaccaactaattataacacagggtgaataacctgctgtaattgacttaagcataaatagctgtgagagaacagaggcgtgggactctgacttttaatgaggaggctcaataacaagttttgaggagtgggtgccttagctgaaacttaaaggatggaagaagttaacaaggcaaagatttgagaggatagaaagggattctaggtataggtaacagaaaaaaaaaagtacagagcaagacagaatatgatccattcatgaactgcaggtggttccagacagaggatagagtgatggttgggaatgccaagaaatgagttttcaggcccatccagattgtgatggaagcactactttagataaggtgataagggaaggcggagatctgaatgaacagaaagagacagccatgaagagcttggtgagaacaacgttcccagcagagaactgtacttattgcacatatatgcctattttaaggaatggttaaagagctaggggaactgattcctggttgtcagagatgagcagcactattccaaatactcttcccctgacaattatctaatctcttttgttgtctctggaagcatggttctttcccatcaatgaattcattcagtccctgtaatcaactctgattagtgttgtttaacatcaatcttttctactttttttcaaagaaagataccaatcagttgctgcacacccctgcttgttaaaagcagcacctctcctgctgacttaccgttcttttaatcaaaagggcaggaggaagcagttgggattcacttttctttttttttctttcaaagtacacaaatgtcaacttccttaaggatgtctggcatagctgagttcagtcatgtaacatacaaagtcagcttgatcaaaaggttgcaggctgcccactgctaaaatggaagagaaaaggaaaccatgggcttccctgaagtgtgaatgagtgcataggccactgccacgtgtgtatttatactgaagacatgctgggctgacaagggagattaggaaacataaatccccaccactacactgctctatcttcacctttgaacctctggagcagcactttctctctttcctatttcttctgttgtgcccagtgaaggagttactatatagctttatagcaactgcaagccatggctatttttgaatatttaaaaaaaacatttttgcggccaggcactgtgcctcactcttgtaatcccagcattttaggaggttgaggcgggtggatcacttgaggtcaggagttcgaggccagccttgctaacatggtgaaactccgtctttactaaaaaaatacaaaaattaactgggcgtggtggtgggcacctgtagtcccagctacttgggaggctgaggcaggagaatagcttgaacccaggaggcacaggttgcagtgagccgagatcacgccactgcactccagcctcagtgacacagtgagactcaatctcaaataaataaataaataaataaatgaataaattcttttgccccaacatttagttgaagtttataattctcaatttgcaatatgaggttataattcacaatatgcaatatgaggttataataatctcaatatgcaatatgaggttataatcatttctatggatttaaaagtgttaataactagaaaaagcataaaactgttcattcattttttttttttttttgagacagagttttgctcttgttgcccaggttggagtgcaatggcatgatctcggctcactgcaacctccgcctcctgggttcaagcgattctcctgcctcaggctcccaaatagctgggattacaggcatgcacccccaacgccgggctaattttgtatttttagtagagacagcgtttctccatgtttgtcaggctggtctcgaactcccgacctcaggtgatccacccgcctcggcctcccaaagtgctgggattacaggtgtgagccatcacgcccagcctcattctcttactcttttaataaatcagtatgtatcatgtgacaaacctgtatctgccaatatgacaaacccttgtcaataattctcctggaagatgcttctggcaacccagaaccagaaaataatttttccaaagagttgattatcttagactaaactaatgactcaagttggttttacaaatagggaacactctgtaaatactcatggacatatctaaacctgaacatacattctcatgaagcacaaaaatcatcatatatggttacagtccccaaacaaggctgcagaagaatttaacattcgtaacaatgtacagctagtataattacattttgtgcaacctcgtaattctttaacagtacaactgaagtgatgagaaggtacatactgatataaggtaacatagctctgtgttctagccaaaactagaactcaggatccattatttttaatctaggaacttttatgtgatgaccatttactaggaagggttgggagtaaaaagcataaggcaattgatatagagaaacaaggatgctttaaaaaaacaaaaacaccagtctaaaagaagactattctttactcacttgaaatggctctgaattcctgggaagagcataggaagaaatgtaactataggatcacttttatatgagtaaattaataaatcatttcccctatgttctctaagaaatcttttagaacaatatttcccaaacttccctaatcataccaattgactagtttcttgtttcagatccaaatgccaaggccccttcgtgaaaatttcttattctctaggtttatggtagactcaggaatgtgcatatttcaagggtgaccctgatgattcttagttcagggatgtttgggaaacactgttctggagaaaactttgtacaatagctaaacatttcttcattcctaatgaatcatcccattttaatgtttctgtggtgtgtcttaagcaggtgcagactctcatagcaaaccataaactcctatgttcctttaaaatagcttaagatacatttactcagttttcaggattagcaaaaagtcaaatagggctgttaactagcccattcccacagaagcaccaacctgtaattcccaagtatcaattctaatgtgttcaaaaataaaagcatatgcttagtcatgtaacagagggtttctttttttacttttatttcattgtctgtcaatctggttgatcagattactaatttctactctactggaagtgatctttagaaaaacaggtctgccatgtttgcattacagagatattaacaataataatgatttttaaaaagtaaaccaaacataaataaacaggaaaagaaaccaccatatttgagtccagtctttgtcctgcctagtgaaacatctgtcttatacctttttgacaggcagaaataagacctttcacatcgcctcatctctctgataaatcagtctatttccttacaaatttggtctgagacaaaactcttctgctcttccacttaccatttagaaaggcacagtcagaaacaccatctaagatgagctcacttctgggtgtctttcagttagacttctattaaatggataacaagaaaactaaccaagaaacaaaaatattcctgtcacttcttttgcaacaattccacaatcttgaggaaaattgaattttgaagaaaagaatggtctatgccatcttacaagcatgagatggaggagcaatgactataaagaatattcgttaattttggttgtactgtagttatattacaaattgcacaattaattcccactatcaaattacactggtaaacaggcctagattaaaaacacaagcctgctctgcttgttttgctctgttatacacaaagtaatcttaaattcagtttattatcattagtatggtttcactttgggggaaaaaaactctttttcctcataaggcatattgcatattgagatgatgaagaccaaagtcaatgctgtagagagttgtagggatataactgctgctaaaataagcacttggtttagtagactatttcccttagacgcttggagcacaataattttttcctgctgggagacaatgtatatcctgaatggggtagggcctgaaagacagtgaaatacagccggaaatacacctgatggcagaatccaccaggatcagacagcatcaggacagcattaaacacagtgtttgaagatagcagaggtatgtggactctcaaggaacactgaaagattacagattgtaggtgagcatggttttgagagtctatctctgctagccacaagaaaattagcagtcaacatttgcaaggtctgtttaattatgtcagtgaccagagctagcctcccaggttaagtgagaacgagaactaacaagctgcccctagcctccttcaggacttaaatgataaagccatggcaatcacagcagcagcagcagcagcaaaagcagcaacagcagcagctgaagcagcaacagcagcagcaagaacatggttttgacccgcagttcttgcccatcaaagagctgtgccctgtctgctcccactgacaggcagataaatacagagatctgttggcaagtacatatttatgtgtatctacagttccctcacacagacttacagagaatgcataacagcttctagtggtataacaaatgcacccactaatggggtgagacccattactcacaaatgggtgaaaagaagcatcaatatgcaggtcttaaccccagtttgtgggcagaaacctgtcattccattgcaggccgataggtctcctattcacacagtccttgtttaattttccaaacaccctttctctaaatggtgctactctgagctgtgtagtgcagacagacaggtttgacaagcagagctgtcaatttcacatttttcatcccaactgcagggcaaaattaggccttgtacgtaactggggttgactggttaggaaggcaggagaggttggcatttaagaggtattttccacattagaaactcagaactcaagatagaaaactcaaaaagggttgtccctattcaacatccatgaaatcaggagagtccaaagatgtgtactggtggtctactgtggggcatatacattttgctgaaacgagaagatgaagggaaaagtaaagcttggtcctatctagaaggagctatgggtaagtaagtagtgaaagacactcactcaaataccataatataaaaatggggcacttgccgtaagagaggaacatagcaacgtgtacacacaattcttggttaaccaagaagttgaatatataagtaatatattagtcaaatttttatccttcaaaaaattttggaattgtccaaagaaaggccaacaggatacatgctaggcaatgatgggtggattaggcatacaacgaaagcaagttaaccagcgctgtttctaacaaccaagtcccagaatatccttgggatctctgggactatctcaagcatataacatgagtctgggatggttttgaaatctctgctagcatatgctctgccctgaggtttctttttggtgctgatttggttgaactgaagaaggaagggagaacacatagaagaagagttctctctattttcaggcggcagtcctatctataccggtggtacagttaagaacctagaatgaatgctcctccagaatcccctgtgcagatcgacactctatggtatatgagatctcacagagtcttgcatatcagaaactcacaaacgggaacacagaagagtctgtgtgtccctgagtttatgctcaagctgtcaaacatcaagagtaatttatgttgttcaggaacatactataacaaagctctcacaggttggaggcttcagtgagcctgagggctcacttcccaacctggacttaccccataaggagcaacggactttgctaacatgaaatcaaaaggcaaaggaaatcaggcatttaggaggtattttacagttacaattacccaatcctaggttggactaggattggggttggtggggaaggagacatggaaagtgctgttaaatgttgtttgaaatgtccctttttgatccccacagtcatgagtgtatttgagtcttgattgctctttacttaaattattgtcattgcccctcagttggcatctctgactaatcccaaccctctcaatctactctgcacactatagccaggttaacttctaaaacatgcctttcattatttttgcttgtctctgtaagtgtttcagttattcagcaaatccttattgcattctaactgtctgatagctattgttctcatcacccacaaaaaataaatctggactctgcctgccttttggaattcacatcctagtcttcaataacatggctctcatttctagtttcactacttcctgtatacaccaactttatttccattggttgatatttttcttcatcctccctacttctctgttttcccatattaaaccattggctaccatctttgcttctttccaaaagaccttttattccattatctttcaacgtccagcttttacatctacagctaaagttctccgtctactattaatcaagccttctatactcctttctaggccaccataatgcagattcttgtagtactcactacctttcgttattgctcatgttggtgcataatggcagattggtaatttccagttagttttaggatctaattactagtctctgcaataagagtataaaaaccataagctctctgtgagcaggtattgtgtttctgatagtaacattattaactgttgtgataactgtgaattaagtttagcatcatacttatttctaaatttaaattgtaccacttctaacaaaattttctccatcgttttattaaaaaaaagtccaaaagaggatgacaataacaggaacacaataaatatatatccacatgtaatggtcagtggtcttttccagtgacaataatgctgcattttgctattagctcctttcttttttacgtgatattcactattagacatactactacactaatgccaacattttccagtaaaaattgacattaattaagctttggatgttgtcagcactagcctagggatagggtaggtttagggccactgagaccaagttcagggtataagatctctgatattcatcaagcagctaagataagaagcataatgaaaggcaaaacaaatggtacaccatatagtatgccgaatatttttaatgctgatttttgtagatagaacttgatatcagcttttactcatttgttattgatatatgtgtattttcttaaaatataataaatatagaaaagggtttgtgaataacataatatgaagatcagaatcaagattagagccaagggcatcagattaaaatgcagatgaataatgaatcacctgtaagattaaagctctaattccaaatggaaagaaagcattggcaaaggcatacaaacatggttctagtgtggtgttcacagttccatgaaggaaaagatgaagcagataggagggtgggcctactgtatggactaggtactggtattaagggttttgtattaggcaagaagacaaaaataattaaaagagtttggactggaagactgggaatgataactggggatagtgaataggatggcctaggtgtacaatgaggtcagcatttagcacatcaggtggccaggactaggacctaaccaagaagctggaaatagaaggaaactccttcattcattatttgaccttacatttttttattgaataatagtagtagactgatctatagacctaaaccagtggatcaacagacctagactagaccatgcttaacagaatttacagtttggagggaaaatagacatgaaagacttaagtaataagatgagagcagccagagacaatgagtaggtaataggagtgaggcccaccaaagaagtgatcatatatcagctacttgaaaccagtggtaaaagtaaactcagtaccaagctcacttcatccaaagcatggattccttatatgttctctgcttgggataatattaagatcaatctgtatgtaaagcttacacagctaggacaagcaaggattcctaggtcgggggagtgtgttcacatatgatggtgtctgtgcatgtaggtttttttcctaacaagtattaaccatgatcctatagcataagagtgagtgatgatgaggaggatgataatggtaatgatgataacagcagctgtttattgagtgcttattatatactaggtattggtttaaatattttacatttattagattacttactccccacagtaattttataataaaaacaaatttatggtcccccacctccttctcctcatccttaatttacagataaagaaactgagtcatgagaattagttttcttaaggttacagtgttgtagaatctacgtagtcttcactcttaaccacactgctctactgcctaaattcaggtaaccaacaaaagagttgccctgcctcatcttggagcttatagatgtctacagaatatattgagaaatatatatgagaaatgatttaaggatattcttaccagagcagtagccattctaaaaattatcacaatggtatattatattgtttagacataaaatgagagtattggggtaacatatatcagagatttggctcttacagattttaatttttaattgtactatttaagggaaaaattgagtattgtgaggagcactggaacaatggaaaaggtaatatggaaagtaaaaagtttagtctcagcctggtaagtgtggctgtctatctcttcaagcttcctttcctcaacggggtgacataagggttaataggatgactgtaaaatgcagttaccttatgaagaatgaaaaatcccattattactgagatttttcaaaccctgataattctgctgggattttctgaaccatgataattctgctgggatctggtattaaacagcatgtagacagattaatcccaagcccagaaaagagcaaacaaataaaacataagtagcataatgactgaagaaagttagattgtagtgtccaatctcatagtggccactttttttgtttgtttgtttgtttgtttgtttgttttgagacggagtcttgctcggtcgcccaggctggagtgtgcagtggtgtgatctcagctcactgcaacctccacctccctcccagtttcaagcgattctcctgccttagcctcccgagtagctgggattataggtgtgtgccaccacatccagctaatttttgtatttttagtagagacgaggtttcatcatgttggctaggctggtcttgaactcctgacctcaggtgatctgcctgcctcgcctcccaaagtgcccaaagtgcttgggattacaggcatgagccaccgcgcccagcctgtagtgcccacttttgacaaagttgattgttcatgtgggagcatgaacatgaaaatttaattacaaactaaggagaaacatacttaactttgaatctttcctattggtttcctggagtcaattttaaagtatcacttaataaatactatttgacaatttgcaaatttatataaatgtattttccttagagtataagcattcaactccaatatgatggtttcctattttcagtttgagtaaatatcaaaatagaatgtccctgttagatatctagggaatcacttttaggggacactatataatgccttactaaataccaagactacagtactattattttcacaagtgagcatgggtcaaggcaaagaagggcaagttggggtaaggatgtataggctgttaaccttgctgcacaggtaaatgtaaaagttccttttttctagcctcaacatgctggaagatcctgactttaaactgagtagagaatgtcttaaagcaaagaaacaagaactcctgtactctgaactttgttggggagttctggccccttttatcatttgatcgtcaatgaataatataactgcgtttagcccttaagcctgtatcagctgcaaacgtgacagatacctgtcatattttagaacagcttatcgcctcagcctctggagtgattgagtatttatagacacaaagatagaaacataaagcacatatgtataggcaggagtcccctggaggtggcgattaggactaggcagtaattttagcttgaagttcctatgacttaaatagccacttgagctctgctcttgcagtttacgatgtcaatagaacccctaaatgaaattacagccttctgatacgcagcaggatatcctttctttgccatgcaatgtacacggccaggagaaattgctctgtatatggagtttcactaaagcagaatttatcataaggctgctctgctaaaatatcattatgctgttattcactggataacacatctaatgactcgaggtgcacttgatagccatgtttcagtgaacacagacgcatgccctgatgtgaactgggcactccagtacttcaaagcactatcgatttcaattctaccataatttacacctggcttgttttgccaatagcttgaacccatgctaacactggaacatacacatacaagctttagaaagatcagaaatgaggtgtatagcaaaaatgaatgcagcaaactctccaggattttgcctttataatcatctcccttgatgccgattaaatattttgcacgattttcctagttaagtttgggcattccctctgttagcattatcctttggttggtgatgatggtaataagaacctcttatatttggacaagctatggacacttctgcagcaggatctgggtgccagtcatcttggttctcccactatctagcacaatgactggcacataatagttgctcatgataatctctgcaggctcctcttcctctctccattccagaaatgcactgtatataaaggaccttctcccttttgtcatctttcaatatatttttcctgagaaatgtccactccataattttaactattaccatgatttggatgattcagatgactgccaaagtctgtccctgacatctccagcattcctgactaaatccaactgccagtctggatgctcccctaacacccccaaattaaacaccttcaaaagtaaatttgtaatcttcccccatcctccaaaatctactcttcctcctcatagcttttcttgcttagttgtataaggcagaaacctgggagcaatccaaaattccttctctccatgcccagcccaaaggttattaaattgtgtcaattttgcctatctcttgaacatatctcctcctctctgtctattcccacagttattgtcctagttcagggcttcattgtttcctgtctgaacaatttcagttgcctcctaactcattttcttgcctctattctcccactcctataatctatcctctaccctgctgacagggtgatcttgtatcacacaatttcatcattaaccttctctacttaaaacctttcaatagctccctgaatgccacaagatgaagttaaaacttctttgcatggcaatcagggtccaacatgattgttccctgcctgcatctacagcatcgtttctctgtactcccctactacacataagtgatagtgttccccagctctgccatgctatttctagttaactgcctttgcccctgctggctcccttactgaatgttcttcctccctctgaccatctgggaaaatccttccattcccagcacggatttatcagctcttctgtgaaacttcctctgatcccccactccaagatatgttcagctgaacactcactgtgcctccatggttccttgaacatccttcagttacggcacttagcataatggtattaccccaacttgtttccctatctgcctctcctctagtgagcaacttgagaccatgttgtattcatctttgtattgtaaatgacaaagccaatgccttcacaacagcatattagggcccatgtgatcagacacccttgtctcccttacttcatctcctactagtctcatgcttacccactcagattctgccacacagacttccttgttgtcactcaaactttccagatacattcatgtccaaggcctttgcacttgatggttccactgttgaaaatgcttttgcttagatatccacaaaacttgcttcttcactttcattgaggtcttttctcaaatgctgtcccccaatgaagacttccctctctacctctccaccctatttaaaattgcaaacttatccctgacacaaacacacatgtatacactctttctcctctttaaattttctccatagcacttatcataaaatgccacatattttacatatatatatatattttatcttctgtctctcctatctagaaagtaactacaaggagaacaaagatttctgtttttttttttctaaatctactgcagtatccccaacccctggaatagtgttgggtacataatatgaattcctcaataaatatttattaataaatgaatcaatctttagcttcttgaataataactgacacagagtagggattcaaaaatgtttctttcctttttttttttttttttggtttgttttttgagacacagtcttgctctgttgcccaggttggagtatagtggtgcaatcatagctcaatgcaagctcaaactcctgggctcaagggataagggatcctcccatctcagcctcctcggtagctgggactacaggcatgtgccatcatgcctggctactttttaaaaattttagtagagatgagatcttgctatgttacccagactggtctcaaactcctgggctcaagggatcctcctgccttggcctttcaaactgctgggattataggtgtgagccactgcatctggcccaaaaatatttcttaaactaaaaaatacatgggtgaatgaatgaattaatgttaaatccatctttaatgaatataatgaagaaacagtctgtgtacagtacagtctgtgtacagtaagttgaatgggttactattatcctcattagacaaatgaaatagatgagtcccagaaaggttaggagccaaaattaaagctactatacatagcttaaacaggtttgctactctttttcaattcactattgaaaggaacagacaattctttgcactttgttcatgatgtacctctgacatttgttatacaattttgcttcctcttgactaggaatgcaattagcaggaggtgcaaggtgctaacactttttattacaatttatgtctttccatattaggtgtttttcataaaaaagatcccctttctttaattttcacaagtggattaggcactcatataattttgcccttcggagtggtttgtacatgactacccaggaggacattgtgttacaaatcctgccagaatgaactggaaggtgagtgcagcattcatagcttaaggatgaacaggttgtttggtgccaggtttgtactaatggagatgttctccattagtgttaactcccaaaggagaataaattcaataacaaaacatttcagtttttggcatttctatggagagttaactttccattgttcaagggttaattatccattatgtgaatcacttttctttctgtggctgcttacatctaggaattcagtttactagagagtgagcagggaaaataaagagacgaaaaggaatattctatatatataaactccaggaaaaaaattggtttaggggacagaatgagatatagtttggggattgctaagttgattgacaattgaaaatgggtaagattaaagcatgttttattatacacaatattttgggttttttttttaaattgtttattagggtcagtttgtagtacatgcagttactctctggatgtgattcttgtcagcacaataccatctagggtgctagaatgggcatttagcaaatggtactttagaggctagctcgacttggtgcccctctcctctgaagaaggcttagtgtgctgcagcttaatgaatgaaacagcactaagtgattccacctatttctctactcattgatgagaaacaactgcagtaggctattttcagctattatttacctcaaacagggcatttaattagtgcttgttaagacagtgcaaatgatttggctgccagtcttcttgcccctgctctttattgtgctgtatgtctgccccgcctctctcctgtctagttcacagggcatccatagccagtcttcatgcctttccataactgacatcagcctgacctccacggatgtggaagtttgaggaaaggaagaacaagtattgacaagctggagggactgttggttaatatgatgcattataggtaagtctggtactttctgactacatgagctgaccaagctggatattcggtcaccctcataagtccaggaaaatgaatggaactactgcaaactgaagatcccatgttccatcagaaattacccaagcattgtggggaaccttagcaatcttagtaaatggttggaaatgctgtcagatagttggaagatctaatgtgggagttaaggaggctcagatatagaagactctgccaatttgtgttctagacatggacatgtttttttcttttcttttctttttttttgagatggagttttgctcttgttgcacaggctggagtgcaatggcacgactttggctcactgcaatctccacctcctaggttctagcgattctcctgcctcagcctcccgagcagctaggattacacgcatgcgccaccatgcccggctaatgttgtatttttagtagagagggggtttcttcatgtttatcaggctggtctcgaactcctgacctcaggtgatccgcccgcctcggcctcccaaagtgctgggattacaggcatgagccactgtgtccggctgtttctttcactatgataagcaagatgtattcactgtcaatgcactgacatgtagatatccattcattcatcacctattcattgatcctccactcagactgagccaatctgacactggttgggagagaaattaacaaacctaaaacacaaaacctgccctctaaccacttgcagtttcatatatagaaaaaacttcaacttaaaagcatatataaatgctaaatgaaggtagatttgtaaaatgctaccagtgtcagatcacttttaatttgggttttatggaaaacttcagagaaaaagtgtgacttgtcaaggatatgatttggctgatcttgaaaagttatcagaaaaattatggttgctgatgctaatatgtaaatacagcatcaaaatatttaacatatagtaaaatagctgagaaactaaaatgggatcatctgtatatgtactcagccttataaaataaaatgaattcattaaacatatgctcaattttaagatatcaattaatttctttctacttaattttaaacttttatatatatagcaattaatattttgaagctgtacataatagaatttaggttgataagctaatatgtatatttgctgaaggataattaccaaacttatcagctaactacatctttctttttgcaaatactgttcataaatatttgtgtaaactttcggtgttgtcagtgtgataaaaagtcagctacatttcatttatggtcattatgaccaaaacatttgactgaaatcaaaggcaagtaagcctggctagaatttggtcatatttttaatagctgaatatagatatatggttgtgcgtatatgtaggcatttataagctaacatacatatacaatcatatgatacaagcaatcaactcctttttaagtttttaaaatatatgtctttcttaggggaatcacataaatactaaaaaccacttctatataaataagaaagaacaatttcttattggggtaacaacaattctgttatttagcaatttgatttgtgtatatctgcgactgcctaattaaatgaatatagcatataggaagtacttacagctaaaatatgcacgcaagaaaatacacatttcacaacatgcatcctcattaatttaatgaaattagaatttccaggtgagcactaggaaattgagttattgacagtgcattgtgaaggcttatgatcaaggtattgaaaaaataagtaatattaatatagccattgaagcacaaaaaatacatcgtcttgcctttgtatcagaggtacactaatcaaattctgacttcttatatatttcaatttagtcatgaaattcttccacgaccacttggaactccaagccttagcaactataagaaaaatctctctggcagattatatttttttaaatgtcatgtcttgggaatactcttaaatatttgttttcacctattctcttcttaaagttgcttatataatttcatatgtagtcattaataacatgttttcaaagtgttagagatctagcttgccttcaacgcagttctaatagacatccctaccagaaactatgagacagttttcctgggagtctgggcagtttgaatattaactgaggaatgttaacctcctatgtaggtcttggtggtaatggcctaagagctagttacattttttataacgtattgtaaacaccatttccctttcaactttttttctttagaaaacaagataactaatgaaaattacccaagaaatattatacatataaatagtatagtcctaacacgagctaactacaataggcaaactttactattaatataacattaaacttttaccatactagccctaataaaactctgagactattttctatcacaatgacagctgatgaatttaatgtgcctcacaaactataggaattgtgataggaagctgactctgtcctagaggccactgacaaacctgataaggctgtagcaggggtcagtctctataggaaacttgggctatatgagcatgtatgagttctgtggttaagaatctgaagcactcagtatagcaaacaaaattccaaagctgagtaccaatgtaatacgctggatcgctgtacctacttggacaagagtacatgcaacaggcacatacaatatacatctggttaaatgtaaaatcatccattgctaaagcattttaaacttctaggagaaatctactggcaatgtgttaacagcaaggacaaccaaaacaataaaataacatctctttcctaaaatttaagaacatcaagtaagtgccccttaggctgggttgtgattcctggaagtttcagcctatgagaaccatattggcgacatcaaagactccccctctttccaaaaagcaattcacttcagatgctgccacacaatcgaatgcttttatggccaccatgtttttttggtttttgtttcgtcttttgttttttccatgcttaatgaacatgccagattcttgaaatagaaagaagatgagaaaacccagtaagatggaatacctctagaaaagaaactaggcagggacctgatggtaaaggataaaaacacattccaacaggaattctacttttagggagagtatgagttattaagaaggatgtggaaggcacattttggctatgaaagctggtccgtggactcctctgccagtctcacatcagacaggatgcaaccatccccactccattccttcgacaacttcccagagcacattcaatcagtgtcccttaaattgaggacaatactatatttgggtttaatactgtgaggacagtcatttagttttcctgtggcaggatgataaatttcctgggaaccaaataaggattctcattgcattcttctgcttgatactatgaatgcagaagaataaagaagagggtgtgacaaatcatattttccaaaggtcgggtgtggggaggttccctaacgtttaaaagcaaccagttgttagcaaagtgatctttagaacagtattagcaagaatgtttgctctacatccactatagatattctctcctgcttagctaggcatgtaagtactgtgagcataatgtaaatactcagaacagaaatgcatggaaagctggtggagtgaaactccaaatgaacaattaattccactttcacttcccccatctacctccctgaatactacctccctgcccccactcacctatcttcctccccccaacaagcatgtttgctaggcatgtcaaggctgacatccatcggtggcagtatgaaacctatgcctacaggctgctcctgagcatagcctcaaggctctgccattgtccgtagagtgctctaagttgtgcccgctaaaaatcttcatcattccatttgactgtttggtagtatttctttaattgtattttttgtttgtttgttttaaaaacaccctttatttcctgcttgccttagagacaccaagaataaaatccttgacacatcaaattctggaacctcaccactcaccaggactatggttcctgatccaaggagtgacgactgagaatcagcacacagtctcttgagggtgtccaggcctggctgttaagctccctgctctgattagtttgtcgagttcacagtgttccagagtgctgaagcacagaaattagggaggggaggtggaaggaaaatcactggagcctcttacgatctaacttccactaactgggaggaaatgtcttataaataaacaacagtaagagaaacaaaaaaaaaaaaaacccatcccgtcctgccagaggaatgtacattattgtctcccgacggaaaactttacaccacaccagaatgcagccatgtctcctgaaactacctccctcaaaacagaaagaaaaagagaatcaaaaaggaaaggagaacaaaacagaacaaaaaagatttcatccccttgaattctgttgggaagttcatgtgagttcccagtagacaaactaaactaagcaatttcaacagtgtcactgttccagaattttgtgcagaggctgcttattagccaaatttcatttctgcccagatcactgctgtaccatccagacattttcagaagggaagttcagggaaggggggaagggtacgactgtggagaagaggaagaagagaggacaaaggaaaactcctgatgaaccagaatgccctagccacggccatgatagagcgagcccccacccaccacccgactactgcttgttgaggacttggtgatgcggtgtgttttatctacttactctttctgctcgggaggctgaggttcctacatttccagctcatgctggactgtaccgtaagcaacaagtgaaatgagttcagtgatctcattctagtccttcgactcctgtccacatcactaagcgactgcacagcttggcacaggccaggatgagtcagcagtctctggtcatgagaggccaggcctggaatagcaggggggtttaggtcaggagcaaaatgaagcagaaaggcagtctagatggcagggctctgttctgcaatacacagaaatactgcaggtcaaaatgaaagcgcctcatcagctctggggtgaagattgtaggactgtaaaaaaagaagcatcaagagaaaaaaaaaagctgcctaccaaacatagcaaggacaaaacagagtaccacagtcagaaaaagagggcactggtagagccctggaggataaaagatgctcattaaggtttctgaaatgtcttttcttccacatgctcccaaacttgaattaagaaatggtgacttcctatatactatcctagtattttggtactgttttcccaattcagtaagtagcaaaacaaataaaatgcaaggcactgcagttaaatagcaagaaaagcctcatatttcataaaataatatgagtctgatatctcaaaggtgtacatttgggttaatagtgtctgtatatagcctgtatgaaatggttaaagaggagtactctttaagttgagcttgggtgggggtagagaagagcttagagaaaagagagttaccagttaatgataaaacataggggaactatgacactgtgaccatatttctactcaatggggccaacatagacctccattagacctccatcaagaagtgatgctcccactaacaggacttcaaacacttctccctctgcagtagtactgtaatatagcaaggggagagggaaaataaaatagatagaaaaacaaggttcaacataaaaaaaattagtgatagacattttgtttcagaggaggcaaattgctctataagtcaactgataaaaaaaagtcttggtatctgaacagacttagagaaaccatatctagatgaagatgccaggtggagactgataactatcaggaaatggtagtaatggccataaagaaggaagaaagcaatctcaagtcacatgatgtagaataaaacagcatggaaaacagaaggagagcaacagacttcgggaacacgagtaaaatatttctttaaagtccttttaagaggagtaatgaggacccaccacatattcctaaatgttgtccctcagagatgcacagatgtatatgggtaaggaaatgtaaaataaactttcagctttcatttcagagggtattaagtcatctgaacacatatttactaactgtttaatcttgggcaaatgagctttctagcctcagtttctctctctttgaaatggaaataatattatcatcctcatggaatcattgtaagcactgaatcaatgttcattaacccttatctcagcagtacctgtcacatggtgaacattcagtaaattgcttattattcatattatttgattatcatatcatatcatctttataagtatccagtgaaagaatccccctccagtgttgttccactggattgagaggaatcaatatgaagactctagtaaaatcagttgagtaacactgcttacactgctgctttaaaaagattatttctgtctgggtatgttaaacattatacttgaagacacaggatgttgaaaatctattatgtgaaatccttgaatttgggtatctatgttgtcaaagcaacttggagcctaacagttgtccagtaactagaggcccaaaaaagaaaagaggaatttttagaagcttctccaaaagcaacaggataaaagtgttattggccttaaccgcatgatgagggctttttaccaaaggggaaaacgtagtccagttgatcatcgcagcctaattgattaattgtgggtctgaccatctggctgatgaatgctgacacccagcagtgattactgtgtaacacaattccggatgtgctctccctgatgcctcccacaataatggcaactctgaacttaaggttagtttattcaggcctcttggctcaatctcttcatggaatagtggttgtggcagggaatattttactagacctggtcaagcattatcttctcttatttcagttacccactcttttccaactctactcctacccactcctaagccctctcttgtatataatcacttttcatgcaaagcattccatctgtagttttcatcatattatctgattctctcatttctggttgctctgttctgaaaaatatttgactaaactaggagatctatactgctagaatgccatttcacaggggatcctattgggacatgtttattgtatcttatttgctactggtttacttcaaattactctgcgcttccaaataaagaaaattattttacctaattcattagcctgattaaaagtcccacatatggcccaagttttccatgagattatcagaatacaagggttaatagacgataattcttacatcttaagcctacttctgaccctcagttaggagtatcccatgaagaagattcccctggagcatactttactgttagagaaggaaagtcagacccatgtaaatgacaaggttcaatagcaatgccatccacaaaccaatctacacctggagatgacttgtacatggagaattcaccaagcaaataaaacctgtacatataaatataaaccctggggaattataacaaaataattccattgtattttgtaggaatgcacaggggagtaactgacacaaaatatcttatacaaccttgaccaacaagtcacaatgacaaatcatccgtttcctcttttcttttcccagattgatttccagctctaaattcatcttttctttcactccccacagatgctgaattcttctatgttccaggctgagttagtgttaattttcagtagaggacggcagtagcatgctgaactgtagagttccgggctgggagttgggaaatgtttttggcctgactgtcagtaaacaactatgtgtcttgggcaagtcaagtcccttaactccccatgtctcagtctcttcattgaaaaatgatagggtaggactgcataaactccatagtctctgccaacactaagattctatggttctatagctcatttccttttttttctccctttggcatcaactgctcaacaactccgctcatagtaatctctatgctctcagttactaatggaaaaatatgtccttcatttactagttggtattttgtatttgtaatctctctctttttttatttgatgctagatattttgagtcataaacaccaacatatccaaatagatgctttaaatttgaaggcgtttaaggaaaatagctttcccatgtagaatatttagtgtagcagggcatggaggaagccagccatccaaaagtggagcaaaggggccaattcacaaatgagagaaagcctttcataataagagtctccacactctttaacttagataaagctaaaatgctaccaacttctaactacttttccaatcaatcccagacaccatcacagacacttaggactacaaatctgaggaccagcactggcagcaatgcagttcttatttcacctccaccacccattgccaagcaggatttaggatggcatactaataagagccaagaggacgatctgtcatttattttcctccaaactttttgaaatttcccatttgggctctgtttcccagttttaatttggtaactgccatttttcagcatttcttttaacaggttactaataatttctgatacaggatctcatatttcattttatgctgctagagctgctgttaatatttcatctgccttcaattcagctctgaataaaggctgctaggttttgatagactgttaacactttggttctggggatttgatcactatgttcatccagtttgtccatattttgttaaaaaaaaagtaataggttagctatctcagaaatatctcagggtgtgctatacattctagggatacttcagagtttctttttctggatctttgatgaaaaccaacaaaaacaagtatcctgggtttgttttcacaaatgacttgccatttgcttcagtgtcagtattctggaagcagtgggcagtggttaagattcagggctcataggcagatctagattcaaattttggctctgaaatttattatatatatcacctcaggccagttccttaaccttgccaagtctttcttttcccatttgtaaaatagggatgataataatatccacttctattaattaatatgaggatccaataaattaatataaagtgctgaggattttctcagttctcaataaatgatggctatcattatcctagcattaataatctacaaattcacattatagaattattattttgcaacatcttttcagggtcaacaaattattttttagtacagcctttgttgtttgcttcactatagcttacatttttaaaaagtctcagtaaaatcatgtaaaatatttaaaaatttgatatttaaactgtatgtacagttagactaatatatagcaccatattattattattgtagcacttttcagtgcagcagcaaattctcaaaagtttttgtccatctaatagccagccctagataaggcacattgtaccaatactaatctgttctataaaaagatgacttatcatatttatcttctcctactcccaaagaatatagattattttaatattctttgggtatgtgtcagtcaggccctgtttggatacagagaccatatagcaatttgaatagaaagttagtttaaattattaataataacgggattaaagtaataagagtagctagtaagaagtaaagaatactttaaagaatataagaataacatgggccaggcgcaggggctcatgcctgtaatcccagcacttagggccgaggtgggtcttcagcctaggagctgaagactagtttgggcaaaatggtgaaatgccgtttctacaaaatattagtcgagcatgatggtgtgtgcctgcagtcccagctacttgtggggctgaggtgagaggatcgcttgattccaggaggttgaggctgcagtgagctgtgttcatgccactgcattcaaccctgggtgacaaagcgagaccttgtcttaaaaaataaaaaagaatagaagaataacaaatgtaaggaacagccattatttgcagggctaagatagcatatccaaggaagagtctcctccatccctggactgagatctagacattgtaggactcaagacaaaaatctcctggacccctggaccaggatccagaccttgttggacaacacacagccataactcattggatggcagagaagttgctggggagctgcatcagtagcacctgcactctagggtgctaatgaaagctatttacagggatgtatctcatctgaggcactctgctataaattgcccaatgtgtgtgtacacatgtgtgtgtacgtgtgtgtgtatggtgggtgctaggggtagctgctacctgccacgtactggagaagctacctgtgcttcagctgctgggtaccaggttagctgcatttgctgcaggagctacatgctgtaaaggttgcttatgttgtagaagccaggctctggagaaaccgtgcacattgcaggaggctgccaaagtagtgcatgacaaccaggaaggaaaatttcttctttctgcaacgtctccctaccttctctactgacaaagcaccctcaaaccagctagcaaagaaaaaatatttaaagaatccagatacatttttgcagagcaggcaaggagaactacatttggaaggaggcaatgggaggtaatacattggtaactggcacagatattattatttgctcacacacttcatgaaataactcacattagagattataatccagtattttcaactgattgcactactgttcacatttactaataaaccaactccctttgcatagttaagcaaatactgtcagaattaagaaaaataagaggccagtagataaatacctataatagaatattttaaagtgacagtactagtatatgtacataaccttttcccccaagtgctgcccacatacattttaattacatgtttataatttacttaagaaaaaaatatacagaagtactaagctattgacctaaatgtatgcatcagtgatctcacaccagaatctcaactaagtgggtattcagaagagtcattacaaacaaccaaaagctttgagagaggtaaaaattgcctcgattatcatttttcctttctctttccttttctttttaattaactctagaactcatatttgcttcttctatgacatttttgtggaggggtggggtggctcttaaataggttattcttttttttttttttttttttttttttttgagatggcgtcttgctctgttgcccaggctggagtgcagtggtgcaatcttggctcactgcaacctctgccttccgggttcaagcaattctcctgcctcagcctcttgagtagctgggattacagacatgtgccaccacacccagctaatttttgtatttttagtagagacagggtttcaccatattggtcaggctggtcttgaactcctgacctcgtgatccgcctgcctcggcctcccaaagtgctgggattacaggcatgagccacgtgcccagcaaaatataggttactgtttttcagaaaaatacatatttagaaattttttcttatgattctggtcctatattgttctactcttaatattaaatagagaagcatcaataaatgaccaatttggtaaactatgatactgtgatcattgttagaactagttttacatatggggagagagtatattccaaaatacctcccctacttttgcctaattcccttaagaagggaacaggtgcttttgctgtataattacaggtagagtttaaaaccacaaacacctgacattagcaaggagcgtggttgtgagaggctgagagcagaaaagctaattgggtgaggagagtcctgtagagagtagactatactgaggtcaggaccacagaacatctttctcaccattcatccgtttttacctatgtctggccatcagcactatctgttctcactattatggaaggggtctacttgttacctcacagttgtgttttcttaaagccagtggtatccagcaaagcaagccatgttgggttgtctcacaatcacactgtaggcatctctgccagctgcaggtggttatccttatgatttccttttgtttgtgctatgcgtgagtactgaggataaatttaatgaccctatgtttagttctctcctccaacacacatgcacacccccctctcccctgcaattcctgagttcaaaaagagatgaagacaaaggaatgtcataagtccgtgtgattcaggcaggcaagtccattttattttagtttgcccttctgttctgctggcttttctgctatgacccactatacttaacctgtcggctgttcttagtagcaacatgcctttttaatcagccttcctggggtctgcatttgattacagcatttgtgttctattttgattcttttgtactgtgccctgtggtgttcgcttgaaaggtgttatttataaaatgaaattctattgtattgccacttggattcaaagaggacatataatattaatgcagaatgtatttaataatatcttcaatctattaaatcaatttcttcatgagaatacagaatggaagggaggcacatgggctgataatcaggtaataagacttaagaatcacctgaacttttccttcacaagctttcctgaaagctggcacaagaatcattctcttaatgtcagggtttccaagtggaggagactacctttcttcagccagaccagtgcagtgcgcacctgtttaaacattcaactgtgcaggccaaacattttcctaggcttttagatgcaaattttttgactaaggaaactatgagaccaaacatgaatatgacttttttactacatagaaagaattaggttatgaaggaaatgtaatcacctatttctaaggatctactttcaagatttgtaaaaagaagtatatttgttctcacactgactcttctcaaaagcaggataggaaaattctagtgataccaagaactgatgcaaagtttccaaggtggcatgttcagaatgatgttctcacctagcaaaagggcaggtttcattgtgggctgctgggcctacagtcaaatgtttctagattagattgatggaggagtccccaagttttttcaacttctaattttaattccagctaaagactgaaacattgtacactgtatcacagcttgcacagcacatttcttgctgcatacattctattctttcactacaatttttttttcctgttgatctatctgaaatcatcaatggctatgctgctgtttggatagggaataagaaagaatttggtttgaaagatgatttaggaatcaggctctgcagaacttactaaaagaaactgtaacatacaaaggaacctggctgggcagtcttgaaatgagagttcctggatttttacctgttctcattcagtggcatattatataactccagaaaaatcagggtccagttttctaatcactaaaaggggaataactgtccttttctacttgcactgggctactttagggatggataagaaaatgattccagaatcttgtaaatgctttgcaatgaagaggaaatacaaatgcacaatattattaaaatgatagtttaggccacatttttgtttctccaaatctagagatgaaaaatagtaacaaaggaataaatttcttccacttcaaaaataaataatatacccttatttataaatgacatgtcaaacataaggaactaggatgtgttggggaatacacatctcagttttgaaggcatcaaattataagctatttgcatgaaggaatcacattcatctctgtatccacccaagttctacctcattgatttacattatgtaagtattccattcgttaacatatgttgaattgaaatgacaaatgagatcgcacaattttagagctcgaattaactagagaccatgttaaatcctgttgcctcattttgcagatgatacaactgaggcccagataagtaacttaactaagtccaatactaaaaatattacaagttttagaagagttattttaaagatctgccactgaaaatatatcactgaattaaaacaaaatagacattcttctgtcaaaataagaagcactattcagctcaaataatccgatgtatcctaacctaatcaagaaggctgaagcctaaagtaacaagtaaacataattaaatagctatagacccataggcatgttagaaatgccaagttactgaggggtgcatatcttaatactttgtctatcagccagtccaaatggcatatttttttcaagtaaaattaatgtcttaacaaataataggggtgaagtcagcaagatggcagagtggaaaactctacctctcattcttccacagaaatactgataaaacaatgttggaaccaaaataccttgcaaatatattcagattgtagctaagaaatagaggcaccctagaggatcccaaactaaaagcagttgcatttgcatgggtaaaaagtgcaatttcatgttagaatgtcatatcagtacttcccccagactggcttagctcaacactgagaggactgcttcagctcatgatttctcctgtgccacagaaagtgagattggagtgtgtatctggcttcctggcctctggcctctcagagaaccctctgttgggtcagttcctatattgcctcatactgtgtactgacgcacctgtagaacttcgttcccagggatgcgtaggagcaaagaaatgaggagggcaactccttacagttagagctgccttgcaagattaggaatggggcagaactgaggttattcttagatgagggaggaaagggaatgaagggggccttattctcagcatttcagagttccctctgtgaagccagtttccatttcaccttgtactgagccttgtgcgaccattagaacttggttctgagggatagttagcaaaaactaaaaggagcaggcatccctttgcagctggcactgctctgtataataagaaaaaaacatagaaccgagccttttccttgagaaggcaaggaaagaagtgtaaagggccttgcccccagtcttagattgtgctccccaaggtgtatgtctctatcttgtctcatattaagcaccatgaactggtaaaggtctctactcatcaaaactcatctgtagagactgggaaaggtagctgctacttcaaatatacagatcacaaagaaaatctacaaggaacacaaagagtcatctccaataaccatcctgaaagaaacagagatccctgaattaactgacaaagaatgcaaaataaatgtcttaaagaagcccagtgagttacaagagaacactgagagatagctaaataaaattaggaaaaagatacaagaacaaaatgagaagttaaataaagagatagagactattaaaaagaacccaatagaattactgaagctggagaatacaaaaattgaactgaaagattcactagaggagttcaaaagcagacctaatcaagcagaagaaagaaacagtgaacataaagacagatcatttgaaattatgtagtcaggagcacaaagaaaaaacaaggatgaaaagtgaggaaagcctaagtgacttatgggactcaaacaagtgaatcaataaacacattagggaattctggggagaagagagggaaaggggtagaaagcctatttaaagaaataatggtaaggaacttcccaaatcaggggagagaaatcaacatccagattcatgaagtccaaagagctccaaagatctacaccaagacccattataatccaattgtcaaaagtcaaagacagaattttgagagaaacaagagcgaagcaactcatcacattcaaaggagtccccataagactgtcagcaaatttctcagcagaatcctcacaggcaaagagagagtaagatgacatattcaaagtactgaagatcaaaaaacaacaacaacctgtcaaccaagaacgctatactcagaaaagccatccttcaataataaagaagaggtaaagactttcctagacaaacatgcagaggggtgttcaccatcactgtacctgctttgcatgaaatgctacagaaagttctttaagctgaaatgaaaggatgttgattagcagcatgaaaagatgaaagtataaaacttgccaataaagtcaagtatatagtcaaatactagagacctctagtactctaatgatagtgtgtaaatcactttcaactctggtataaacattaaaagacaaaactataaaagtaatgacatgatttgttaatggatacacagtataaaaagacgtaaattgtgacaccaataacatgaagtgtgtatataggagaagtaaaagagtagagattttgtatgtgatcaaatttaagttgctatcagcttaaaatagatgattataagttgttttatggaagcctcatggtaaatacaagaaaaacacctgtagtagatatataaaacataaagagaaaggaatcaaagcatattgctacaaaagataatcaaatcacaaaaaaagacagcaacagagggacaaaggaactacaaaacaaccagacaataatttaaaaatggcagtaataagttctcacctattaataattaagtgtaaatggattagcttccccaatcaaaagatacaaactggctgaagagattaagaggaagactatccatatgctgttaaaacagcaacaacaacaacaacaaaaaacaacaacaacacactttagctttagggacaaacatagactcaaagtaaaaggtgggaaaaatatattccaagcaaacgataaccaaaagctagtaagagtggctattcttatatcatacaaaatagactttcagccaaaaattgtcacaagagacagagagaaggtcattatataacaagaaagtgattaattcattaaaatgatataataatccccttgattaggatccttttgattggaatcctcttgactggagtagaacaaaaactgaataattgtaaactattattatgaagtagagatctccaatacactactttttatttttccaaagctttcctggagatcacagagaactgaacatggagaaaaagtgagcaagagacagcagtaggctttatgccttaaatggctgtatagcttgttaaagattattgtttgtgtattaaaaaaacatgattctagaaacataattggggtttcacagatcaaattcaaattattaacttagtatttcagcctccattacttgctctatcttgcttaggcatcctaggttccagtacttcccaacaagtgttctgtggtgtatgcagactatgttagtgtttccctttattttggtatttccacaggagacctaattttaaattttctgttctatcatctccatgatttcttaaattatgtctagacttctggattagaatattattcatgtacttactatgattcaataaacatcttctatgtgtgagacagtaggaataagatacaaataagacttatttcctatcttcaaagaataaaggaattcacaatacagtggccacttaaatatataacatgtgttcctgcttttaagcttttattctttctataattagagtatcctatcattattttattgattgaattcctttaattatcttatagtccagcttatgttctgcttcttccataaattaatttttactttttatagcccacactgtttccttttccccccactattacagtggaagtggacactattccctaaccaaacttcattccctcattcttcctagccgcagacctctattttgtgcagagtgtcaatgtgctcagtgctggatgatgagttttgaaatttataagccaattatgacaagtgtattctctaatttgcttgcttctctagcaaagaagggtggcctagggattcagttatagccaataagatctatgtggcaatccacttgagaggcaagtttctgagaaagctttttttttccgttacaaagaggaaggtaaaaggcaatccttctgtttcctcctccttccctctttgaacatagacatgatgcttggagttgtggcagctattttgtgatcataaagtgacaagcatgaaagaaagacaaaaagaatcccagagatatcagcacagactttatcatataccaggaatttcctacctctcaacttctggacttcctgttaggtgagaaaactgaatctctatttgtttaagccacttaagtcaggatttgctacctgctgctgaacacatttctaaccaaagtaataatagtaacattcataatttgaattcaccaaactgttcttcctaactagataacagacattggtcacattcttggcacttcataaacattcatttgcttcacatcttgattaaatatgctagacttttatatgtaatgaaattctcacacagaaaggaaggggggaatttggattagtatcagaaaagaggatgaaaccaggtcaaaaaaggaaaatttgattctataataaaaaattatatgacaaaaatttgttacaatgtagctcaattattatatacaataaaagcaaatttttaaatattttccaaaattaatagcaacatattttaagaaataagacagtagaataagcccccaaatgataaatgttttaaaggagagatgatataaacaagtcttctattaaatgtgaagacaataccatgcagttctactgaaacctaagtgaggaaccagcgtttgtcaaataccaccagcaataagactttttctctgtcctttaggttgtatgactgtgattcaccccaatgctacaggctccttagcatgctcattatttctaaaatctttcacctgaggtttgaacccatgacttaggaaactattatcgcatttgcttttggagaaaagactacataagttgggacagaagctattttcaaggcttccaaatattacaagtaagtagtggggaactgttgagaagagaaatgagtagctttgggtcattttaggttagtgaccttaaacataaggtgtgatttaatcagaagccagagtaattatggcaggaggtggggaaaaagactcagagctgtctggagttagggaggactttggtggcagctttcagcttgagctaaaactgcaggattctgtcagaggctccacaaacaaagggctgcattatgtaaggaatcttgtatttctttgtgaactagtccacaacaaaatttcattagtttttttttttttctctcctagagatttttttttaccacttccagcccgtaacttgttgctcagaagggaaactttctaccttaaataaaagtttaaattgtaagcaaactgacatttttttaggaacaaatcaaattaatttgaactttataataactgggaaaatgctttttaagttaggtggatgataagtaatcttatatgaagaatttccaaataatttagcaatagttggcaataatttagcaatagttagcaatacgagttcatatctctctccctctctgtctctatcattttctgatagtctgtttacacatgtaacacttttgggtcacctttcaatggagcatttcataggcagaattggaagatagcaagacacatggatggcacatagcaataggttctcataaatattatctgttttcaaaagaatatttatttttttgcccattataaagatattctaagattaattacagtcctaatactgtcaaatttagctttgatatacaaaaatctattttttagtagtttaatttttttttatcaattactaacttgaggctttcattttacaacattattttggtcagttataaaaataatttaactgccaaatgggttttcccatttgacatttcaaatgttggtttaatacttatcacttagacctctatgaaggttgactcaggtttactgggggatattgcatagatcatgtcttttggtccaacagtttgggctgtgaatagtctaaatttgcatggaagctcccaactaccaagctatccaaaaactacagggacagggcggggtgaatgattctcagcaggtggcactcttccttctaattaggtcttgaatgaatgcaccagcattctgctatctcttgggtggagtgtgagactgaatcattcaataatgcttatagcgcttaagaaccaaattcaagggaactgtggaatgaaggcaagttataggtaacatacaaggattttcattctgctggactttttcattcaaaacagcatcattctcagactcagaattatggataaccatgcctctcagtctactcaggagagtttccagtttcagttccaatggcccagtcacaattattagtagtgttcattttcactttcaaaagtgtcctagtttggatgataaaatatggggttaccctgtatataagctttaaaaaagttagtcataacaccatttacagtgataatcattctatttaggacaaattaaagtagactctattggccaacttctataaagagaaagagataaactaaaacattattaatttaatctcagagctttaatcagaaaaagtttattttaagatgacaacaaaatttctatgaattatttaggatttctaattttaggtcatttttttttagccttattttatacaagcaagcacgtatgcccttaagatttgtggtggagaaagaagtacaatatctgaaataaagttctttgaagcttaggtttgaattctaattctactatttactcggtgtgcaaatttaaataatttctgtgaacattattattaaccctttctaaaatatgtttaaaaacattttaaaaaccagaagggaaagaactacatatgctgtgaaaagctgtaagttattaacagttactattatttctctttataaataatgatagtttttccctttcaacttctatgacacttttacagactgtagaaaaatttggccaagcatgttgtagcaagggtccttaactgtaatcacctttgacacagatccatgatatttctgggtgacatctctacatggacattgatggcctgcaaagatctagaaaagaaagactatagatcttgtacaccaaggccaaagactaaaaggctgaaatttaaagtacaaaagtattgtgaacagttttgttagtagtataatatataccacttatatagataatttttcttatatagatataagaataatttttcttatatagatataaaatagggtttcttatatagataatttttccatggaaggaaggggaaacgaggcgaaaagtggctggagtagaaagactagtttgtaaggcagaaagattttctaattactaggtagattttattttattttacttgtttttactagctaaattttaaaaaagagattcctagatctctatagacatgttcctctttctttttgctgatattttcctatttcttttctgaaatcttaatttgactagaaaaaaaatgatgttctgatttaattctcttagtctacctgacatcaaaaagtatatggagggtgtctttagttttttatttatatgaatgtaatcaaataattttattttttaaaaaaagactctcactgtttttcattgtttaacagacatttctttaaaactttgaagtaattatagaaaatgttctcataaattttccctccaaattaaccaggtagaaagggctaatcctgttatgcatgccatttttgtttgtttaaattgactattctgagaattaagtctgtagtacctagtttgaggcctcaagattttcaggtatgcacaaggttctatcaactaattctttgtctcactgatgatcctttattttaaatatactctacttgcaaaggtggtagggtaaaaagaggagtggctgacaagagactaaagaggggaaaggattcccaacatccttaatatctcagggctgaaaaagagcattagaaatcttctccaatctcttggagaaaaaatatctttcacacactctgtctattagaacttcatttgtgtttaacaagcccctcttttaaaatgcaaatttgccttgtgaacctgtaaacctcattcacaccttattgttaattactttgatgttctagaatatgatcaacacttaactgatattggcaatctaggaatgaacaaattgctcagggtgaaaaaaggaaaattttgttggagtggggctgtaggtggtagtgtgagaatttcatttgtgagaaatagagcatactgatattctgaagttttgtctaggagaatggcagtagttacggtaccacaaaacgagcacttttcccgactgccgatgtctagttgagatcagaaaaagcctggaagcctgcaaacctaagttttaaatatttagccatagcaagctaatcaagcttgcaattttctgaaaacgttttaagttaattcataatagctctacaactcggtgaccttgggttctaagactcatttggttcaaccttccaggtttaaaattcaaccaataaatgaattccaaggaaaaaaagtgaatatggcccagtccttttttactgtctccctagtcattcacttcagagattttggaatgcaatcctagaacatactgtaagcaatttcagaagaatacacaggatgcagtatttctctatgtgtcttagtaaatgtcacttgacccgatatatcaaaaaggttgcaaaatttgaattagactttagttgacttaagctacacatcttagcttggcagaaattcaaggaaaaaaatattttatggcctcttgtaacattattaatcacccctccttttatataaaaaataaatatgctaaactcttcactgttcagaaaaggggtcatttttcctgccaaaatggctaattttagtttttatgtagttggatacatttgtaaactattacatgaaaacatatggttggaacatgcttactccttcatgagtgttccccttttgaggctgcaaaattttccttagttgctccatgtgctactttgttgtgctgatgacttcttgttctaaataattttcttcattttccattgttaatgaaatgagttctaataaggaacaaagaaaccctctgatgaaaatccctttcttgtagaatggactgggaactgatataggacacaggggaacagcaaatgctgtgttgcacattcttcaattaaatgatccctttgtagtttattcacctgaatgcattttggcaaagagtgaagcaatagtgggaaaaggattgtttgtgtggctaatctttggttactcagaaagtactagacatgttttcctgcatgtttgattgatttcctgcacagtttgattggtgaatcaacactttaaggtatctaacccataaggaagagtgaaaaacttccccagaggtattgaaatttcactaaacctcttcttggagttttggtgtatgattctcagttgatctttgagtgtaacagtcaactattaaattggcatgactgaagtacagttttttcaaatagaagagtattttagaacaaatgagaattctaactctttaactgaatttctaactttacattttgcccgtacctctccttgtaacattcttccctttttccctatatatttttaccagtaatcctttcaactgctccttaacagtgagattctactgttctggcacattataggttctctttaactattttttgagtgcacaaatgaccatttggacaaatattataaaatgaacaataaaaaaccttaattatgcaaattaataagtctatacctttgggaaaaaagccatgatagtaacaaaatgaataacaattccaaggatatttaggaaggataaagcctagaagattaaaaatgagaaattttagaatcataaaaaacaaaacgaaataaaatagctcaataccattgaaagcacatgtatgcagaaagaagctaatatattattgtaaaaaattaaatggaaagaaattagaaatctattggtattattacatcaaaagcaggaagttctttctttctggtccaactttagagagaagaacaaatttgccagtgccaccaagggcagaatagagagagatgtttggaatttaagagttacaggttatgttatggttcatttatatcattgccatcactgcagttcattcattttgtgtctaattattgatgttgccacggttgtcaataaacgctcagcattactaatcatcagagaaacgcaagtcaaaaccacaatgaaataccatcttataccagtcagaatggctgttgttaaaaaatcaaagaacaacaggtgctgcatgattgtggaggagagggaatgcttacacattgttggtgggaatgtaaactagtcctacctattaggtactgtgctcattaccataggaattagggtgggattcctattccaaacctcagcatcacacaatattcctatggactaaatctgcatatgcaccctctgtatctaaaataaaagttgaaattttaataaagatggaactaatccctcatatcacagaattatgtagttgtgggtagtcaggataaagaatatttaggatataatttaaatgaattcactagctctgaaaatgaaagaataaacagaaaactaatctagacattaaatttttttctttccctaaggataatgtatagtccctaaggataatgaatattcaaggacatactgtaataaatcatatacatttattattaatataatatagtttattgcacacacacactatgagctccacgatgttcgttgaactattacaaagtttaaagacatacgaaattacagtaagagccatccatataaaaataaaatgttagtgtttggaaggaccaattgtaggagactatattggcgagttaatacaaaagatcatcttttgtttaagagttcatatatttttgtgtaaattatatctatttacagaaattttctttactaccaactgttctcaaacccattcactaataaataattactatatgtgattacttaatatttacctcaaacctttatgaatatcactgaaagcattactggcaaattaattatataggcaaatggtgaggatctctcaacctcacctctcaccttcttcccaatcactcgaagactgactatatcaatttgtcttgttatccagaaattggctttatttgttaattccagagatgcttcaactgtagtttcagccagctgtttccttacatctttctgggtggcatcagtttacaatgcatagcattgttgagggtcaaagttattttattttggtattactattggatttttcccccagtgcctcaaaggggaatgttgagtcatggagatgtaatgtgactccttaaactaagtagacttctaatacaagtatacttttattatggagaaaccaaattaattttatcaattaaatgagaatttatttaccatttgcctttaccagatatttcattagacacaattctcagactttacacaattacaaagaatgttgtataaaaactatctataaagcaggagatatttcattcttagttttttgccaaacaaattatgttgcttcgaggaacagagggaaaagaaacattgatgaaacacagccctcaactatggcataaagtccaaagcacagagaaggtcagaaaagaataaagcagttttgcagaattattatgatagggagtactgataaagaagagtcaactttttggccttagtcatttactgagttcctttattaaaaatagagcataaacattttagaaataattttttctcaatctttttttataaaacctctacagaaaaaagaagcgttatgtgaaaagcagctaaatgggaggaaagtaggggtctgtgggtgaaacaggaggttaccattgcaaaccctgtccttgatgccctcactcagtaggactggtggatggaagaagtttgaaaaacttttatgtagagatgaagaaaagtagaagccctagtttacagagaacgaaagatacatttttcttctgtgtaggtagagtttgtatttggagaaggaggagactcctttcttctgatgaaaactccttcttccaagagaaaactccattaggaaaaatggagcagcagtgagtgagagagaccaggtttaagatttgttttggaggttaaatttgttgtggaagttgacagaatgtggtgaaagcaagacacatcataaaataagccaaaaaaaatctctctcttccagctcattgtatattggagagttagttgacttttctactgtaaatgtaaagaaaacaaaagtttcattcatcctcctgtaatgatgccaatctaatttgctattaaatttctattcaaaagccctattttgtttagttacaagggatttgatccccttaaactttcccaggcaatttgtatggaaaggcggttgctaagggtattcctaagggaactggcaaacgttggaagataaataacctcagtacaatatgcagattaagtagaagggatggtttaagagttaccttttgaaggaaaaataaaagattcagaattcagggctagagttgctagttaatcactgatttgaaggtacttaatcaaggcagttttattttattttattttatttatttatttttttttagacagagtcttgctctgttgcccaggctggagtgcagtggcgcgatcttggctaactgcaagctctgcctcccgggttcatgccattctcctgcctcagcctcccgagtagctgggaccacaggcacctgccaccacgcccagctaattttttgtatttttagtagagactggctttcatcgtgttaaccaggatggtctcgatctcctgaccttgtaatccacccgccttggcctcccaaaatgctgggattacaggcgtgagccaccaagcccggccaaggcagttttatacttctcaagaaagtagaactttcacattgttcctcttgggaataaaggtaaaattatcatagagaggaaattagagagaaatgttcaccatttccttccttatattcttcctttctttcctctctctatctctagagctcttcctcaaagattcaaataaccaaaaatatgaagccatgggtggcagcttggagttctcaaaagtccaaagtgaggttagcttctgaccaaaacttttggcaatttccttaggttgagtgaaagaagcaatgtgaaaaagcatgagtttagagtcagtcagccatcaatttaaaatcaaactccactatttattattggtgtgatcttgaatacattagccaacctctttatagtccagtcatttctaaagaggtgattatctatgaaacctgtattacatatacaatgtgtaagtactcagtaaatactcagtacttctctagtatctctctaattggatttggctagtaatcatgacaattgtgggagagaaaaaaaaagatatgtaatcctgagggcactcagtctctgtaacaatcacttgataaataatcaggtgatacttcgttgacatctctttaatcttccaattgagaaaacattaggagtagaagaaaaatgattaatctccaacttctgtcattggaaaataactaaagatcagaactataagaaacataaaacttttctagattattaaagttaaccttttagacattttccacaatcacatggtatgcaaattttaactaaattattttacattaaatgtattttgtgctatgttttgactagttgattttactgtagtatagaatgtattatgacattccattatcctcttattactcatcaataaaaaatttattgagaaaacaattaattataattaatatttattattcattactagtaggcattgtagtaattacactattattggtattttaaatatcattaatagctataaacatgttatacataataataatagaaaccatttgtggagtgcttactgtgtaatacattttgctaagcattttatatacattcttaaaattaataatttcaaagatttaatgagctaagtgtcaccagataaacgagaagacataataatctttatttattaaaggaaaacttgccatatccacacaatcttccaaagcactgatagaacagaatgatggcatgatggcatcttaaatttagaaagtgtcattcataaaagtgtactgttaactactaatttgtgctatctgcaataataatattatattacacaagatggaaaggctaccccctaaaagatagcatttgataaattgtacataaaaatctagaagaataagagtataacagaggagtgaaatttgatctgaaatacagagaaaattaagaaaaacaaaacatgttagccctactggaatttgtctcaatgtatttcaaggttcaaagtatagcagaggaagatcattgacactgtcagaggattatcattaaatttcaacccaaaggcaactaactcaaactatgcagatatggaaagtagtgtttcctaaaatgaaactaaggcaaatattatttattctagcttctactcttttgactaatcagctgacccagaaattaaatatttaaaggcttaaaaataatatagttttaagaagttgacctatacgttactaaataaaatgatcctcgttgtatttgaagtagctcaccatttaaaaatttaatctatgtccacccattttctttcttcccaaataatacaatgatttaattaccccacagtttaatttgacagaggagccaaaaagatacactattccttcattgttaactttaaggagaaaaatacactataaactatattagaaatcttattttttgggtgtccaccacaatgttttcactacaaaatcccttgctgcctgaatacaaaatgttaccattcaatcagatgagtctccatgaagttagaaacattcaagtgaaactcataaaataaagaagatatactctaaaaattccagttcttgagaagctgtttacacacaaaagggctattaaaagtgaaagggtaagtagaaaatcttctgggctcatttaataaaagaatgtagagttccatgggattcttttctaaagaaaccactaacaatgttgcagatctacaaatcctaaaagagtgcataatggactcaagtctctgctttgtgactcatgggtgtacttcatcaggatgtacttcctcttttagggggtcatataggtgaataagctgacaacaccttcagagagagaaattccacatgtgtcataggaatagaatttatttgatctcaagctttctatatatagaaaaaaaacaaattctaatccaaactttaatgaattcagtattgttgttgttggtttgcctctagaatgtctcttttgaccaagtcacattcctttaaatttacactaggtaaattatatattttccaaatcttttataaaagcataagctaaatgagataacattaaaaggctgattggagatttccctttaaaagcagtcataagaacaacagcaataataatataacaacaatatacactacattttgggcaccatgctttgaatttatatacactaatattattaaggcaatctgtgcttttgagaagctactccagactaggcactacacaaactctgccacacacaagagagaaacaatttcaattacaaagagagctagaaaataaaatggataagagtatcatgaaagattttttgtaaaactgaatagatcctttcatgtttctcagttttaatctctccaaatatccctattgtctgctttttaaaagaaaaaacactgtaaaaattctgaaaaaattattcacaaagaaaacttccactcgtttatataaagcattattattaacttcataacatgcataatatcatctatttctgaaagaccattgaaaagtagccataaaaacttaaaaaattgaaaataatctttagagatcaacaggccaggaagagttctaagaatatgcattggcctttactaaccattttcaatgccatgcacttttgtctgtcaatactttctcctgttatttttaatatccctagattaagaaatattaacatctatttacaaaaaaatattctaacagtttcccccacaaaagcatattcccatgaagatcaagaaaacaaaaaacatagcagggagtcagtattctgacagccttttagtcttcttcatcttcttcctactattattattagacctactgcctattaccagtaggctttttaaaggtcttggacataaatatcagttgttaagttgctattttcatggtcatttaaaattatttcaaccataaatgcttttaatttcctgaatatcttaaagctgtctaagtataaatattctcccattatattcctctgtgctaacacaataatctagttggagtcaagtttcatgaaaataagaaaattggtacattataacattttaaacactgaaaaataaacgtgatagctgtaggatgtaaagtgtagtcaggcctgtagaacttcggatgcatcattttacaatatcatttatcattttgataaaactgaggtcaagtttctaaaaatacaacttgttaaaagcaggaataaatgaatgagagatgagtcagctcgtttgatggaaagggtttaaaaaatacttcaaaagcataccacatgacttggtaaatattcagtgtatcaaaatgtagttgccatctggcattgatagactgggctagaatatgtgtttaaaaagaacaagaaaggaaataactcagccaggttaatgtgcacttgtctacatttcataattcaggtattaagtgctttaataaatattcactatgaaagaaaggctgcattacaatcagacttgggcagtatttgttggggacagctagaaagaaatgaaagaagacaagacctgatggcacttaagaaagctaaaaacaacaataaaaaagtggtttaggtaaacagaattctcaatcatatgtaatattgccagaacactagtatcacagttaaatgcagggaagtggtaagcttatatttgaaaataaactgaaatcttgcttattttcagctttgaatattttaattattcttttctttggctttgacaatttaaaagtatagagaaatccagggaataagtaaaacccttggttggatagtaaaaaaaaaaaaaaaaaaaaaaggaaaaacgaaaaagtcctgacattctttgaagttttaaacctagagtttgatattaactttgcaatatgcaacaaaacaaaaagtaaatttgaaggactcctcttttctccctcttgctcaagaaataaaatatatttagaaagcagtatcattcacaaaagagaaaagtgaacacgagcagtgaacacttgcccaagcgttcgactgtccaaggctgtatctgggcttgttaattagatatttctgtctttaaccttgaacattctccagatttccaaatcttgacaatttacattctaccacatctcttggaatcagagcaataggcagaagagaaaagttttaaaacagctttgaaggttaattaggacagggaccagggtagccattaggaaaatagatgaagcacttcaggtgagagttgattagggtcaacatgaaatttttcagagttgaggtataatttatattcagcaaaattcatggacttcaaaatgtacacagaatgagttttgattttgataaatttatacacctatgtataaatatgtatatataaaaatgtatatatttaccaccataacagagacatagaaagttcctttgtgcccccttccagttaatttctatctcccataaacaaccagcattctgatttttatcacgatagaatagtttcgccttcacataacttatgtatactcttgtgtcctggctcttctgcataccatgtttctggaattcatctacattgttgtatcatactctgttttgttttatttgcttgttagtatttcattatatgaatataccacaatttgtatatccactttccacatttgggtgcttccagttttaggcaattacaaataaagtcagtataaacttgcctgtacaaatctttttgagggcattattttcattattttttggtaaataactaggaatgtaattaccaaacaatatggtaggcatatgcttaaccttagaagatactgatccaatgttccaaagtagaactatatatttacagaaagtcttgaaattaggtaatgtgagtctttcaactttattctttttctaagttttctgcaatctcatatacattttaaaataaatttgacaatttatcttaatgttagaaaaacaagatgttgatattttgatggtgattgcattgaatctacagataatttggggaaaaatgacactttagaaatactgagtattcatctataaataacggatttttctctaaggccttttaaaattttgagtggggaatcttacattcttttgttaaacttttatttaaatgtcttatatttataggctactgtaaattgattttaaaacttcattttcaaattatttgccggtactacataaatgcaatcaatttttgtatattgatcttgtgaccttcctaaatgcactgttagctctattagttgttttgtatatcccctaagagtttctaatgtaaacaatcatggtatttgtgaataaacacaatgttacttcttcctttcctatgcttatacctttaatttattttactcgtcttattgctctggctaggatctttagaacaacgctgaacagaagtagtaagaatatatatctttgccttctactatatcccaggaggaaagcattcagattttatcattaaggacggtattaattatatgttttcatagaggcccttcatcagattgaggaagtttcaatctgttctaattttctgagagttttcactgtgaatgactgtcaaattttttcaattgctttttctgcatctattgagatcatatttttcttctttattaggatgcatttacagtgatttattttcaaacgttaaactaaagttgcttttctgagataaatcctacttgatcatgaggtattatactttttactttttattgttgaagtttgtttgctaatattttgttaaagattattgtgcctagaaccatgaggaatattggcctatacttttattttcctgtaatatctgtcaggttttgctgttgggattatgcctgtctcataaatcaggaagtgttttgtttttacctcctatgttttctgaaagagtccgtgtaggattaatattatttcctccttaaatgttatatagaattctccagggaaactatctaaacctgaagttctttttttaggaatgcttttgacgacaaattcaatttctttaatcaataaaggaatattttgatttctttggtttactatgccagttttgttaatatgtttttaaataaatttacctattttatcaaagttgttgaaattattgacatgaagttttcataatattcccttgttatcctttaatattgttatgatatgtaatgataatctctcattactgatattcataatttgtatcatctcttttttcttgaacttttctgttatagcttataaattctgttaatcttttcaaatattcatgttttgctttcattaatcttctttgtagtttgtttttatttcacagttttctgcctttgttatttgttttctttttttactgcttttgggtttaaaatgattatactttcccactttcttaaagtggaaacctacgctattgatcttaaacctttcttcttccttctaatttaggattaaaagctcaaaatttctgctaagcttctctctggctcatattataaatgtcaatatattgtattttcatttaatcagtttcataaatttcaatatactgcataacttaatttaattattttaaaatttcatgactttcaaccatgaggtattaagtttgttgtgtagtttccaactggtcttttctagatattttattgttttctttttttatttctaatttaattaattataaacaagaagcatattttgtagtatctcaatcttttgaaaatgtttgaaactcatttgatgaaccagattagggtctactttaataaataaagtagaacatacatacaggactctattcctgtatgttttaaatatgttttaaagaacacatattctccaggtgggaatagaacacattctccaagtgggaatagtgttctgtaaacatcaaacaggtcaaggcagttgatggtgtttttaatttcttgtgtattcttactgattttctgcctatttgttctatcaagttctagaacaagaatgttaaaatctccaattgttattgtagattttactatttctctctagttttctgtcagtttgtgtctacatgtttatgacttatgcattcatgataatttcacacatatgattaggaaatatccctccttatctctaatagtactccttggcataaagtctattctttgtaatattaatattccaacctagctttctcatgcttattgtttgcattgtatatatctttctatcttttcactctcaagatatccatgttattacatttaaagtgtattcctgtagacagcatatgttgactcttgcctttttattcagcctaatactctctcttttaattgtagtatttataccatttacagtgaatggaattattgctacaattaagtttaggtctaccatttatttcattatatgcttttgatttttttcttttgggtttttgtcattgttattcttctgttttcctttcctttttttttttttttttttttgagacggagtctcgctttgtcgcccaggccagactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccttcctttccttttttaatgagttaaactgatcaattatttttccattcaattgcacaactggctttttagctgtaccttttttgttattttttagcagttgttctaaggattacaatatgcctctttaattatcactgtttacacagagttaatattttaccactttatgcaaatgtgagtatcttataagtataatttcatttactgccacccagtactttgtagtatttttacatacttcatatctgcaagtactatagactcatgagaaaatactataatttatgcattagtcagtttttcttttaaagaaattaaaagaataaaaggatattcttttacatgtaaatagatactttaaaatttttagtgaaaattttctgtaaaaacaagtttctatcttggttcatagtgtcatttcccttcaccctgaagcactcactgcctttcacactacttataggaattccactgacaacagaaaattcatttcttcattattgcaagatcacattgctctacataaaattctggttttgcagttgtttttcttttcaatcattaagaaatggcattacatttagtatgaggaatgagtcgatgtttgattattcccctgtaggtgatctattgtttccacccttagggctgcctttgagatttttctttgtatctttggtgtacagaagtttgaatacagtgcctacatgtgattttctttgcatatttttgtgttttttctcagcaaattttggacattttcagctatgatttcctcaaatatcatttctgtcccattttctcatctgccacccacaatctgctgttaagattctccaacaaatcattttttatttcagattctgtactttaacctttggttctttttagtaatttcatttcttttttcttcttctgagacatgcaaagtatagtggactggttgatattgttgtacagatcactctgcacatttttgaatcctttttctctctgttctttacattaataatttctattgacctgtattcaagtttactgacactttcttctgccatctacaatctattgttaagccacttcaatgactcttcaaaaaaatttcaggtattataccttaactttttacttatttttgaaaattttcatttctctgcttattttctcatctgttccctcattatgactatatatatacatatatttttagagacagggtctcactctgttgcccaggctagagtgcagtggagcaatctcggctcactgcaacctccacctcctgggttcaagctatctattctcatgcctcagccttctgagtagctgggattataagcatacgccaccacatctggtggattataggcgtgagctaccgcaccgggcctgaaaacatatttttttaaaatcctgaatatatttataatttctgctttaaagtccttgtctacaacttctgaatcatcgaggaatctatttccatggactttaaaaaaaaattacatgtcacatttttctgtatccatcactggtaatttttgaattacagttgaacattgtgcatgatatttatacaaactctgggtttggttatctttctctaatgcaatgcatttttcttctagcaggttattaaattactagtcgaccactttgatttgaagaggactggttttattatttgacagaaactttcaatgcttcaggtttgtctctctttctataattaatttcttagttcttagctatcatctatatttctaaggtttgatccttctgggattcataaagcctgagacatttaccaaacccttctaactttgtaaactcaaactcctaactttgtctcctcttcatctaatgtatctgttcagctcttttagctttctagttgttgcttttctccaggcacttataggctcccacatacatgcacagtttatatcagccagaatgttagggtaacttatatgtagattcatgggagccttccctcgatggctccatcctttctaatacttccttcctcaatttcagctactttgccaatgccagctccattcgctaacatcacaaaccaataagattgtggttttctgcctgaattctaacttctctataccatacagactgggaagttccttgagggaagaagctgtaacaaacgtgaattttacccgggacagttcactccagattccaactgcttttggtcactctccggtgccttcaaataattgtggtgttttttttttaagtttttaattggagtttagttttatttttaacccataccatggtttggaactgttatctgtggaaatatttgtcctgaaacagtacaagttactcctttattaccaaaatcacaactaccaaaattgtggttttatgttagatagcacttgaactgatatggaaaactgcattagaatcaaagtgtctatagggcttcctctctcaatattcagtattttaaaattgagacaagactattttttaaccttaaaaaaatcactcatagtgccctaggaaagtgctatatattccactcagtcgctaaatatggccaatgaatatttctataattaaatttagcagaataatctgtgaataaaatgaaacagacctgtatgtaaagaaaactaccttaatgaacttgcttgggagatcagtggtatgtgatatttctaatcatgacagagaagttgaacatgtggtacagttgtgtagggaaaatggataactcttatcttcattattttttaagtcattctaagagaagcatttgctaagtagtttatatatatgaacttatataattttcataacaatttttaaaaatagtattgtaacattattttgtagatcacaaaactacaaagtatcccaggccatcagactccagagttaaattccaaccattccctctaactacctgctcagaattgagataaaactcatccacagcagtcatcattttttctaagaatatacatcacctattaatgttctttcccatctcccatgttaacaactttcttcctctatcatgtaaacttgctctctatcatctccgtgcctttcttgttcattttcatggagcagccataaaatggagaataacaattgaagcagtgaatagccaagaagcatctctcaatcaatgaacctgagacagcctgttcacttctgtccatcattcttgtcctttagatctcagtttcaaattcatttcttctagacattcatctcttcccatgtttaatctggaaccatctacccttccaccagaccaattatcctggcaaattaatgtaatagaccagtattaattatttgcttgtatgtcttaacaacattctaggtgctgtgccaaaaacaaatgaatagcaacacaaggtcttctggttacaagcacattacattttggttggggagattttgacccatctcacagtcataatcttcatccaggttatctcgtcaacctctatgtatgcatatattccaatattttgttttgcttttctttcttccttgtagtaatttcacacagactattcgcttcaagaacctaactaacttcctgttggtacccaatcctttaactctagagggtcaaatggagccctgtggctcctggcagtgttcctgaagatcaggtccctctggtggaactcagttctcactgccttatctaaccttcctcactcagcttgtaatcaacttaacttttaaagtctttgtacacattaggtaatatttgttctctgaactcccagaggggctgtggtaactgcccaactaggaagccctacccttcattattcagcaacagcttgaagaatattctaattctaactttccgccctctgacagaccagctgcatcaaaggctgtgttcccctgtttgtttttttcctgaagcagagtcaccatttcaaactaagtaatctatgagaaaagtaagagctctgggtccaaatgtttaaaacatggctcttctgtgaaccacggcaaatctaaactggattatgccttatgctggagtcagaacttacttggtcccttgttctttgccctctggctccctgcatgctgttcaggggaagttactggcttttgaactggcggtttgaaaacgaaggcatttttcttttagggagaacagtctttcagtgatttaaacaacaagccttgtgatcaaaataattcataaaggaaaagatttatgaagtgacttcactagcacacaatgcattttaaaaactttgttttttaaataaatctgtcagtacagaagccaagacaacacatctgaatgcaatatcagtggacacaccctgaatctcttcttctttgcttgtccaagactgtggtagaaaagggaaatgattctctttgtcttttcttatttaatattattattaaaaattttttaaaaattctagttccatgaaaagactttgaaaaattgtgcctacttttgtttcctgcaggaaaacctgccttgtaaaaatgtattttccattgaccacttgtgcttgtttaagaaaataaaaaataaataaagaactccaacttataatgaatacctctggcattagggagcctgttctaatctccctttatcaagtttgagtgatagttctgctcaacgagtattgacagggccgtcctgtttctcaggctttcgtttccctcggttggagaaggatacagtgcattttcacattctcaaagtctgcagttgtttttatataagaagcaatttgcttgggtcacgtcaggtcgaatgggatgcctgcccagctcttggttttaaaggaaaaacatacagaaagacacaaaaacacagcagtttccttcattaaattccactctacctgccatgggcttctagccacaatggaatttcccaccctggcctagcctagcctaacttttatttttagggattttttttcccctttaaatcttatgagctttctttcaagtgaactttgaggtaaggattattaaatgatagagtaattgcctggttaaaaaagaatcagacataaaaaacaaatgcctagtgaccttccataatatcgctggataaccaccccctggataacagcctttcaaaaactgttcataatcagcacaacaagacaggtcatgtaatttaaaattaaaacctgaatcatttaatgaatagggatcagcatttttttcaatagtaccctcttcttacctaattgcattggatgaagataattttggagaagaaaatgaataaatgaaaacacaaggaactagataaatagatggggcgggtggatggggggtggagagagagacagcaagtgagagagagaagcttttggacctctctctccaaaaagccatttatgcttttccccattgcctaggggcaactgatttaatcaggattgttcatgtggattatctaaactatgaaaagcaacagggagcacttcccaagaaatccagactgggtgtgctgcagaatacttggtttggggcctggagctaagtagactgttcacattgtactcagggtcctaagaaaagtggctcagtgtctctgtaattctttgtccctttgatctacctcaacatttggtgtctcttggcattaggaaagctcacgaaaatgaccctgcctagttaacagattcatagtctgggcacacaaaaaaagggtaagaaagaaaaaaagctttggtaatgagggagagaaacgtaccttcttgctatctttgctgggcataaataaaaatcgaaagatgtgatttttggagatgtgaatcccgttcttcccatatttagtaatagccttttcagagccaattcaagaccttctatcaaccacctctgttaaacatatcaagttagatttctcattcattattttcaagctggattttgcataatcttccttcaaatgaagaagtttacttttcgaacatgtcatttgctcttagcactgttgttctccttcacccattttggcttcttatcctcaaatccctgattccttattaaagtggattgttaatgcagccattctttagcaccacagcacatttataaatcaaaaattagtttactctgcctggcttccaaaaccatttgctgcttgaaaccatttcatgagtttgtctactcatgtgaataaataaaaacttgcctataatgtgactttgggaaaggaaagagcaactatatgaaacgaattctacagaggccaaaattattttcacgagtttcatggattcagcccttgcatgtgccattctacattaactttatctctgagattaggattttgcttctctttttttttttaattatactttaagttttaggctacatgtgcacattgtgcaggttagttacatatgtatacatgtgccatgctggtgcactgcacccactaactcgtcatctagccttaggtatatctcccaatgctatccctcccccctccccccaccccaccacagtccccagagtgtggtattccccttcatgtgtccatgtgatctcattgttcaattcccacctatgagtgagaatatacggtgtttggttttttgttcttgcgatagtttactgagaatgatgatttccaatttcatccatgtccctacaaaggatacgaactcatcattttttatggctgcatagtattccatggtgtatatatgccacattttcttaatccagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactcacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccatgagtaggttgtgaaaattttctcccatgttgtaggttgcctgttcactctgatggtagtttcttttgctgtgcagaagctctttagtttaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacacaattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactatgcttcataagtgaaggagaaataaaatactttacagacaagcaaatgctgagagattttgtcaccaccaagcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaatccacacataacaatattaactttaaatgtaaatggactaaattctccaattaaaagacacagactggcaagttggataaagagtcaagacccatcagtgtgctatattcaggaaacccatctcacgtgcagagacacacataggctcaaaataaaaggatggaggaagatctaccaagcaaatggaaaactaaaaaaggcaggggttgcaatcctagtctctgataaaacagactttaaaccaacaaagatcaaaagagataaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacaggattttgcttcttaagtagatgtcatttttctccagtaaaaccaagtggtttaccctgacatttagtagtaatttagtgatttcagagttccttctaaatctaaagtaaatgttcatgagactcatgaacttgtatctagacaattaatctgagcattttaagacttccctgaggctacatataatctctcacaaccccttgcaaaacctgagattttgaaccactgtcaagtttgtggttgccctggtaaggagtaaagcaaaatcattacttatggcaactaccacacaaacattgtagtgaactgaagtataagaaaatcactactatactttagacagaacattaggattaatgctggtaaccaaggaactaagagcctgtaaatataactggcttaagaaggagaacaggattaaacaatattggagtttagaaacaaaagtagtactgtatcaacctgtcactatgcagccagtcattacaataaaactaaccaaaggatggcggcagaaagaaataaaagtatttttgtgtacaattcttcttgaagcactacttgaattgcatctgtagggaacaggtctcataggtctattatttgcccacctccccaacacacacacacacacacacacacgtactagcctaggccgatatctactgtggtaagtttgcatctgtgagccactgagcagctgctttatatatgcagcataggatgaaagagagaaaactggggtactcatggtttttgtgtaatatcacaaagaaaagaaaacaaaaaaaggcttagagaaagttaaaggaaaatgggcagtggtacatatacagaacaagttaggattccctaggaactggtaataggactaaacttgcttaacatctatcaaaatgacttacttattccagggtcttgcatatacatagcagaagcacaattaatttttgctgaatgaataatctggaacaaggaatgtaaaataaattatccaaaaatgttgatggaatgaaacttttctgagcaaggaaaagctaaactgatggaacacaatatttatccaggtgtgcagaaaggtgccagtgcaaatagagaaaaacaaaatattcaaatacagtcgtttgccgtgtaatgacattttggtcaacaatgaaccacatatatctataccatggtggtcccatagattataatactgtatttttgctgtaccttttctatgtttagatatgtttacatatgtaaatacttaccatctactctgttacaattgcctacagtattcagttcagtaacatactgtacaggtttataaggtttatggcctaggagcaataagttatactatatagcctatatgttagtagtatataccatctaggtttgtttaagtacactctatgatgtttccacaatgatgaaattgcctaaggatgcatttctcagattgtatccccatcatcaagtgatgcatgtctagtttaattataagtcttacctaggaaagggacttaaaggctatgagctctttcaggcaaaaaggccttcaaaattttggcactcattaagtaaagtaatgaaaataaggtttataattcccttatattaaaccctctgcaattatgtgaaactatctgtacttcaaatgccatgttcctataacataacaactcagggtgtcttacacaggacagtcattaaagagtttaaggtagattaaaataatctgcattagtagagaacaaattattttgcggtattataacaattcattgaacatgagaaaaagcaaacaaacacgcttgttaataaatgttacttaacagacatcacactgacatttcttagtgactgactgccatggaagctttctaataagtctaatttttcccacgctctgagtttataagatagcaatattgtagctttgggtgtttacctttgtttatttattgggcggagttttattgcgtgcctcctccagctgtgccaatctggtaagatcaaatggaatcctttagctattgtcactatcctaaatggaccgcatgcttcctttgtcccttgcattctctgattttcgctgggggttatctatcatggctgtacatccaagtctctaatctatctcctttctcatccgtttttcctgacttatttcccttttccctttgtctatttccctgtgagaagccaaaagactgtatagttcttagtagcggtagtagtgctatctagagttggcatccaacagcaccagtgttataatacactttctacaatcaagaaatgatttgatttccttgcctcagtagaaattttacaagttaacagtggttcacctgatataaaccataatatttctatcatatcatgaaagaattctaaaaaatctgttagactttcttctacaagtttgcctatttcctctgaatacagttaattcacctggcaacaaaggagattagctatttctttttgtatgcagacagaaagaagtgtgatctttctttgccaataaaaacttctagtaagtggtgatagacttcaaaacccttctttttatttgaaaatcatggttcagttatcaggaattccaaattcagaatctaagaacagtgatcctatatagtcttgtgattttgcacatgctagggattggtaagttgctgaagacttcttaaataagagaggaagcatttttcttttcacttgcaaagaaccaggaggtacattaaaagaggttttagagtaactagaatgtgtgataaactgttcactttctgttttaaaactgtccatgaggttccctttagagataggacagactacagagaacgtggtgtctcgtttctatgggttgaaattccacagaacaatgctttgcaaagagtcataccaccagttccttttcctgtgagatgcaaatactaaaaacagatatgggctggacaagattattttaaaaatagatagaaggcaataaaagctttggtgatattctagattacatatgaaatgtgtaaaagcgtaaaatgaaaagttctctactttttaaaagctgcatcaaaatttccttcctacactgtaatcgtgccccttaacccatctatgcctgaggttgcaatttctttgaatttctgcaatcagaccatggcgatgaccttgagcagtaggatataaataactcctccatgcttagcgttccaataatggaacactaggcataaatgggataaaacacaaattgctaggttcatgataaacagagcacatctgtaaacaaaataacttttaaaaaatatgcctacatatataattttattacttctagaaacacaagtgttattagacttaaagagagccagtgaattgaatcaacttattctgatatgaacctcaatgtgatctgattgcaggctgcaatgattaacacgttttaaaagaaatgggtccatactatactttccaactgcccacccttctgttcttcttatgctacagatttatggcagcctaacctccagccaacaagttagagaattgggtaagacatcattttggctttttaagaaaattatggataatcaaaaaacatgacacaaaagatttagtggctattatcagggtataaactaataactaaaggcatttatgtgttaggtaataatgatgcttagaaaattataaatatcaagatgctctttcaacaactatattccagatttaggaattttgtagaggatatggcataagagtgttaagaaatgtatacttttttgaaaataaaataaagtctgatttatttattatccaagttcctgtgttttctgggaaaaatgtattaatgagaggtagcattatttgatagttaatggagagtggaaatcatctgttacaggcccacatgctcacaagcaaaataatattctctcaatcctcaaatggaaatggggattataaaatgctataagactctgtcaacatttctgataaattccatgaaaattttgtgttacatattttaaaaattgtgtactatgattataacatagttgattattaaatatgtaatcctttctttcagattattcttcttccttaaatgtaaagggtatattattttcttgatttattcttttggataaatatcctgtacatagatgtctgaaatccagcccgtcagtttccctttaaattctagcatattttaaaggaccttaaaagatgactgtggagtactgcctgatttggaacttgcctctgtctcttacacactgtatgacgttgggcaagccacttaacttctcagtacttcagtttcatcatcagtcagaacagcacaataatagtaccctgctcctatggttactatgaggattagtgggtttcatactgtcaataataagttgcctttctgggtctttgaagtacttgaaatcaggttaattaaattaagcagagctttggtccctttgtttgacaagtaatctccaattttcatttccaggttctgatcccctaaaatcagtggaataaaaccttgtttgtgtaactgccatcttcctgccccaaagccaagattaatttacctgttggttttagttttcactaggtctctctttagctaggtgcttctaagggtaaaatatcaactattaaactatttgaggcaggagatgttgaaaggggaatttaattgttaagtcaatagcagtgtgccagcttagtctgcctttcagaaagatcaccatagtaataacgagaccaataaataaataaaaagtataaaatatacatctatgcagaatcttagaaccctttctctaacacataagtcattaaaggaagctctgaggtctgcctatgtgattcaacatttacacacatcatagttctatggaagaaattctcagttgagagctaccagctttcttcagatcggatcagatttttctatactccattataaacaacaaaaacaaaagcaaacaagtgaacaacaacaacaaaactgtagttgtggttcactccagtaatatatactaccaattcagtggttcttaactgggggacaattttgccacccccttccccaccaggggagaactggcaacatctggagacaattttgataatccaaactgaggggtgctccaatggggagaggtcagaaataccactaaacatcctacagtgcacagaacagacatctaccctgcatcccggcaaagaattatctactccaaagtatcatagtgccactgttgaaaaaccctgtgctaaactaacatctgagagccactggccttaaaccatcagccacatcaacacgtaagacactcagcctatgggatagtctaacagttaaagaagacaccttagagggaactacttcaaaaatatataaactgacaaatctggataccatactaaggaaaaaactggtaaaacaggtagttgtttgaaagcttcttatgcccattattataaaccaataattttagattactgaaccaaccagactaatattccctttgaattccaggaggtataaaaatatgaagtcatcgactatgcaacattatcctgctatggagacattctgaaatggtttataaaagcagtgaacacattaaaaaaaaaaaaactagcccaaatgagttatgcaaagttaaagtcattttttctaggaccagttttttttcctgtgcatagtattttccatatgtaccgcaaacattcatttgtgcagaacatagcaccacatttctaatacaactcctctctgaagacaaatcaggctaaagctaagagttgcagaaccatttctgtatgagtcatttttagcacaacataagccctagagtaaaatttattttctaaataagccacaattattctgcaaacatttaacctagcacctctcaactgttaaagaatgtcaattatatatgaaaggaagaacaaatataaaggaaatttgaaaatcaagaaaattttttctgagaaaagtttgtgagaattattatgaatacagctaaaattcaaatatgtgacattttatttttttaagggtttccctgtcaaagacaacacatatttttctaatgaaagaggatgcctgaagttgacattcataagagcatttggatactaccaatgtgaagttgtacagatttactcatttctgcaattaccctcttgtgtttgaattctactttggttagtggtagcaagcactaaactgtactgagggcttcgcaaaagttgactttatttctttacacttagaaccccaaaaatttacttcctaggaagatactagggaatcatatcttactgaggaggaaataagaggtggaataactggattagcctcacaaagaatgaaagctcagtaatttctgagttggcaatatttttcaccctccttttctccatttaaatttctagatttaccttcaaaacacttgcctttttctaccttaagggaagttctaggatcagggagatggagatagagaaggtagagatagttttaggttttcacagaagttcaattaaaaactgccaagtacctcctaccaagagaccaccactaaaatttatttctagaacaaggtgcagaaaaataaaaggtagaaagcaggaatgttctggtactgtaaaatatttggggaaaaagtctaatttctgttctcaaaatggttactatcttgctctagagaaaaacataaaccctcttaaaataactgaagaacaataagaaacagtataattaagtgtaaaaatgggtggtagaagcaaaatgctgtggggcacccatgtgtcttacatctttccaacacagagaaaagagacaatgggtcaaatgcagcctactctagtctctgatattagtttcattacacagctataatcccattacaaagaacttgaaggaactgttgacattttttgctgccctggagtttattgtctcaagtattgcttgaaataccagggtacatgcagagatgtctgctctaatggtatttgttgacctacattatgttagggttagcctgaataaatggagaggaacgctacatggaatcagttagttagattgtttgtaagtaggcgtgcattatttttaccatgttttattatttttaacctaaagactacgcatttaaagtagggtattatctgtaagtaatcttgttgttatatgaaacagtaatatttattaaaagtgcttttgtaaagcccaaaaaggggatctgcagaggcagatttactgcatatttaatggagcttaaacctcagggaccttcacttgcgcagccccccttccaaggtcctgtacttaactctgtaatcataattttgtattctttttcttcaagaggaccccccaaatagtttaagcttctggtaaaatcttgatctagcctaggtataaaataatcttgaagggatccaaactgatagttctaaaaggctgatgctgagaaagatacaaaatgtgcttttacaaggatatcatatcaattatattttccaaatgtatctctcttattgttgtcgctcccccttccctgccaataaataaatgccattttttttttttacctcactgttaaaaggttattagacccttttaaataagatcggtctgttcagtgactgggaataaccagagtgttaaaaaaaagatgaaaaattcagaggcagaagataatttccaagaatgaaaagatatcttagagagactcacaaaatgtttcactaaaacagcaataattattatccatacctaaggagtacatgcatttgagaaaaggaagggcatggaaagtctctcaatacaatttacagtagtacctactgaaaactgtgctgagtttacacagagtgtgggaatttttaccaccagtaacaccacgtgtctgtttttctggtttctgaaaaccccaaataaatcccacaagcgcctctaaactccaccatggaattctcacacttctgagtaagaagttcagaacagaataaaaactttggatgcagtatgtctgtctatagtttttcctataatgccttgtcccagtttttgaagaaaactgaataaaaattaattcaagaaaaaaaatgaatgaaattacctcaaatggaatattaaattgaaaaataatagtcaaattgctcataaccacttcctgttaattttttttctcttttagaaatggagtaagaatgcttcaaataaaaaacgtaaaacccatcccatcccataaagggcccactcacgtaaacaggaagcttattaaaagaacttttcttggtttcctggcaaaatccagcttttattttggtggcagcatctattaaggaggagactcattttgtgggcaggatgaaaaattaaacattgcaaatccatcaggtacttgctggattagagttagttgactgacttgttggctacagggaacaaggtagttctgaaaccaaggaacaagctgccaaggaacagtccagccctgcccaaaagatgatggtcttctccatccaggcagcacaaatcaactcgaggttccaagagggccagtagacgccagcctaccttactgtaaagtgtctcacatgcatatctaactgttctctcctttcctttacatttaaatcctgttgtattggcttctctgttttccctttcctggaagcgctgtagcgtaattaaaagagtatgagttttggaatttcaaaacttggtttatagtccagcctctgccaaatactgtgacatgttacctgcttgagccatcattttctgatatgtagattgggactaacaattcttccttaatcagctcaagtttcacaaaatatgggtaaacatcacgtgactcaaaatcaactgaggcaaaaattcagatgtcaatggccctttcttgacttattagaacctccatgagctagaaattcttggaatctgaattttaaactcactcccaagtgatttccatacacacagaagtttgagaaccacatcccaccttgtcttgtgtcaggattaaataaaaccatataggtgaaacttatctgtaaattgcatatcaagacatgcttagctgctctcaatagtatcattttccagatagcccaaagcaccaaagtaaggacagcgggccattttcccaagatctttcttccagcttttccctgccatgccaacagcattcttcatcttcaggtaggcagggcaggttcactgggggttggggtagagctcagcactgtgacacaggcagtacttccgtagaatttcatttatgtgactgtacctaccccacagggtgatataaggattaattcctatttggtaatttactgtgtgtaaaatgccttgagccccttggaggaaagtgctatataaatgtaaaataattattataataataataacctcgactatttaactgatcagtgaattagccagaagatttaggctgccaagggacaaggctgaaaccattataagtagaaacactttacatcatcatatctcaaactgttatcacgaaaaagggaaacaaagggtgaaaattaagataaatccatgttctcaactgatttaaatgacagaggatcactagtaatgattcatgaaagccaggaaatgcaaaaatgacagctgcattgtaattctaactcagccacatgtcctgaggttttgtacactttggtcttttatttgtagggaaaatatctcatcagtgcaacatctaaaatttagcattatgaaggcacttgactatgcttttgcttagttgaaatacgttcataatgtatcccctatttgtaggtaatgatttttctacctaaaaagcattgacattattctatgaagttccaggtaaattttgaatcggttgcttacaatctgcctccccacatacacaccctaagaatacactctaacaaaacaatggtgtatttctagatctaaatttaggaaaccaaaatatatagaagataccttttcttcccaggaagaaaatgctttggtatataaactcacatgagctcaaccgtcttcagctcttacattatttgttttatttatttattagattcatgaagattcttctaccaaaagctcaaggggctgaacccagaactttcatatattgaatgtgaatcacttcttaaaccacagaaaggaaaataaagggctatagaaatcttaatgggcaagctccagatgctcaaaagcaattgtttagttactctacttagttatgcatcattcaaaacactttctaacaatcgggcaagaaaggttcctttgtgaagaacaggctttggggtcttggacaagttttaattctagttgttttatagctcatacaaaatagttgtggtgcatatgtaaagaggtactgtacttacatgcaataaagtttgcagatgaatattttgaaaatcaaagaaaagaaaacaaggggaggaatgagcatgtggtaccttgctctatttttaattattaacttgtagcctcaaagatttccatttagtagaaacacatgtaaactacaatgaaggagtactagaaaataaagtcaattggtataactcaaattattttgtaaaatgtgaaattaagctttaacctgtctatgtggaagggtgatgaataaatgaatgaatgaagtaaaaaatcaaagatacagagttgtaactgattttctttgcatgaagtagtaaatattaatattagaaatatcttttgatttagataaaactggccttgggtatataatacacaacactgaaaaacatttcaaatgtggtatttgtttaaatatatacatacataaacacacacatacacacacaagtcaaaaatatgggtgttctggtatagttttctgccttcaaagggtctctggaaaaaacagaagaaaaggtatcctataaactgcttttgctgaggtctctagtagagagcaaatcgaggcaagtgctgcccaaaataatctctattacaaacatttaaaaaatctatctttcatatatatatatgaatatatattatatatattatatatatacacaatatttttaatttttaattttattttatttgctgtatagctaacagcatagccaatgccctgatcttctagccacactgtaatttcttgtccttgcatcacaaccccagctgtagtcatcaaagtggaaaaactgacagcattgtctgaaagacacagcttgggaaaattgctccttgtagctcccctgtcaatgaatattatcatatttttctcatggataaggttactgtgttttttttgctgggccgggggtggggaggcttctacatacttagctactaagcacattaccattccgtttgtggaatggactaaacgtgacaatgcgagctgtagggttagcattcccaacattctgttttaaagtttttgtgtgtatatcttcaaaaataatattcctttatgtattcagaagaagtaaaatcacaattatattttacttgacattactattttcttaaggaggctaacagaaaaatcaatgggtgggcataaagagaaagaaatcatatgaggctaccacacatattctgttactgaatttctttcacctaaatatacaatggaatgctctgaattgtatgttttcttttcccatcatattaaactaaagcaaagttcttgggctgaaagtagaaaaactgcactttagtgttctaatgatccacacctttcacatattcacttcgcttacaattctagatgctaactcaataagaaagaaagaaacaaattcagagtatttcagtcaccaacaacaacagcagtaacaataacaataatattaatatcagttaatatttatttaactcttagatatactagatgccattgtaatcacatgtattaactcgctaaatcttcacaactctaccagagagtactgttattactccgattttattggtgaggaaatagaggcacagagagatcagaaacttgcccaagatcacacagtcagtaagtagaggagtcaggattcaaacctaggaagccagactctgttacaggatgaatattttggttgctaaaggccccatcttccttacttctcctgatcctcttccccaactgatcagcttgcagcattcatttgatcttctcaacaaattacgtattcatttgcacaccgtccatttagaataacacagtagttaaaaacttaggctctggagtctaatatgagggtttactgccacatattggtagtgcttaacttttctgtgcctcagtttccttctgtataaagtagtaataataaaagcaatttcatgtatttgttgtgagggttaaatgagataatgtatgttggagctcaatggaaggtcaatgttctataaacattaagttcattattattgatttttatctcttaataaatagaatccctttttccaattagattgtttttcagaaaaattgtgaatatgaatcttttttgtctcgtgtaggggttcccaaatgttcagtatgttgaactcttagatgtcctaggtactactgaaatcacgtgtattaacattcataacaactctgtcaggtaatacttacatttacccataatattataaatgatataatataccaatgtctaaaatttagtgagaacttactcactggacaagtgcattatggcattatctcattctccctctaagcctctgaactaggggatttttttttttttttttttttggagatggagtgtcactctgtcgccaggctggagtgcagtggcacgatctgggctcactgcaatgtccgactccctggttcaagcgattctcctgcctcagcctcctgagtagctgggattacaggtgtgcaacaccacgcccagctaatttttgtatctttagtagagacggggtttcaccctgttggccaggatggtcttgatctcctgacctcgtgatgcctgcctcggcctcccaaagtgctgggattacaggtgtgagccactgtgcccagccaactaggggatttttataatctcaagtttatgcaggaggaaacagaagctcacctcggtcatcagctggtaaatgttcacaaatgtaaattcttaaccacaatgccatactacctgctaaaaaatgaatttaaggtagatctttagtaaatatatttggtcttgatgatgaatcaattgaattctttatttctgttaccagaaaccttgcacttaacaataaactaatgtggccttgaccagcagccgccagtccccaggcttcagacactggtacctgttaggaacttagctgtacgggaggagatgaacagtggacaagcaagcattactgcctgagctctgcctactgtcagatcagcagcagcattagattctcattggagcacaaaccctactgtgaactgtgtatgcgagggattgagtctgcacactccttatgagaatctaatgcctgatgatctgaggtggaacagtttcatcctgaaaccatccccacacctccagtccatggaaacattgtcttccatgaaactggtccctggtggcaaaaacgttggtggctgctggcccagacaatatcactcattctgttaactattgaaaagagatgactgtatgtcaggtacatgccaaatactggaaatttgaaaaatatatatatatacattgtgggtctaaaactgtatcattaaaagcagctaatgatttaatatcatttcatttactatcattttctgtttactcttacaaaaatcaaacttcttcctctccccttcctctctctgcctactctttcttattccttcttttaaatcaaagttttacagtattaaccttacaaagatttttgcccataagaaggttatatgttaaggcaaggaactgttttaattatatttactcttcattttgagtatatttctttttcatacctgacaaagacttttgaaatgactaaagaaaggcaaagcaatctgattctttataaaaaaatctttcatatgcaatcttttgtctgtagtattctcataatagcttagaaattttaaaagaaggttttagctggttttgttcttttcaaattggcagaatttgatttttttcctcttcacatttggattcactttaaaaatcaacaaacaagaaaataaaaacatattcaatttaaaaaatatgctctccattggtgccttggcatcatcaaccaatatcagcatcactctgaaaaccatttctattctgtttttaaaaaaaagagttttaaaatgcacacataaaatgcacttaaaattgatcctactgtattaaggagagagaaaatttaagggcaatggagagctttgctgtaaccaactcttcagtcaactataggatattgttaatactgccttcacctccacactgaagatataggtaccattttgactgtgcttttgaacaatatatagctaaagatttgaagtgagtaacttcaaagtcagtagttttcatgtatacgtcgcagaatcactgcatcttatgtatgactttaagttgtattaagctgataatttcaaaaagagagactttcaatgaaagaaaattcctgaaatttggtcattaaatggttcgagtacgtagaattacttacaatgtaatgccaaagaaaggtatattgtatttatccagaaagcacgagcataagaatgacctcagaaagttattataatttattacttcattaaagatacatttctagtccatctattatgtgctaggccttataatagacaacaaaaatgcaaagaacaacaaatgtgatctgaaaagtagtaaaggttagggaagatgggactagtaagagagaacagaagtaagaaaataaagtgattataattgtaactgccatgagctgagggcatatcatgcattgaggtaaggtcctaggtgcttaatatgaacaagccctgcaagacaggtatcataatctttgtctcacaggtggtgttgggaaaactggctagtcatatgcagaaaaatgaaactggaccccttccttacaccttatacaaaaattaattcaagatggattaaagacttaaatgtaagacctaaaaccataaaaaccctagaagaaaacctaggcaataccattcaggacacaggcatgggcaaagacttcatgactaaaacaccaaaggcaatggcaacaaaaacccaaaattgacaaatgggatctaattaaactaaagagctcctgcacagcaaaagaaactatcatcagagtaaacaggcaacctacaaaatgggagaaaatgtttgccatctatccatgtgacaaagggctaatatctagaatctacaaggaacttaaacaaatttacaagaataaaacaaataaccccatcaaaaagtgggcaaagatatgaacagacacgtctcaaaagaagataattatgcggccaaaaaacatatgaaaaaaacctcatcatcactggtcaatagagaaatgcaaatcaaaatcacaataagatactatctcacgccagttagaatggcaatcattaaaaagtcaggaaacaacagatgctggaaaggatggggagaaataggaatgcttttacactgtttgtgggaatgtaaatatagttcaatgattgtggaagatagtgtggtgattcctcaaggatctagaatcagaaataccatttgacccagcaatcccattactgggtatatacccaaaaaaattataaatcattctactataaagactcatgcacacatatgtttattgcagcactattcacaatgtcaaaaacttggaaccgacccaaatgcccatcaatgattgactggataaagaaaatgtagcacatatacacatggaatactatgcagccataaaaaaggatgacatcatgtcccttgcagggacatggatgaagctggaaaccatcattctcagcaaactaacacaggaacagaaaaccaaacaccacatgttctcactcatacatgggagctgaacaatgagaatacatgaacacagcgaggggaacattacacaccagggcctatctgggggtctacggctaggggagggatagcattaggacaaatacctaatgtagatgttgggttgatgggtgcagcaaaccaccatggcatgtgtatacctatgtaataaacctgtatattctgcacatgtaccccagaacttaaagtataacttaaaagtttttttaaaaaatatgtgataaaataaaaaaaagaattaaccacagtgccttgcctattcttctataacagtatctatttcactctattttattttgaagctatttatctccaagtttctttctagaatctaaacagttaacagcctgagggcattgaccttgactcttgtctaagttttacaaacaaacaaaccaaaaagcacactgcattgatatacttggccaagtaatgatgtccaaatgctacaatgtcacaaccagtgctcagtaactattagataaataagatagagtcattcactcaatcattcactcctgcatgtttcacttagtaatcttgtacgctcattgaataaattaaaagctgctttatgaaaatgttttctgttaatttgaataaaaacctttacacatcaactagatacaaaagagaaatctattgtttgacaatgatcgttactgaatcaaaaaacagtggggccatctgcagggtacagatcatgctagagtcagggaaaactggtgataaacttcagaaagccaagaaatataccagcttacaacttagcagcactgcctccacacagtcttcaggtatttattgactgtctcacactaatgcatgagtgcctgtggtaatggtaaaagtatataaatttacttgcccagagatactaattgttaaaacaaatacaacaatttaatggcaatgcaagagaagacagactaacatttacaaagctatttcttgtttaggcaagatagtagactctaaacatatattatctcatttaaattatcatttaaaaacccttagattgttagtatttacccattttaattaaaaacataactgagcgtataatttttttttttttttttttgagacggagtctcactccgtaacccagattgcagtgcagtggtgcgatcttggctcactgcaacctccgtctcccgggtttaagcgatccttctgccttagcctccaaagtagctgggactattaggcgtgtgccaccacgcccggttaatttttgtattgttagtagagttggggttttgccatgttggctaggctggtctcaaactcctgacttcaggtgatccacctcccttggcctcccaaagtgctgggattacaggcgtgagccaccacgcccagcctgtaaatcttgacaaaattcccagaggcaaaattattagaaggctgggagccaggattaaaaaacataaaatccttggcttttccatttatttcacattgcctcttcttagaatccacttctacaccaaagcagttaaaatcaatgtggatttgtattttaatagagggtttatggagtagtgggaaagatagcaaataataactatgtttattgaatactactgttcctaacattttgaacctatccaatcatttaatcctacaacaatcttttggaagtgagtgctattattattattgccactttgtaacagagaaactaagccaaaaagaagataaacatttgaaaagtcataaagctagttagccgctgtgcagctgaacttgacagcctatagcccacagagtttaaccatcatgctatattgcttcattaggttgaaaggttattaaatgaaatggcttaaacaaagttctaagcacatggcatggcacagagtaggtcttcattaaatgttagtttctgttttttctttaatctctaaaattctataataataatacctttattttcaaagtaattctgctttttaaagactttatgacatctgatttaaatttcacaaaaaaaggatggtgaatgtggaataaatcttcacaaaaatgacactgaagattatttaaaggcatagaatgttactcacaacacagatttaagagacaaaagtagaaacagtgttcacagtgttttaccaaaaacaaaaagggtatatatgcacaggaaaaaaaatgattagaaaggtatatccccaaagtttgaaaacaaattacttctagacgattgtggggattttaatcgtcctcttgtaatttatgctacgcacagaattctacaatgccttttgtatgctttctatactaagaaaaaataaaaaagaagagtagtactccttttttgagatcataatactgaggggggagaaaatcagtagaaatgtgtgagatttcaccctcagtgatagagctggaatagaattcgcactcttcatctctaacctactgtgttttatctgacccttattttctattcagtgcttaccataattgatgaattcaaaactaatctatgatgaaaacccctgaaagtgattagagagactgtgattgtaaatgtggtatcaatcactaacacaaaagtcccttataactcatcaggcttcttaagttgtttattcaaaccatttgtttctgagtccaaaccaataatatatgtgatagaccggattactttctctaattcttcactccctctctataatagaactttacatccataaactttaccatatgacttgaatgtaactctcagtagagtatgtgttaatgtgggagatgggatatatatctctgtctcttggctttgagcttggttaagtgacttgctttgactaatgaaatattagtaaacatgaaatgagcagagactttaggtattttctgcgggaacaaattctgtagttgtcaatagtttattctcctagattaaatgtttgataaacttttctaaaagaaggaatttttttttcagagagaaatatagctaacatggaatatcatgtccttttgtacttacctggagccaaagtaaactacttggaaaattaaggtaccttttgctggactattcctcatcctttagtttcttcagtccagactgggacattttggttaaaaaggagtaggcttgtgatgttaaggtgatcatcttggtcaccataccccagaaaaaatctttacatatccatgtcttagacactgaggtacagaaagagagttctgaactttccattccattgtcatttgtgttgtggagtcttattaatctgtctcatggaaggtgggaatcaggctatgaatggacaataattcatggggggcagtcaacagtagagaagaagttgctgcaaattgattaatacaaacaaaccaacctgagtacctggctcattttaggttccctccaaaggcttcagtacaggcagtaacttagaaggtaatctcagagggtaagataataataaggattgacaataataaggattggccaggatctctgagatttacacaaaatggctccagaggtagacattataaagaaatagaggctagaacatctctttttccagctctattcctcctttagttgagagtttccccagggcattaagccctgggggcttaatgtaagccccactctccccatcctagattttttgagatctcccagcattggaaaaggtcctggggcagaaggaaaagcatacttgaggtgggagtctgggttagcagagaacggcttcaggtgcagctgaagggaccatgacagcactgcctgacatctctgagggactatgacaggattctgacagccatatctgctacagaagcctgtaaagacttggggtggggggcagtggtgtataatatactgtgtagtctgatattgcatcctttaaagtatgatctggggaaggttaggctgcatcttctttattaaattatattccaaacaagttgtctcctctgactcctgcatgaagtcagactttgggacagtaaatcctacactgtccagctaagaaaaatgacatgttgttaataggcttaactgattctcttgctatgatggcaagatcagatttttagcagtgcttctgaaaatcctgacactcattcaccaattattttcttctaggagtctaatatgtattcatcttcccatatttcagggaagaaatagttgaacgactttagggagcttttcccaaaatgctgacgcatttttgcagcattttgccataatggggcctattgaaaatttttctgacattctgaattcatagcattaagatttgtggtgttgtttttgtatctggtttgtatttatttttgtttttattaaaatacaggagaaattgggacaggttaagagttgcacctaaatgtatgaagcttgaggtctttgaacataaatgagttagatatacagaaagttattaagacctttaagcattcgtaaacatttcatcattgctgacaatatctatttactttaggtaaccctgcctgagcagctcctgcattgctacaaggatgaaggtggggttatttaaaaatttaccaagctgtgaaagagttttctggagaaaactggtttggggactcagagcataaggataaacaatggatacttttatggttacaggagaggagttgataaacccctcattcctctaatgtaatgtataaaagaaaatattgtattcctggtcctcacaaatggggaggtggtagggtaggtaggttatatgaacacacatgtcttccctttgacaatgagtgggcaggcctttaaaaaaaagtctgaaaaaataaagagccctggggaccatttaggctctatcagtgagttctatcctgagatatcaaatccagttgcacagaatctaaatgtcaatatttacaaagctctttccatcttatatcccgcttcctttttcttttatgctctttctaccccttttccttcctccctattcccttgatcccctacatcattctgttttcccatttgctctcatttcctaacaacccccatccccattagtcagtccaaaatctgttcatcccgctataggcttcagtgatggaaaagaaagggccccaaacaaagccaccatccaagacaaggagctccagagggtggtgaattggtgattgaggtaaagcctggggactgagaatgttcaccgctctggaggttcttagcccgaaaagtgattaggcatcagcaggcttgatagctgtatcaagcctcatgatttcaaagctttcatgagctgacaaggacttgctaatttcaaactttctaaccaattacaatcacaaagaactcaggacaacaatcagtgagcaaaatgaaactgctggagtgaagcagccctcggcaggtttcactcttgtagctctgctacgcaatgtgcagctgggactctgcttcaataagtaaataaaaatacattataaaatacaaacatacacaatggatcccacttgctgtcttgttcccagtaaaggggtatgtaggaacgctgtcttgcattcattcagtccattaatttctgatggtgttaattaaaaacttttgatgctggtttgaatggaaaatacctcaaacagtgtttcctttattgaaacaccaagttccaagtcttggattattaggttaagctctgtcagtagtgagaccaacataaatgcttttcataccgtatgctttgacaaaagagaatagtaataataataaataaataaatgaaaaggaagaagaaataaagtgtttagactgaaaactcctttacttcaccaacctgtttttttaaggactaaactaaaaatccaggtccctgaatgtagaacatataattttaaaaaaatcttttttcaaatctttatagaacattcaaatcacccaatgttccaggacctgaattttttatattttaaaatgaagaaagctgcttaaaataagtgaatcagctgctaagtgatttctctctgtcttttcctctactctctctttaaaaagactggaaaatgcttaaaatggtatatgcaattgatatgtgcagcttaaggagcttaatataattactgaggactcagactttctatttaaaaataagatagggtagggtaacagaaactctgagtggtgagtattcatcccttgtgatggtgaggtgtgggaaatgtttccaaatgtttaatccactgagcaaggtaaagagtgcgaagcagttattcacagaatttggtgtccttctgaaaacctagggaagcctaggaaatccagagaacaactgaggaggatagtatgagagatgctgtgcaggaaacaagcaaataaaatatccatttcttcaatccaatgcttttgtgaagtattaagccaaccaccaaaacattctgattgatttttaagactcttctctaattttattttttaattactcttccctttgtgtattggggtctgaagccttgggcacccattctgagaggtcttgtaaatgtgtctcacatatgcccgtttctcttttgttttctaatatacctttctctatcatttttcatttcccaacctgtttattcacactgtctgcaatgtcatctgaatcctcgaaaaaccacaagactttctctttattccccctgaaggccttcatcactcttgttcttgttttgatctacatatctctaacgagaatgaagttctccataaaggctaagcagtttggcagaacttccttccttccctccctaaccgcaggctgtattgacctcaccctcttggatcagtttgctaaaatggcctccaaactttatgtgatatgatagtgaaccttcaacaacaacaacagcaataacaacaacaacaacaagagcaacaggataacttcagtgtaaggcatgtgagaaaaatacgcagagtaatagaactaaaactccatgagggaaatgggcctgagcaaaccacagcatgggtctttttgttaacaaaatgtatgatttttccccagagtacattgatagaggacatagcctacaaaggaccagtaaatgtaaattaactaacagatatgtagcaaatgaatgcatttaaagatgatttccagctgaaatgtttttttttttttttttctggagaccaagtttttgttaaacttaatccttactctctttcctttccagcagcagaaacatctggtcggttttagattccccttggatttccaacttcaaagggaattataaagaataacaaattcatgtaccggcactaaaaaaaaattagagcagcaggagagaatggtaaaattgtccttatttgactgctagtgacaggcgccacaggcagaactatgagaaaagacaaaggcaagatcaccagttgacaaccagagttcctgcaagagactgaatctttggctacatgcaaatatgcacagggcccttaacaatccatagggagatttacttgcttaaggaaaataaataggtaaataaataaaaggagttgaaaggtaaaaaaaaaaaaaaaaagaaagaaagaaatgagttcatgtttgcctgtcacatagtttgttgaaataataacaaataaaccaataaatgtttattgaaagaatgacctggaaataattttaaagatccacttaaccccttgggttttatttgatttaaagaaaattgtgagagttctgattctacaaagggctggataagtcatccaagaaataatacaggctcttaagagtccactaaacttggatctccaaagttcttaaaagtagtttctgtttctcctttggctccagatccttattatcaaaagatgtgacgagaaatcaaagtcttcttagtggccgggcgcggtgtctcacatctgtaatcccagtactttgggaggccaaggcaggtggatcacttgaggccaggagtttgagacaagcctggacaacatggtgaaaccctgtctctactaaaaatacaaaaattagctgggtatgatggcgcgcatctgtaatcccagctacttgggaggctaaggcacaagaatcacttgaaccggggggacggaggttgcagtgagccaagattgcaccactgcaatccagcctgggtgacaaaatgagactccatctcaaaacaacaacaaaacaacaacaacaaaaaaccaaactaactgttcagtacatgctcagtacttgggtgatgggatcatacataccccaaacctcagcatcacacaatatacccaggtaacaagcctgcacatgtatcctctgaatctaaaataaaagttgaaaaaaaaaaaaaagaaatttgtaactgtgtcaagttgtgtttgacaccactttatagaaatggatttattcttctcctctatcattttcttagcaaaactgaaacacacttctagagtgcaggtcttgatataatcagacatgagaaaatgagaacagttagagaaaatacaattttgccattgtaattacctcttacaaacagcctttcctctttcctgttttatgtgcaatgtgtacagcaacaacaataaaaataaacaaagacatgattaaccgatcaatttgtttctccaaagagagaaatagttaagggctaaagtgcctttcaataattaattataagagtctttaaacttagtattgagaggttacagatttccataccacaaatacattaggttgattcacagagtggccatcaaatacccagaaagcaaattacttttgaccgaaatgtatacatcaacagtacggttaggaatgttttcatagaggaggacagaacatacataaccagttctctatggagcctagcatagtgtcccatggaccaatccacataagataagaccatctacagagcatattcttcatatcacagactctaggtaagaagaaagtattctctaggtaagaggagaaaaataagtgaagatttctttcgttaacacttccaccatgaaaggaatgagctgactacagaaccattttcttgaatatttttgtcttgagtggggtttttatccttccttcaccactctaggtagagcagaatcaccaaagttctctcattacggtaatgtcataaatcccatcctatagcagttgtgcatgatcctgtgttatgcatccaataaagtttattcagaaaatatgtcagcttcattaaacagggatctgatgatctgaacaaaccacttatcttgcttttgtgacatgtattggtatccttaggtctaaaatgaaaatcttggttggtgggggtatctgccaaggattccctgcctcatgtaagcagaatcatctaaccacaattctgagcttaactgggggaaaggaggtggaaggtgtatcgtactagttcgttctaagaaatgtcttatagcttgaggatacgtgaggtcacaaatgtaacaacaactgaactagcaccaagagccaaagaggccaagcataaggaaacctgaagcaagagaaaaaggtgtacgcgtacatacaccaagaagcaaatgctatcattaataataattattgttattacagctattagaatgatgaggcattgatggttcacttgggtgaaatatataatacataagctagaaagaactgtgggtaaacttatggatctttttaaaaggcagtttatattctaggtttatgtgatatgagacacataatttaacaccacatataagaacaggatgctgaaaaaagtgaagaagacttgcagctttaaaatagtataatggctagttcctactggtcttttcttgtgacacctgccttagtcaagccatccgatatagttctaaccttttctgatattttaatgatgatgacaggcccagagtaaaggagacaaaataatcagaagattcagaggggaaaaagaaatggaaagaaaaaaaaagagtttgtattgtttataccatctaatctgacaaattttatatatgctctctgtttgctcaggatagtttattgctaatgttatgactttctcttttttttccatgtgctttgctctaccagttttggctgaaaatattttgtatatgtccatactgtaaaccctcatatttttctagagatttagtgtggtggggaaacttttttttcttccccaagggttaggcacatcaatattctagctactcacttttgaggccaatggaaaatgtgctcctaagattaaatagacctgagtaacacataaattcagtttatactgatgcagtatgttgcatagttacatcctgaatttctgatgcgtgtaatacacctgttggacaacacatcactactgaatagtcactgacctacaattcaaagacagtgagacagcacaagactacagatacaggttctctacagacagcctgatttgtacagagcattcctcatctgtggaactctgtgtgtaaaggatctaggctagccatgggaagctggctcatagagggttctaaatatttttagaataaactagagcaataatacaagcacagagagcaccctttgttatacaatgcataatttctttccccccaaacatgttgtttaaaaatgattcagatttttattatataattcccccttttacatatttctaaatgcctcacatacccatcacatgttttccatgtctgccaataatcttaattaaaaattataaacttttaaagccagtgttacatttgatttaagtagatttgccatatttatctggtattggttggctgtagccagactggagttctaagtaataaggggactatgctttcctttcacctcaggtaagaaattgtattcaacacatgcttaaacccaataataagtataattaatgctgtatagatctggcaggcaaattagcatcctaaatttgagtcaagtaaaaaaagtaccaaaagaaaatagttcccccaagaaacctagccaaatctgtgaaatatttctctaggcaaccaaattgccctgtggcttacagatgtgtctaagaatattaggcaactcactgatgagattttacaatcaactgttacatgttagaaaatatgatgtcaggatactatgaagaaaaatactactatatacaataataagaactatttatctgaatagtttttaacattaacgtgtaaaaaatatcctgatggatctgaaataatgatgtactaaatactacaatgtctggggtttgcttcaacataacatggtgatatagtgagaaaataacaggccatcagttagtcattgtgcaagctggtgatgagtacatgggagttcattatagtaatttgtttatattcatgaatttaagattttttatcataaaaaatttaaaaacatatactgatttgaacttttattcatttattatttgttgactgattcatttactgtttatgcaaggtattattgagatataaataataataataatgctcttattgggcatttaggttaaatgagctattcctcttcaggaatattatatatttattttaaatgtttataaggtctatgtaattacatatttcttaggttaaattttgaaagcaggacacaaaattatatagaaagtatgataacatcatgttttaaaaatatatcctcggggaaaatgagagtaaggaaatatatcaaatggttattaatgattggatttaaattatagaaataattactttaatttttcttcattttactcctatgtgtttttctaaattatttttaatgagcatgtatcattttaaaatgaaaataaatatttcttcattactggaaaagatatgttctccttccccaaggagcttttcatttactgaaacagagaaactgcaaacacacagcattgcccagatagtttaaatctccatacctagaagggaaatacacccacaggaaaagaaacgtcaatacagattttatctgatcatagaaacataaagagctttctctgtgttggacagcaatagggaagaaactggcttgtttgcaagccagcaaaagcgtgaaattcagtcctttttgtgatgagatcattttgtgataaatgcaaaaggagtgacaaattaaagtcaccaaataagcctttcccttgagctcctgaggcttactaatacgagtttcttttggggtagcatagcaagtaaagcgtgggagtggggagggaggcggagctacaatcccgaaggctcctggccttcactggtgagatggatatgctcagagagacagagatagatgtgcaacagaatcagaaacaacaacacagtgacaactatggattatgcacaatggatatggaaagtctctgttagaaaactatctttattaccccaagagattatttccctcagtttatgcacgttcatataaagcgaagtcaagagtgtaacttttaaaggtttggatgaatatgatgttcatgactaaacaggcctagatggagccaggcagaacacagttagatgccagggaagtcacccttttcctcctcctccctctccagtacagttgccagtgcatttcaatgcaggtcagcctctagcaaagtcagctgtttcaagctctgattggataatactttatctatacacccccagtcttgacctgcactcttctcccagtcatggaaatatcaagaattctagaaggccacaataccaatctttttgaaactttacaaactttacaaattttcactacaagacacctagaaaaatcttcaagcctatgcttacctgtagccctggtcttggtcctcttacttaactggtaaaagaggatagccttatttatgtctttgaagggtattttccttttttgcttgttggtaagtacaagagcaaccatgtctaattttaagattgatccaaatgaagcaaatgcatttcaaatttacagaataccatagaatactaatgggtagttcaaagtatcactaaatgtgtttggagggttttgagttttttcaaaacatacaatgttccacacaggaaacatcagtgccaacttcaccctatcactctttctgtccactcaggagtctcctttggaaatatatctctctggagggtcttccaaacaaatcctttgaatacttccatcttgtttagcagagtattctaaaatatttgtcaaaatctgtgataataggttctggagatcatgtttcttattcttctaaatgctggtatttcaaatgaacaaataggatattaaagatctgtcctttaccaatgtcaaaatatgttctgtcaaaatttagtattgctaaagtttagacccaaagactcaccacagcctttggatctcatattttctgaggttcatggaaagatatttgacttctttgcacctcaatattttggactgccatttagagataatgagagttacttaccagacagcaatgtcatgaggaatatcctgttagtaatgatgaaacattctgaaataaaaagagtacaggtaagtgctaggtatttattttaataaatgtatgataacatggtaatcatagaaaataacccatttattcctcactttgggatactgactaagtggtagtatataaaaagtaaaggatgtttccctttgggaatggaaatagaattgtgcactaagaaagtatcttttgtaactgcctgcatgtttaactttaaggtctctaaccagttgcaaccagttatgaatgacttgctgcccatttctgcaattcactgtaacttgtgttgagaaggttatgttttatggttaattatccatggtctgtttaaaaaaataaatcaaaccactgtaaaccactaggatttgcagctccatttgagctttactgtagttttgatcaaacattttgtacataaaaacaagctggtttctctttgtttttagttgtttgttatttgtgttataaatattgtggcaatggtgggagaataagctatggattatttaccctcggtttcatgagttgtgagttattggccttatcctcctttataagtataaataaatgtataatattatattccaagtcttgtaagacaaatggaacgagtgaactgaaaccttttagacccaaaatcttttatgcgaagtcatagaacaacaaaacaaaacccaaattaacatttaaaaagcttctactgtggagcaacaaagtctttaaatattatataatctgcatttaaaaaactgctcatctaacaggcagcagtctatcattctacaagcttttcaatgcctttaacattcagaagctacaggtggttttcccaaagatcactcagcacccccaatatcactaccacaatgaaagccttgaaaatggccagcatgattactttaagccaaaatggatttagaaaaatcaggaattcgtgtagctaaaagtaatgaaacactgtataaaagaagaaccctatagaattttttttatagttaccatcctaggacttatataaacaaaagaagtccaaaaacaattgtccagagaaaatgagaaaagccaagattcaaaggaccctgtggcagagtgcatgaggagcatactcgatagctagaatcataagtatctaacacatttgcatatgaaacttaatgaggatcaccaaagtagcttgccaaaaattatgtttgttaaatcagccaacagtctatgtagcacagacccctaaaaagaacctctaggaaagatgtaaaattgtcttctgaaatttgcttcttttataaaggcagaaaggataaaaaggcctttctcataaaatgaagtgattggtccactactacagtctgaagagttctgtatcagatttcttcttaccctttattacttgtatggcttactgcttacctgcatcagcagtctgcagggttggccatagcaggtcccttacgagttcactgaaacacggaaaatatttatgatggtactattatgtgccagacacaactggatggattctgcttgaaaaggtaagtcagtaactgaggttcttgttgccacattaaaagaaaaaatctatccctactgccaacagcaataagaagagaagctagggtgaaagagttgtcaaagacttatgaaaaattcgaaactgtttaaaattctccctagcttcttttcttgcatgtccaagtaacagaaagcttaggcctgccacctgtcttaagcctggatcccatattaaaaaaataaaaaaaaacagaaaaatgagaaacagctaatgtgttcccaaggccttggttacaacagaaaatgagagccgagaagtctacattggcacacatcgagatttgaaaggtcagtcctgccctagtatggttcagagaccgtgaaaacccaccaagatgaaaatggaagctattctgacaacaagaggcagggaaaaagttcaaagacttttcctctgcttcttttataacgagatactttcaactatttttgacaatcaataaaatgcaaatctccctcacttttgtgttctaagttttttttttttaaatttaaacaacccatttgaaaattagggtactcagaataacttcttgtatacagaactacacatttaaaaagctttgtgcagattgttaatcatattaaaattacatcataaacaatgcactttacatggtgcaaatgttttatgtttttttcttttgacaatcaggcacctacatgcaaaactgcatattggaatccaaactcaactataatacatgtagaggaacccttagaaaaatgcatgtgggaatatgatatcccagttagagactagaatattctgaccaattttcattatttctctgtaataaatttatctgagctatagatcctgttaagaaaataaagctaaatggaaaagtattgataaaatacattaaatatatatatactagcttagtcattattcatattaagatcagaaaagatttccgcaagtcatcacaaatacagagatgggataataccaataatctcgatcacccagttgttaaaacagagaacctcacatttgggcaataatagttttgatttttatcttgtgcaccagatttttccatacaaaggaattctaaattgcaatagttaacacataagacagtgttaaacaaattcataactttagtaaaattaaatgaaccaatttcttatggctttaatatccagaagtaaagtatgatcttaaagaatgatgctgatctgagatacaaggagatcaagcgcttcaatagttcctcctcacacactaatgatcgcatccatcctctcttccacccacctcccaccttttctggttgtattaaaaacaatcaaaactaccaccactgctgctacccttcacacacctgaacttaatttcttctaagagatgcctaacagtgcctagggctgtgctatcactttatatccattttatgaccgcttgagaggcagaaactaaaaaggaagaccaaaacaaaacaaaaaatccctccaacctcccttatcagacaaatgcctggttcccagaggacaccagtcagttaagcaaaaccaaatattacaacagggatgaaggacttataaattgcatacaaatctcactgtgctcccacttaaggtggaaagggagttactccaatgaaagaaaagggggagggggttgtgggaaggagcgaagggctacagaaagagcgagagaaaaagagagagagaaagagagagatttattgtacatttgagacattaagaaggcagtacagtgaaaccaaaggtgttccagggagaaatgtgacagaaagctctaaatgagaattacagaaactattccttcttaaataaaactgttgtttagatgatgaattctataggaagtctgaattaactgtctctgttgtagcatctagatgttttctctttcattaagactttggagtttgaatgtactttgttaaaaaaaaaaaaaaagaagaagaaagagaaaaaaagaaaaaaaaaaaagcattagagctttatatagctcccaaagtaaaaagcaagagaaagatgggtttatataactggcttttttacataaatattacatcaggatacatttcaagtgaaaacacacaaacacacacacacccgtcttccttatactctttctattttaaaattcatttcatactttaaatgttgttggtttttcacaaaataagtaaaaacgaagtcaaaacatctcaaaataagttgccttatattacctggaaaattaacccatcatacaggtcacgatgtctcatttaaagccagttaaggtgctgacaattatgggacattttgctgcagcctagggcaactagaaagggccatggatgttaactaactcccttttaaacagtctgagaaaagggaaaaaaaactgtaagtttccccatctgttatttccttttttttttctttttggctgtggaaaagtaaaattatgcaagagcttttgaatgtaaaggctgtgtgtgctttttccctttttgtctctgtgtaccggttaagtgatgttgcgtaactgagtacagagtaggcggttagcgtttactattgatttacactatgccatctaatgaattcagaacactaaaaagaaaggagcaggagagggagggaggaaaaagagaaagggagaaatagggagaggaaaaaataggaatgaaggagaggaagaaagagcttattcagagaaacagttctaatgactggaataggttcatttttattcctatagctctgacttttggttattgttcagctctcacaaaaaaatggtcttgagctggtgaccccaatattccaatcctatttctaataaggattactggcaggtgaatgcctgaaagttctaatgtgtcaaattacttgaaaccaatttcactatactgtcagactcctccatatgcatctatttatgattctctctatgcatttgtgaatctgtatctgtgatcaccatggatttggtcctactggcttacccaatcaaaaatattatttgaaatatatcacgggaatgtcatcagggtaaagagaaatacattctattttacccatctcctttaaaaatacataaagaacacatttagaactttaaatatatcactattttactttgaaaacagacatgctacaaattgtttggctgaacaaaacagcccaatataggataataaaagagaaataggcaaaatgaggaagaacgctaaattgaggaacaatattcataaagaaatttaaataatttcttatgtctatggagagccttttacttttgtttgggtggaatgcctgtagcattctcagtctttgaatgctgctcagtgcttcccatgccatataatgaattcccaaagcgtggaccagaaagaaagggtgaagttgtttctgctgctaggtacaggtccttcctgtacctgagtgccctcctatggctgagaacaaccactaaggtgagaaagagaaagagaagttctctttagtaatcagctgaaaagctgggcagggaacttgatttctccctcaatgtgtgtttgcaaatgatgactgggaaaaatcacaggaggttatccaaaggaaagaacaagagttggggtttctagtcatccagttgtcttctcttttcagccatctgagcttagaaaatattaaacagatgcgtactctgtccacttgtcaaagatgctttaatgacccatggtggtatgcacacagttgtatacctagcacttgccatggtgcttggcacattttctatactcagcaaatatttattgaaactgaaaaatgatgatgggagaaatatctctgtagaaagaatgcactagaaaggcctgaaaaaatatattccgatgttttacaagaaatcttaggctatattgctctatcattaatctgcacacaaaataatactgtaagagaaatatcaggcagttatttaggggtcagttgacttcagttccattttattaggaaaaagcttaacaaaaattataatactgataacatcagcaaagttttgtgttcatttccaccagcccttttgggctgtctttcatttcagtcttgggcacagaaaagtctattttaatttccatggacacattctaaagaaaaagtcatgggatatcaacgtaattcatcttttaaaaaatactgagacaaatgtagccatttagtaatggaagagaatatggctttttgttgaagggcaaggcaggtggagttttgattaggttacacaaatttaaattactagaaggacaccaagaatgtactgatttccattttcttggttaaacagtttttttttggaaaaaaaaaattctggtttagaaagtcagaaatgccatctttcagttaattggagaataagacctttagaaaaagaattgcaactacaatttctcaaaaattccagcgaagattcaacttaaagcatgtttagcaatagtagccatattcttttaaaaaatggggctaccatcttgttaattctgtaggactgagcatgtagatattagtcaaaaccttcaaaaagttttttatttctctctcttggtcatctatttaatgtaatcggattcagcaacttccttcaataagcattctggcaatatgtcaacaagatcattcatttcatgattcttaaaagtggatgagaacttacctgttcttcttcattttatatatgaagattctgagactcagaattaattttctcaaaagcatatattttgaggcagagctgggactagtatctaaagctcacagttcatttttttcacagcacagactaaatcaaagttgtataaattcaatcttattttaaatgccataggggaagatttcaaaggattcttttataagacaaggaattcttacattatgtaaaatgttcacctcaaagctatcttatacttttttttatcttaaatgtgagcctactgttcaaattgttgcttctccttttccttgtcttaatttttgactctttagagtctttgcctcctgtcctctcacttgtactctgtgtctagttcatatatggcccttcctgacttcatattcttccttctctctctcttttcatctttttatcaaacttttatttattcttgttcctcacagaaataatttccttgttaatgtgatatcctcagaaactacaaaggaagaaaaagtgtaaatttagtattattataataaataggcctttggtttatatttaaaacaaaactgcaataagatattgacaaacagagtaaactacagctataggcttccctatagaaagttacagctgtctagacctccatattatcaatatgaaaacttgggggctagcatttcaaagtatctcatcaaagacagagagcaaaggctcatgatctccagaccactcattttccactacatcaggacacctttcgtttcccttttctttctttccattctacattattgatatttgagactgattacggcacagcaggaggagattcagagaaatctccttggcttaatgtggtcaaactctctcaattccaaaaaaagtcagaaagacctgcacactaaaattgtagttacacagaaaaagaactctgaggaggttaaaagagtcctctgacatgagaaagtagtctctggatagcagggacattgctgccaaaatcattgtaattaagattgggtcattgtttccattataaaccttatgcttatggggtttgtaattcagttaaaatgatcagctgtaggctgaaatgcagccccaagtatcttagagtgggaggtgtttctcccctcctatttcttaaaaaagaaaacacatagcaactatttaataatttcaatgagagttgtattctgacccttcccctacaaagggtagttaatcaatgagcttaatctagagtgagccaaggtgagcaacatccactgtggaatgaagcacattaacctggcatatgaatgggcaataaaaggatttcctattatttcataaggtttaatgtacatcactccattccactgtattgatgtgaataggctttcagcaacaccgtgttgaaaaatctcccacttctgtttgttaactcattattgtaggaaacattacaattataggagacaggaatttctgatggtttccttagatttctttcctcataagctcattcccagggtcagtattagataatcaataatttctaaaatttcttgctcctatttctttagcattgtctacaatatctgatacctatagtgtaatgctatgtgccaccatgatgtagagggattggggaggaaatcatagctatatattaaaattaacaggccagaggaaactggtatttactgagtacatactacatgacatatattccattaatattatttcatttaatacaaacctgcagtgaagtagctgtggcccatgttttatagattagcaacatagttaaagagctgttagctaacctgcgtaaggaaacagagctaatttaaaaagttgcgaagtgaggtttgaatcaagatctgtttgactcccaggcccatatgtactgcaatgcaatgcaacaccaggaacagaatatgaaaccatctaactgaaaaaaaaaagtctccatgccaatgatgagagctacctcatgctccaagtaggaggtagaaagggtaaatgactcctaaaaagagattcttgctttgctcttggctctgataaatccctgtttattcatatgcaaatatccaaatgcatatttggaaaatgttttgtcttagataagaaaatgcacaatctcctagaaacctttaaatgagaccagacatttgaatgtttacaaaaattcctttgaagatttatattaggagaaagttttaaaacataatgcataaaaaaaaatcagatgattggctaggcatggtgactatcgtcaccatgggagtcgctttgggaggctgaggtgggtgcatggcttgagcccaggagtttgagaccagcctagacaacatggtggaaccccatctctacaaaacacagtgaaaaaaaaattagcaggcatggtggcacgtgcctatagtcccagctactctggaggctgaggctgaggctgaggattgattgagcccaggagaccgaggctgcagtgagccatgatcgtgctactgcactccagtctgagcgagagaacgagaccctgtctcaaaccctccacccccaaaaatcagatgattaatacaacattaacatttcaatctggatgtgtgtgtttgtgtgtgtgtgtctatgtgcatataaacctataaatatacacatacacagatgaatttttttgtctttgtcaaaatttctggtaattattataaagtatttgacaaaagctaaacagtaaatatgttacaccaggagaaaaggaaacaaagaacaagaaaagaggagtatgtgtatgtacatacttccctcagaaatctaatcctaaaacattttttaagctaaatgggacatagtgctttagtctaaattgtgtgtgtgtgtgtgtgtgtgtgtatgtaaagataaaggacttttactatgttattttggcaagtgattatttttctaaaatctttgctgaatcgttttatgtagatatactataatactcttgaataaataaatacttgttcaagttaaccttagagctcatcaggtaaataacagaatttaaaaaagaatctgtagtctgaaacactgtagagtatgccaactttacacattacattaagtattcgttcaaaataatttataaattgaaaagtatactccattttattcaaacaatgcaattttttaaatgaatcttacacaaatttgtgtgtgtgtgtgtgtgttagagagagtgtgtgtgtgatcctcaagaccactgagtcattctttaaaaatattttaaaatcataatttggtgaagaacttaacaacaaagtaactgaagccagatttgagagaagaagaatgaacagttcttcaggaagcaccaattcattccttaacattcaataagtctttattgcttcgcccttccctcctttttttcctctagtctaaactctgatttggagcagaagttaggaggaacacgtattctggtccctcttctctcatccctgtaaggaaaagcaatggtagactaatgacagaaaaagcaattgcaacaactttggcagttttgtggtactgggaaaaagcaggctttgtatttgtacatttcaaggaatttcttcaaattttagcttctttgaatgttcctacaacaagctgaaggggagataagatctgctagggaaatagatgaggtttagagagggaaaatggagggactactttttttttattcaaatagcattcaaacacatgagcaagatataacttgcaacattaaaaagtaaattagctagctaaaaataactcacaatacccttctcactaaaacaaaataaaataaagcaaaaactcacaaccaattattttgactggtaaaaacagacagtgatatgaaagtaacagatggaagcccagttttactcacacaacacactcactaaagacaattgcaagtgtccccatgacaataacttaacaatggtcactttagcctgagatatctcctttaggtgagtttccttaaagacttcagaggggcttgtagaaaatactgtagaacgaaaccaactcatttgtctatatgtagaaataggcaagagttgcaaatcacagcctgtggacgaaagggatccaggtgtcacatttgccaaatctttttgcaagactggaatagatattcttttcttatttattttttgttgtatggcagtatttttaggagtggtgacatttctgtacttttaaaaacacaacactacacagcacctaaaaactttcctaaatcaaataattaacagtaataaatcttcctgctaatttctcctcaaagttgaaagaaaggttattttcttacctcacactgagccttctgatatgacagtgtcattcagtcaataatttcaatgtcagttactgatttctaactcttttattacaaagacttcaagcaataatgaaatggtgctgatctgcttgctttcactctatataacgtctatatttatatgcttatgcttctatttggatctatatttatctgctttatctgcctacagtgcatctgtttctcatacacacagacatatatttatatatatacacacatactgtatatatatatataggttatatataaacacacatacccacaaaaatgtatgaatgtatgctagtgagcttacttcaacaaccatgcaggtgcataaatattcaggcacatgacaaatatacaaagaacataaatgaacatgtaaacatagttacacaggaaaaagaatatcttaacaacagccctgtctgccatacttggctgttggcctttgagacttatacactgttgaatgatatgtcatagactactctgagaagcagaaaaatcttctgaaggcaaaagtatatgactaaatcaagataatgaattctaactctctcattttcgcaatgaggagtctgagatactaaggtgaacagcaaagattttacagctttctggaggcagagctggaagttttacccaagtctctgcctgctagacaaatgctctttctactactatgctgaattgaaaggatgaaaacaattttttcaaacccaatatcattattttctaattgccactctttcccatttttcccttttcttgctgtgtgaaatgtaaacaaacaacattcactcagggtcaggcactgttctaaatattctatatgtactataccatttaatctgtaaaatatctctatatagtaggtattattattcaaaatcttagtttagtgaattaaataactcactcaaagctacacagctagtaaggaaaagggctgagctcccataatactcaagacccatgtttttctcacttaactatgatgccttccctaatacatatttgtatataatactaacccttccctcaccaccacagcctgatagtcttagaaatctaatatttgatctgtttcagaacacataacaagtttaaaggttctctcagcctgaggaaaaaaaataaagggaagtagagcaggtataagttacatccctagtatgcagcacatgccctatactagagaactgaaatatgcaaaattcccccccaaaattactccaatgatagtgtgatgtgatttaaagccttaataacttccagtctatgaacattttatgtcttttgcaaaggattatggcaaactgataatatagaatcagattggaaataagaccacaagaaggcaaagggaaaatagcaaaaggaagaaagacccacacccacttcttcttcctctcttggcacaacacttccaaaaacaaacacccattaaaaacaacaaacccagtatcaaaatttggtatttttttccccactcaagtgttagagacaaattcagaaaagaaactaagtctacgtatggtaggtagttttatacaaatctcttcagatagtaaccagttgtgagccatccgaacacggaggaattttacactttggccagctaacccagaacccagcactgggagatgtcatgtggatttgtgaaactccctggggcatactgcatccataagccaaagaacagaaattatactgatccatacatgcagctcttcatctgtgccatattgataattactcttcatttgtgaattaaatcctagttataaaaacaactttcagacatttgtcacaaatggcacattttacttaactctttcataacaccatctagccacggtctataggaaatgggagctaccatactcccatataggtcatgatattataggaagaatatgatgtagagaaagagagagagagagagagacagacttgagtttgaatcccaggttttccatttattaacaataaagctgtaggcacatcacttaaatgattctgaaacctcattttcatcacctgtggaataaagaataaaaccacctattttgcaggaacgttgtgaagattagagacatcccagcacaaagaccccctcataaaagggggcattaaatattaattattgtatatttaagaagtctatttgtgtgtgactttctcttgtattaatgatacataaatctgctgggagtaacagaagatgtgaggtactttttatgcttttttaatcaaagacaaactttttggtgatcacatgtgttccatgtaaaagtggaaataaaagcatatcacagtgtaacattttcagtggacgattttaaagcacttaataacccttgactttttgtgattgctggcactctcatttaacagttgggcaaaatggggttcagagatacatcctccaaatcagtaataataataaagaaatcaccagcaggggttagtagaaagtctgtttttaacatctaaatcccacagtgtccagctaaggaataactgctgcaaggtcacagatacaaaaggccacactttccccaaagctctttgagattattcactgaggccaaaacattaggtaatgctgtgtacatctgctgagataacaagggtgagtcagggttaggtcacggtttcaggttagaggggtggggtgaagagtggctttcagatcaaatgacgagagtagtttaatttaagcaaagaacaaaccatacagtattttaagtaagaggggaaaaaaagggggtgcaactacagccaagagaaggtgggtgggaatatagaccctgtgggggtcaaatgggtaactgtggctcaaagaggaaacccacccacattcacacacactgaaaagcgaacaaaaagcccagggtgcagcataaatcctgctatcccaataacacacacagatgttccaccattgttttcttttatgcacattttaattaagagatcagaatcaagcattaaaatgttattaaatggcttgtttacatttttgctatatgtcatttataatgcattttctaaatgtgtgtatatctattcggaaggactatttggaatttttacatcagtgctacaattgtcccactaactcacagtcatttttgctaaccaaatatgtgtcagaaatccttttcagtttaagcaactggacaggagctctcactctttaattctcagtcaagcaattccctacccccaatcacacctcctttaagcatgacaaagtccaccacagtacttcaagacaataggaaggcccaggtacactggcaacctttctgatttttcacaagagtcccagtttcaaatattctcccattgtgctcacaagaaaatagtcttcatatacatgcccgaccctttccctagaacagttttgaaaatgtcgggaactcaaagctaccacatgaaggaccctgacctatgagtgtcccctggaggggacacagtggaagaagcgggaactagtagatttttttttcctccccacaatccatcttctatttgcagtctacaacttatccctatttgcctgggcaggaatttgagttctctatattattctggagttaaaacaggtatgcctttcccgtctctcagattccacagatatcatgactgatgcacacaatccacctgcatatgtggatcacaagtatcctgtagtctgctggcaccatataacttaattacttttaaccacagggcattgtcctagaagcccactatttatattgtaccttatcaatcatggtacttggaattgcaaagtctcagaaagcaggaatcatatctcctccacgttcagttcaatgcctaatgcattgtgagtgttcagttaggacaagcaagagaggtaaggttttttctttctttttgttatttgtttgttatccaggataagcagaatgcttgtacagaacatgcataagaaagaaacgcaatctaatctcactgtcaatttatattctgtaaactgtctcatttgcagcataaatgactacaaaaatgttttggttactctaagtgttaaccttaaggtaagagttaaattaagtctgctataactggtggaccagaaaggactcagagaaaagcaacagcatggctttgaatcaaatcacttttggaagaaaactttaagatgttaccaccgaaaaaataaaactggcaaaatgctctggagggcatcttagcaatatgcatcaaaaatttaaaaaatatatgaagactgttgacccagaaatctcacctctaggaatgtatctaaaggaattactcaaagatctacacaaagatttagaagcaagaatgtttaccatggcattatttataattgtgaaagactggtaaccttgtctgacaatagagagttgattaaataaatgacagtacattcctagacttaaatactatgcagtttaagaaatcatattttagataccacttaattacatgaagaaatgtttttggaatactgttaagtgaaaaggcatataaccaacaatatatgtacaggaaaatatattgtttaagtaaatattgctaagttaaatattgttaacttaaatattgtttaagaagtgatagttgtgtacacacaaagtgcaaaaagaccagaaaacactagaagtgcttgtttctgggtagagaaattataaataatttttgtttatttgaacttttccataataaaagcacatttatttcatagtaaaatattacttaaaatattcatctataccaaccttccttctctaaaggcctaaaagtgaccctctgtaggcactcttttgtctctagaagtcttccttctcctgtttttatagatgtatgtgttgcattctaaaatcttaagtatttgggactatgtagttataaaagataccctaccaattaaacaaataaaaaatcttattaaatctgtggttttaatcttaggttcctgcttagaaaaaataccaatttctctttaagtcctatattttgctttcaattcagcctccatagtattaattagttatattatttaggcctgcagcagaacagtttcatagttcttctcattctcacagttctttgtaagagacaccacccctctcatggttcttactcacccctacacccacaattgaccataggtaattgtgcaagagaccacaaatagaaagaaaatgaaggaagccttaaaaggccaaggtagttccaagttataaaacagagaaaggctgaaaatttaggcagagatgtggagaaaatccgagccatgacacttaagaatgaactggagtaaagatccatgagcacctggtgcagggagagacaactctacctatcaatccagtacatgctactcacacaggactattaattctagtaaataaccacagctttaggaggggcaaatgttctggaataggctgcctgttgaaaatacaagtgctagggcctttccataacctataatcaggacttccagaagtaatatccaggcatcttcattgaaagctccaaatgtgattctgaattatactagaggtgagaaccaatgggctactggggaagttcaaatcccttagctctagccaacttttataaattcatctcccttaacttcacaaacatatacactctgctgatgctagaccggtgtccttgttctccatccttgctccgtcataaagagaaagctagtttatgtctttgtacaatctacttatgactttatatcttgaatgccctgactgctccttactacctgtttaaatcttcactaattccaacaatgggttagagtttcaccttcctatgaattcacattgatttttcctacacattaaactacagaatctgtgtcttcccctatttctactcttacatcaatatgaaacaataatttgtttgtcttacaactcaatatgatcataaaccatatgtgcccttagaaagtgttcacatggttttgttggtacctctttgcaatgtatatcagggaattttaaaaaatagcagactgaattgagaccagtacttgcatgttcatcatcatataatatgggacatgtatatttacctccaaacattctcagagttcattcttcgtaccctgtaggcttatgctgtaaagaaaatacatatgcagaaataaaaacagagtttgaatctccagtcctaatccttcctctgaactcctgtctcatgtatccaactgcctactacatctctttatttggaaaagaatttcaaattcaacattctccaatactaactcataatcatctctttcccaaatctgctcatttctccatatcccctatagctcccaactccatgggatattgccatttatccagtggctggggtgaaatgcctgaaattcatcacacctgatgtctctctcatgtaaaaccacattgagaccctcagcaacttttgtcagccctaccttcaagttatgcagagttgaaccacttttcatcccctccccactgccattgccctttgcataactgggctactatgataactactacatgctcttcctgtatcaccctgaccctgtagactgttctccacagtgtagccctggaactcttttaatatgtaaatgagatcatacatgcttaaaaaaatcctctatagctttctgtcagtctttatcatggcctgtgtgagctggtccctacttatctacatgatcattcttactttggtccacttgagccacacatttcttcttgctcttcctggaaaatttcaagttgttcctactccaaagtctttacaatatccatcccctttccctaaaatgttcttcctgctggtcaccacatgcttaggttcttctaataatttaaatatttgctcaaatatcttccactcggtgagacctttcctacttaccctatttcaaatagcactttctaaattatatatccctattttctacctccttattatgcattattttcttcctagatctgatcattatttaaaatgatttttttttgtttacataattattggctgtctctccttccactataaaataagtttcataggaaactttgtttaatttctcactatattcccagtaattagaacaatgtctgaaacattataggtacttgatagctattaaatgactgaatgaataagtagatgaataaagtgttccagtacttataaatctcatcccagtcacataaactttaaataggaaatctttattctgcatggtgcagcggcttctctggattgtcccagaggcctctattctttccatctgactgcacaggccagtctgggaaaccacctacatgcaatagctcacatgtcttataataaacttcttgggaggagtaagtcaaattagatagttaactaaaaatagtatctctgagtttataaaggagacgttttcccagcccaactggtcctggtaagttagactggcatcaaatgctgacatggcaatcttatgcttgatgaaccctcaatctggagaggagtgagctatacttttatactatttattttgtgaaagttccaagtatagttcatctttgtatccacaatgtcaagaacattgctgagcagagagtagagcttcaataaatgtttattaaacagatgaacaaactaatccatgaagcaaacaacattctaagtgctattcttctatgtctaagctttgacgatgcgctatataaaattcattcttgcaattttccttcatagattagactgaaaaactcatcgtgaaggaccatgtcttatccatcttgtatcccaagttcttagtacagtgctggatgtaaaaggaagaaaaactccaaagcaaaggatagagaagttagaagtcctggcagcgatcagtgagtattaaagaatgccagtatgacgtgattatcagatgttaggtgatgaaaatcatgccagctaacatatggatttctaccctgtttctgtataagacttgagctctaaatttagttcctgaacacaggggatcagagttgaaggtgattatttactatgaaactgctattttccacagtatacatgatcaaagtgctagaaacttaatgcatgaaaatctacacttctttactcaacctctcttacagttatataaaattctttagaaaattaatgttataaaaaagagttcaggccgggcgcggtggctcacacctgtaatcccagcactttgggaggctgaggcgggctgatcacctgaggtcgggagtttgagaccagtctgaccaacacagagaaacctcatctctactaaaaattaaaaaaaattagccgggtgtggtggcgcatgcctgtaatcccagctactcgggaagctgaggcaggagaatcccttgaacccgggaggcggaggttgtggtgagccgagatcgtgccattgcactccagcctgagcaacaagagtgaaactccatctcgaaaaaaaaaaaaaaaaagagttcagtttgttcactaaagggctcaatttgttcactacataaaaggatatagcagtttgttcacgaaatcaaagccttttcaaatataataagcaatagaagaggtgacaaaatatataatgtaactattaaatcagtatgccttacaagtatccatcatggttatagtactaattgccttggtttgtccaagactgaggagggatgtgagcttttccgtgttcaaacagagaaagctccaggctagtcaggacaagttggtcaccctaataatggtataacctgctaagctggttatcagctattccgatgtatctatatgtaggatctataggtacatgtagaatatatgatagataactaggcattactaggttataagatgattaagaattaatcagtctgtactagtataccatatgaagtgcaaatcccttgtttcattttctcttcatttcccctcgatgttggacttcttatgtttttatatcgtatgcttatattgattttattatagtcaaatacattaatttggggtgttaggacaatttcattttcttcagaagaaaaggaaaagtgagtagcagcaatgcagatgggtctcaattgacgcatgagctcatctgttttttacaactccaagtgtggtaattccccgtagaattaaaatttcctaacacagaaattaaaattttcctagctgaaaatgccggctttttacatatcccaaaactgaacacataaagattaaactccaaaagtaaggcaagatctacagaactatcccagccctaattctgccgagatatttattataagacaaactgagacagtcccctgtggtctccttaaggtcctgatggccccctcaaagcatcatctggctttaagagaactccaaaatagtaattggtctttgggcacagaatagccattggaatctggattagagtctgaaaaacactgcattttccaaagagattacaatgccaggctttgaacattgaagggtaatatcttctttctaagtatctctggtcagtctcagtaactagacctacttttgaggctccatttcttttatgtcttttaaatttaatgataaaaaagaaatatctaaatttataatatacacgaaacagtgaaattaggagaaaaaattctatttgatgtgtccatttttttaagctcccatgactaaaaagatcaacagttacctacatttgtaatatttatgcctcccaggctcagtgtaatgagtttcatctctgatcgaatttttataactgactttcacttacctgtgaaataggtaataggaagccttggtaggtgctttccctaaagaatcagatgcaaaagttagacctactgcaaacaatacagaggaaaaaaatgtcactctaatatactactactatatccgtctgctttttgcaggaaaggaaagctatcatcctagacagaaatactgaaataagtgaagtacagacaagtgattaatcaaaatctgaaaatcatagtcttcagctttttcttccatgaaaccatggtgtgtcctcttaactttggccaagtgcccagctaagagaattcttccatgagatgaacatgcttcagggcaaaaccttattctaactgatggttttaaaagcccaactctacattctgctcaaggctttggttacgtaggtaagccaaaacacaggagacatgacttcctccattaaactggctgaagcccaggttacactaattgagcctaaatagaaaacctctgcttttcaatccctttgttctcttggatgtcacagcttcctgctctattcgcttccttttatagtcttctctcaccaagcatttcaggaaaaaaaaaaaaaagctaaataaagatcacagcctgttccattgtgtccccttcttcttcatcatcttcttttccatgtgtgcaatgttgtggcacctattaactaccaatgttttcagaatgacattatacaaggtgcaggctgtaccactgtgccctaaaaatatcaacaactgcattagtctcacaataattaatggcaggcattatgcaaatgacaactttttcgctgcaaaataatgacatttcttcattttgagcagagttatgcaaaacaatgaatttaggatgataaatcacacaggagaattaagaaagccataacgttcctgcccaggcaggcagaaagatagacagaccaacaatttagaagacattgttttgttctcacaccactataaaaaatcatagccagtcggccattaatgtgtgtaggtttttttccttctcccctttaggcaacaatgcataaggggatgctaaattctagcaattggatcattacaagtcacaagcaaatttttctttattaaccttaataagtcattcactcagagactatagtcatcaagcaaataaaaagtatcacatgccattctgctacacattaactaattccttatgcaaacatcacaacatatagcaattactgccgctcaaaaaaacaaagtcattttcaatttattttattgcttttatacttggccatttcctgtagcacattatcgtttctttccctaacaacccgaggtggaatgaagaagaatttcggtagcaatgagccccttcctctagccacctttgtcatacctttttcccctccgggaggcttttaaggaaggttagggataaggtatgtgcacgctccttcacaggaaatgtgcatcaagctcagagaaatggtacattcagctcctattcttgcagcaaagagagtgtggggtaggcagtaagacccaagtctgtctcccacatttgctacaataacactgacagctttcctttattcagtaaaacaaggtaaaagtgtaggcttagacctgtccccaacaggtgaacgttaaagtcaatatatgcaacgttgacctgagagatatagtaatggttaatgagaattatgaggttacttcgtcttgcttcactcagcacataacttgtcccttccagaatgctgaatgaagagcaataataaatactggacactaccccacaacatgcacagtattaaataagatctttgtgtgtgtgtgtttttaattctataacatcctttatccaagactcccaggatgtgaaacaaatgctaaacaaagcttacacattgctaacagattcttttagcccattttacagactgacaaatggattctgagcaactagaggctttacacaaagttggactggaacaggtcagactatctttccaatgttctaacctctgaggcccgtggcctcttataatcatgagcattctttcctgctgataaacaattatgctgtaaacagcctgtacatgtcccttttcacacaacaggatgataatctctctccgttctcctaaatccacaatccattcccccctttttaaggtagaacatttccgaaatacacacgggaaaagctctgttttcagtttctcctcctgaaggtaataacattttgcagttctccttaaataaaatccagcccatgctggatcaataagaatgatgcccatttccctaatggcagccgattgccatttgctattcaaatcagactagataaattacagtacatgccagggaacaggccagtgaattaagacaggcctccagaggaccagcgatattattaatcttttaagacactatcatatttcttcttgacagtgtgcgtagactcacagacacactgcacccagattgaaatatcagctgctgaaaaaaatcaatagtgttagaaacacaataatttttggtctgcagggtctacactaagcaacacttgtacccctcctgtgccatctcttctcccacttcccctttgccatatttgcctcctacctttttgctcttcccttttcattctctggttttaaaagcttgtaagtccaaatgacaagatattatgagaaggtttccactgctaacactggccattgtggttacagcgttgatttttcatgggttgtttgaaatgcaattttactagtctggcaaaatgttttggcgtgggattgtttttcctatgaacttaatatagattttcaacccttatgcacttggttctgtattatgaagaaatgaaaatatttataggggtggccatacctgaaagttctgaggaaagtggaatgcacagaagggaaaataatggaaacctggcccagaaatgaaaaaaagtggggggtattcattgaagatccaggagaataaacaaaacaaaacaaaacaaaacaaaaggctacaggggaggtgtatgtagagcagaacatggtaggaagaatattctacttagattctgaaaacttgaagttgacctctgcctctgctgcctgcacactgtgtggttttgccagttacttacccttgcagagccttggtttccttttccattaaaacaaaacaatctaaccacctacctcatagcattcttgtgagggctaactaacaagatgtgtgtgttttctaaataataaaattgtgaatgatataaactaatttctactagagagaggtttatgaaatgtgtctgcttttttcctttttcatagatacagaataccataaaggaactttagacgttatcaataaataagcaaactgatagccacagaaaggttattgaggttcacattaccagtagctagtagaactttaagtagaccaagatctgttgaatctgagccagtcccttttacattttaccagatggattttaccttttccatgtctctttctactagagatttgaggctttgattcttgtccatgttgcttttccactggggaggcagataaacaaaatgccacataagaaaacaaaaacagaaacaaaacctaccatgtttgtgtatatttatatgctattcttttgatcccaagactccctccagttcaccccccattttgattcttcctttcataacaaaatgtattagaaaaattgtccgtattagttattaccgtatcttcactttctattcttttcttaatctattccaatcaggcttttatccgttccactctaccatatctactgttgccaaatgcaatggtcacattttaattttcatctgactcaacttcttgcaacaatttaacacggataaccgcttcttttcctcctcgaaactgtaatatcttttgggatacccctcttttcaactttctctactatcttacagggcacttaagcctatttaagcctcatcaaatttgaaatctgttactagcaattcattcttatttctgaattgggataaacacagtatatttggaaaaacagtggactgtcagatgttttgatggtctgattttatgactttgatatacaaaaaagagtagaaaatcttattcttggtttggcttgaagcttttttattccacatacctcatggcaaaatttatgaactacttttgaaaattcataagtgatcatttacctagatccacttaattgctccacccagtttcttcaaacacttgttctttgaggtctacatggcaagaagtaaatacgaaaaccatttccaagtgaactaaagtaacctgaatatgttttctgtgttaggttgttccccctacccacagcaaaagcatgaagacttcctttaagaatacaagatatattctaagtctaccagtactccatcttctgatgtcagatggagttaaagttcactttcatctcaagagaaaaaacagtcattcctgacttacaaacatgagtggagggaagtacctgaacacagggattgctttcctcacatctggctctaagatacaaccacgcgctgtgacatataaaaaggtcactgacacgagaaaatatcgcaagatattacaaggataatcaaagccaaaatatatccaaacccacttttggagagaatcccaataacttcttttgaatgtgataataaaaataacatgaataaagatcattttcttaagaaaaaaaaggaacgtttctatcacttgcctgccacttgccacttaggagtagactctggctcccttttccgcttaaattcttccacagagtcagcttgccagactcttaaccaaggtttttcttttatctagactataacaaatactccattttgggtcatgagaacatagtagcaaaattcccagagttaatactttaattatacacatatgtatttattattttgtatgtgtgtgagctgttccactaagttaaactttaaccatattaatccaggaaaaaaatccctgattatcaactaacaattttgtaaacagttatctcacaggttaaatattaactcgaaaaatttaactcaaaactccacacaagcagaaggagccaaaaggccaggaagaagaagtaaagattagctgctttaggaggaacacagccaggaaagtgagcattttggtagctggataatgtgtaggaagtccagggggttgtgcaggggggggaaatagaagcaagaagggagcctggaggacacctgctgcttatcataatatcaaaacataaaacaatgaggtgagaccttaaggaaaagaaaattcatggagatatgaatccattgataatggccacaggaattcaggtgcaataaaggtttgaacctcaatgatatggacatagctaaaagatccaacacaaagctagctggagcggactgcctgcctgccactgaatatcatgaggaacattctggggtccctcttccactagaaataatgggatgaaggctgctctgcctgtcctgtttctgtttcctaacaataaaacaaaactgaagtgtctccctccagtattgggttattaggggcaccgattgcaagttctaagcctttatctaactgtccatcaattctctccctgattaacagaaccatatcacgtaagaaaaagttggaaccagcagtagactaagtcagaaggcttttctgtaccggaattgctgaactacaaatattgttctctggttaggattttgactaaaaaatgtcaagaaaatccacatggccagagaattcgcacaatcttgatatctgaggtacagggtaaagctgatgtattttaatgctgttttaggaaggttagaaactgttaagattcttcctgtcagtatgtcaaatatcagatcagtcctgcttgctgatttttaaggaagtcattaaaaaaatcctcccagtgagtagctttcaaggaagactcccatttgcccggcagatctaaagaaataatgaggccaaataatgcaagtttctcaagagaggtgtaggattgaatgaaaaaagggaagatatagaaatgtaggagaaataattcttacatatataatatatataatgtatatatgtatatattgtgtataatatgtatatattgtttatattcaagaaatatgatatagcttatcatatattacttttgatatttttcttatacatctagtacatgaatacatgcttattggaaaagtacaagtacaaggtgtagtctctattatctaaatatattatttaaatatatatctaaatatattatctaaatatagatgacacctcgtacttgtaaagctttttgcagtttataaaatatttttgcataaaatatcttttgctttcctgacaaccacaaaaagtaaaaagggtgggttctataatttctgttctatagacatgcaagtattactctaccattgacgtaactggtgcagaataaacctgaacagaggaaatagaatccattagtagcctggttatccatatccacatgccaagtaagaaagcagcatgatgactgtggaaatgtaaaggcattataagagtgatttttggagaggattaaggagggagacatcaaaataattcaaaaggaagtttagaaaatcagtagaaataaagggctaaatttggagtaacttttttggaaaaaaagtgtttagaacaaggaaagaaacttccaattcagaccatgtattcatttggcatatactaattgtatatctatgtttgattttctttgatagatgctattgggtaaataatgatgtgtatggagacactgacctgtgcctgacatatttaatatctatttgttgggataatgcccagaaggaattattatgcaataaaattcagatattcagaataggggtttagagagaaaatcatcactgatatgtaggctgacaaaggaaagcttcagtatgatgaacaaatctagttatactttgaaaaacatgtaagatttgggaggtgataagacatttcaagttgtgtgaagggcatgagagaaagcatggaagcagaaaattgagatatgtatttgggagcagcaaataaacaagttagttggaattgtaataggaaacaatgctggaaagatgggttgagtgtggaatgcgaaacggggtccttgaataatgggctgagtagtccactttattctgtgaacacaagaggtctattaaaggcttgtaaagtaggacactggcatggtcacagtgatattctagtataaataattgggaatggtggacagaaaaaactgaaacagggagagcataaaggtaatgagagagaaagagagagagtgcgagcttgtgagagcaagagaatgagaagtgatccactgcaacaacccaggtactatgtgataaatatctgacttcggtagtgtcagcagaaatgtacaggaaataacatgttctagagacattgtggaggaaaaaataacaatatttactaaagttctactctgtgccaggcaccgaactatgtgctttatgtagattaacccattaatctccatgctaaccctaagaggtaagtaactttattgtttccattttacagataaggattaagcaactttttcaaggttatgcagttagtaagtggtgaagcctggattcaaacccaggcaatctgactccagagcctgttctcctaacccccacacttactgtttttcctaggtacaagggatcttttggtggattatatatgacaagatttgatataatttgatgactgactacatatgagcaataaattcgtgggattcttgggattctcaattctgagatttttgggttatattatgaataaaaagaaggaaataaagaagatcttcttgacttcacattgtacatttgttcctaatggtccaattgctttttggacttaaagtatcaatttacaataaaagccacagaagcaactgaaccaccaaaccggaaagctctttgaaaatgattcttctttctagtttcactaatgtatatctggagtatagcacagttcttcgcatataggggatgcccaacaataacatgatgaatgagtcaactggagaagtattaattgtaataagtgagaataagggagtggagggtgtaaaagtcaaaagagtatgacccagagtcagacaaatattggttcatatcctggctcagggccctttctaactacatgacatacagaaagttactttaaacattttgtgtaatatggggtaataattcataggaaagctagctaccttactggattcagtggttttatataaaggcaatgggtgtatgcaaacctagtaaggaatgctcccaaaggctgttacctctgacagaagaaaatctgcaacccctttctctttgtttaacttacaaaaccacatgaagacctaagaaaaaaaatctgccaaataaattccagttacaaaaggaaaataaattattttgaaagtaaaaactataatttcaactgaagaagagattttaattgcagggagatagatcagttgaatggtttaacttggacttgagaaatcagtagcagccagtgggatacatattaaagaaaaaaacaagtttaattacccttaagattttatacagcttggctcttccctcccacacctagtctgcttccatcaggtcagactccttttcaatcacactctcttccatccttttctcagttgctgtcatgacaagccaatgagagaatgacataccgatgaaaacaaggtttgagtaattactgcactgtggctggttgttgtctgggcatcattttatttcttccaatcaaacaggtccttggacttcacagctctgtttcaggtgggggtgatgctgattatattatgacattatagcaaagacaggcagatcagatgaagtgaatttcactcagtaattaaactgcagtttctttcgtctaaagtccagggcaggattaatcgaaacgtagctctttatcattcctattaatgctgggatttgaagagtgagctctgatttgatagctagccctgaatctggctgactggtgtccccaaatctgtctaacttgcaaaaataatatcagatcaagatacatttgcaaggttatacccttcccttttattttacttttttttttgataaggaaatgcaaatagattcaaatatgctgccatttccactaccttgttttctattacaaaaatgtctgtgaaaaaaatcaggtccttccaaaccccacagcattttacaaatggttttccataattccacttaacaccatgctctaatggcttctaattttgtgacttttcattatctgagactcaatatgaatatttggatggcccaagcgacagcttttcagaggctcaaaggttctacttttattttaaaggactcattctgggacttatatagagattttgtttcattcaatcactcttgtaatgcatatgatatcaccaaattctttaacaagtatgagttggatcactgattctcaatcctgggtgtccatagaaggacctgtgaagctctgtaaaaaatcagcctccagcctccactccaggccacactcacagatcggaatctctaggttttagacacaagattttatatattcttgaactccataagtgatttgaatgtgcagctagagttgaggaccagagtcagccacacagtgtattagctgtatttgcaaaatatttattaaaacaagccattgttcagagaaattagcctcacattattgtgagagatctctcaataaaataataaaaagcttattccagtagcctttgcatagaaaaagatatacttgggtttctttccttcttttcttttttttttcttagacggagtctcactcttttgcccaggcaggactgcagtggcgctatcttggctcactacaagctccgcctcccgggttcacgccattctccttcctcagcctcccgagtagctgggactacaggcgcccaccaccgagcccggctaatttttttttttgtatttttagtagagacggggtttcaccgtgttagccaggatggtctcgatctcctgacctcatgatccgcccacctcggcctcccaaagtgctgggattacaggtgtgagccaccgctcggcctcccaaagatatacttgggtttcttaagggaagtagaggaaaaggaagactgtaaaaacagacaggtaactgttgatggggcttccattgttctctctgataacattgaaggtgatggtttactgattgagctcatcacatggtaacactatagctaccaaccatataatttaagatgacagttgactaacatcatagaatctcagagtttggacataaacttggaattagctgtcatctattttaaccccttctctattcagctgcctttttagaaagagaggcagaatttagaagactttatttcaaattctgttttcagttctgtttcagagtttaagaatacacgttctagggtcaaactgaattcaactactagttgggtggcctagatatttacttctctaagccttaattatcccttctttaaaatgcggcccagaatatgtatctcaaagagctatttaggttttatattaattaatttagataattaactagaatgcctggcacacaaaagtatcagaactcaataaattaagtctattgaaggaaattgcaatagtcacttttaaggttgtcactgagactctatgcttaacaactatcagtttggtgactcacagatcagttttctggaagatttgatttgccaaagaaaaagagagtgagtccaaataggaatggctttcacatttaattgagccataaaataaaatacattttattaaataaattttataaaatacaattttattttaatgatcacctggaaatgatcattaaaaatgcaaatttctgggctccaatcccagagattctgattcagtttgtaggagtggagtctaggaaccatccaggtgattctgactcagggtcaagggtcttcactttaataaagacagttataaaggaatataaattagccaagcatttatcccccaaataactacagtgtggcttgacctggaagagaccatgctttctattccttaagtcagaattcagttagatgagtttaaaccatgtgcaaatacaaaatgtttatagagtatatttatgcacacagagttaaaaaatctatttctcttcaattaaatatgccttctcaacaattatcatttagccactaacattatcttcatctcttttcatcactactgggtacatgtaagtatacagacaagggtcagatttgctatcgactcatccattttcttcttacaaaataataaacaggtttcataaaattggtaaattccttgaataaacaaaagcagctatttcctcctctaaatgcattgtagaataaagtattttcaaaacgcattaatcgaaattgataatgaaagtcaatatataattgtgagttgaatattttaaatgcaattgattacttcgctaaaatgaatatactcaacttacacatggagactgttctggatctaaggagaaatttaaacattttcattcccaatcagcgaaatcccagaaatgtgtttagagtttctaatacaatataccaacaaatgtgcattaactctctatattctaaaagttattgtgtaacaaataacaggagaattatggtctctaattgcagttgaacataaaattgagctggggagaaaataaggcatcaacatgagaaaagtttttcagcattatacaacaatataggctagtggccaagtgtaaggctgaaggagaatctttttagtacatactgtgtgaggcagggtaagctaccgaagatctgcaaaagtcaggcacagtaactcactgagggggttgtggtgaccacagtgggtactgaataaatgtaacctattatttattataatagttgacagtttattttagtaacacaagatatatcacagataagactatgtaaccggtaaaaggtgaatggtacaggcactgagagttacagggagccaaaactgagagaatgctggcatgactggtaagggttttgtgaggaagagacatttgaatggataatgcaggagagagaggatttggctagacagaggaacaaagatcattttagacagggtggggtgttttgatatgaatcgcaggtcaaagttaaaaagtgtttaacgactgttaaaaaaaacagtttaggatgaagccataaagataaatttgaagtagaacaacagagggttctggattccaaaaatcacttgtagtttctggtagaatttttaattgtcaaaatattttctcagtggaattcaatatctctttagatcagtggttctcaaattttagtatgcatcagaattacctgaagtgcttgttcaaatacaaattgctgtgttccacctcaaagtttcttattcagtaggggaaagtgaggcctaagaatctgcatttctaacatattcctaggtaatgctaatgctgctggtcacttggagaaccactgctttagaagacagtgagataggccgggcgcggtggctcatgcctgtaatcccagcactttgggaggccaaggtgggcggatcacgaggtcaggaaatcatgatcatcctggctaacatggtgaaaccccgtctctactaaaaatacaaaaatttagccaggcatggtggcaggcacctgtagtccccgctgctcaggaggctgaggcaggataattgcttgaacctgggaggcagaggttatagtgagccgagattgtgccactgcactccagcctgggcaagagagagagactccatcacaaaaaaaaaaaaaaaaaaaaaaaaaaaagtcagtgagataagagaagagttggatgaagagtttcatggataagaaagagttggacgactatttcctaaagtcaccatataatggaatagccctctttatttcctataaaatttcaccctccctttcataccaacacatagagaaacctacatgaagattacctagggatcaaaattcttctttggctttctaatccctctattgggttcaggtccttaactgtgggaatgaagaggcccatgatcaaaaggagcccaggcccaccaacctggaaacttgaagacaacttaatcactattaaggatattcaagaattcaaaataacagacccaagagactaaagaaagaaggtggaatttttattccaaaaagcctctgtcagtttcatgttgaacattttgtacttgggctgcacttaactgcctgccccttaatccacaaactaatatcatctcaccttggttcacctttttcttttcttcaaaaggcagtcagaagcaagcaggggcaatgagaactttctacctaggcatgggccactgtttaagcatctccaccttctgcttcaaaatctttctccaaaacaaacttccactatgtggtaactatactgtaagaaatcatttaaaaggcagaaagaggaaatgaaatgctctgagagactattttctcatgcataacttcgagggcagtatctcacaagtcagtactttatttttgatggcagacaaaaaacatgttgtgtttgaagattcatgtagaaatctttgtgaaaaaaggtcaaaattggatttaaaatgttcaaaactccaaaaatctctaaagaacaggagcttgtttattttctagcaatttatctttccttaaaataagaagctatataattacaaagtataattaataataataacaataattaccacaaatacaacagaaataatgatagtaagcaccatgggcccagatccccatagttacaaaggataagaatttgtctcagtatatttgagaacagacagcagcccaataatacaggaaaaaaaaattggaaaggaaataatctttcttgtgctccctggaaaataccacagaaaaatagacaatcaaatttaatacctgttgttaaatatcttcattgtacagattaggtcaggcaatttaaatagacaacaacatgaggcctctaatgtctcttaggaaacagtttcaatgtaaattcctaggaggtcccaattcaatttctagttaagcatccccatccactcgtaacactcataagaaggagaaatgcatttgtatggtgttttacagtttataaattattctcacaaacgtgttatttgattgtctcaaaaatcctgtggggtaggtaagtagagaaagtattaatagtatacccattagaaggtgaaagaattaaggatcagagaaaaaggacataaattaatctttattaaatatccacattgggtcaaactgtgcagacctggaaagaagtccaaataaagttttacataacatggataggcttggagaatttgttaactgcccaaagtaaaaaaatggaagagctagaacttgaatgcagataatgcagctcaagatgtaatggtctttccatcagaccatagactaaactctcagttgtaaccatcgtctagttacagtaactgcccctctcaagaggaggctatttcattgccaagaaataaaaccgtgaatagtggtcaggttttctgtttttagttagactgaaagaaagcacatactccttgagaagacgtgcatctttttaacatgacttagtctgtcaagagaataagagagagaatgtgttatttcattcatgtagaatactgacttttaaaagtcactcaatttctctaatgatcagtgatgttgagctttttctcttaggtttgttggctgcatgtatgtcttcttttgagaagtgtcttttcatgtcctcaggggagggcagtgtgggggcagagagaatcaagaaaaatagataatgcatgcggagcttaatacctaggtgacaggttgataggtgcagcaaaccaccatggcacatgtttacctctgtaacaaacctgcacatcctgcacatgtgcccaagaacttaaaattaaaaaaataaaaaataaaaaaactgactccagctacccatggacacaagagacaacacggtcccatttgtcaccaaaatagacaacacagtcccatttttcactaacatactctttgcaagaaagataaactaaaagactatccaacattaatagctagattctggcatagtctcagcttaaactattagtttctaaataagaggcaatacatatgcatagtaaaatagagaataacagcaatggatgtattaacaaaatgcattttccattaattgttatgaattaaaaagtctcgaagctatagatcgagactttgaaacttctggaacaaattaacctatctctttttatttttactttatgcatgcatttacttgtgtagttggtgttgctatgttttcttaaatttgtttttaagataattatattctccctctacttttatacatatatcttctgaggcatttaaaggtttgacaaagcagtgtcttctcacaagagacagaggtttcacttagaagccatcttgggaatttgggctgcagaaatcaagggaggtctagtacgtaagtaaatattagtgcaataatattaaatttttgaatactaaaggaaaacatttattgaaagaaaattgctttatatccttaacaactaccttgctatcgaggatttttagagaattgcagaatttcagagttgatgctatatgtaggattttcttttcttttaattttttttttagagacagggtttcactctgtcacccaagctggagtgcggtggcatgaccatagctcactacagcctcaaactcctgggctcaaacaatcctcccatcttagcctcatgagtagctgggatcacacatccggctaattttttttttttttttttttttgtatagacagggttttgcttgggggcccaagcttgtctcaaactcctgtcttcaagtgatcctccctccttggcctcccaaggtgctgggattacaggtgtgagctactgtgtctggccccaaagattttatttttataatgacagaatatcagtgttagcagagtccattaaaattatatatgacaatcatctgtttaacccatttatgccaaatgttgcaattttgtgtgtgtgtgtgtgtgtatgtgtgaaaaatcagaacttggtgatgaccttgagcaacaggatatacataactgccacaagcttagcattccaatagtggaacactaggcataaatgggttatggcttcagtatcctgcaaaatatccctgtaaggtagctgtctatgcttaaacaccttggtcttaggaaactaggatttgtggatattaggcaatgttatgggctgattgtgtcccctaaaatacatagggtgaagccctaagctcctaccaactgtatttggagataaggcctttgaagaagtaattaaggtttaatgaggtcataaggttggcactctaatccactaggactggcgtccttataaggacaggaagagacatcagaggttctcttgagctcacaaagaaaaggctgtgtaaggacacagcagcagaaggctatctgcagccaaagacagaggcctcaggaaaaaccaaacctgatgacacctcagtattggacttctagcctccagagttgtgagaaaccaatttctgtttgctagtccacccaccttgtggtattttgttatggtaggcctacagactgatatggtgcctgtatcagtgcctatatggtgcctatctcatcacaacctgtaaggaaggaattacttaaagccaatttataggtatagaaacagactatggaacattcaagaaatgtcccaagagacaaggattcaataagtggcataactgagatttaatctaggtctatcttccatattattttttaccctcctattttttacctttgaacacagaaggctgctacaaagttagtgtttcatattgacttgagtattttattcttgtaggtttcatcactggctgatggtctatttgttggagtaacagaaagcaacataatttatcttttagatgactgtcattcatatacttgaagatagttattacattccttcctcctgaatttcctgttaatcccggttcccttaaccattgctcatatcacatgtttcagttccctaccattctggccacttatacctgaagatgttcctatctatttaaatttcttgtactgggttggaaagtcatatctctgctacgtcattcatgactagtctttttaaaatataaaggcaatatcttgcatttatccatttagaaaatttcatctgttagatgtagcccataattccagtctttcaatgtctttggaattcgattacttcattcaacaacttttctatgtatctggactcatgtcatctgcaaatctaatgaatatgttttcattccagttattgaaaaaaacttgtgaccaagataaggccgaaaatatccttgcaatatgccacaggaatcccctatattatgatattgagccatttgtttgtacctaatagtgtggtcaatcaaccagttactaatccagctgtacctacattagttactaatccagctgtacctagattagtaactaacccggctgtacctagattagtaactaacccggctgtacctagattagtaactaacccggctgtacctagattagtaactaatccggctgtgcctagattagtaactaatccggctgtgcctagattagtaactaatccggctgtgcctagtttagtaactaatccggctgtgcctagattagtaactaatccggctgtgcctagattagttactaatccggctgtgcctagattagttactaatctggctgtgcctagattagttactaatctgtctatatatctaacccaggagatatcagatcacatattgtagacatcattttactgaagccattctattgtctagcaagcaccacttctttcagtggatcatgatacattgttttatactttattgctttaataatccattctagactgttgctcaggactaacagcaagtagttgcatcatcataaattgcctttctatactttctgtaaatcagaagatttccacatctctagttatctaacattgtttctcttctcctcaaacatggatggtagtaattgactatctcattgacaaatcctctcatgagtatatggttctctatccctatttttaggctcttctccttttcctttttttcctgttatcttccaaggaaagagtcactcatgtttaatcatgaacggtatgttggtcagagatagacctgcaaactggaacaactgagaagatttatacaaagtgttgtcctagagtccctgactgtgcccgtagaggaaaatgtactatgattaggtgaggctttgctctcatctccacacagggctctgcatggcttttctatttcacttctggcagtactcctggggaaggctacatccttttcctattcattctgggtgacttcctttgccaaagattcaagacagctttgtatttttcagtctttaactgagaaaggttgtgatatataatgcctttattttcccatgaagactttctctgaggcatgcacatagccacgacctttacctaatcaagaaaagttgcttgggcagtgggggatggggatgcaggttggactttaaatgcacaaatcagttctaataaaaacactgagattcaggtgcctgaggttagaaatactggagggaattcaattacactaattaatatttaagaagggctagagatcacacactgaatgtgggaaactaggccagtcagacatgagcatatggggagggcaagatcaacagataaaagtaacaaacaaatcatacataaatgctccaacaggaatgaaatagagaatataaaataaatgttccaacagacactgaagaggaggtaaatggtctaccagacataaaagcaaaatgttccaacatacacaagacattttattggtttaatgtaaacacatatattataaaaatgatttttccacataagttagtaggaaatgttacccatttatagaaacagacttacgggttctatgaattcacagcatactatatttgctctcatttcctcactggctcatcatgcaggagtctcaataaggcttgactttcataacaggtagttctccaatgcctaagcctacctggatacccaacgcctgacagaaggctgaaaagctgcagagtgtgcctgcttctgcacaagtttttctagttccggttgctctaatgtgatttggttggtgtcacagctaataccacattctctatttgatctgatttttcatctgtggcccagacagttgattctgatttttggtcattcttttatagacttgaaagttttctagagaaggcactagtggtgccaggactatcttgcttccttctgtcctgtctacactagcatttaattacacttttctacctcttttctacctctatgccctctcaccctccttcatcttgggagcttccaaaactagaagccaagagaattaactaggttgctttataaaaattgtatatatgtagggtaaacatgacattttgatatacattggattgcttttgctatcaacggcatcatgtagaggtagtagtagaagcatggaagggtagaagaaaggactgagactgatatttggactcctctttcaagttttctgatgtacacatagagtaactagatggcctggactgtctatgtacaatacggaattttaggctcctggaggaaacaaaccaaaacaaaaataaaaacaaagtccttttccttcagtagctttagctttagaagaataaatgattcacatataccaaaacccacaagatacggtatccccaaaaagttaaattgtctcttacctaatagaggatcagaaaaagaaaagatagttatttcctaaaaattgtttgaaccaaatttgtggttttcaaactatgcttcatggtccccagacttacaaagagatgattacaaaaagattatcaaatagatataaataaataaaaaaataaatacatatataatatgtagtaaatacatatatatcaatttgcaattgtgataaaaatgacatgcaaatttaaatgtattatataaatttaaaaaacactggagaccaatgtgttattacaagttaattatgtacaataagaataagcagctttcatgcaggcctctaattaaggctctcagattggaatacaagctgttgaaaaaaactgttacaatatgcaactacttatcagtctcatgatttttttgataccatatagtatagtacagaaagtcttcacttattgccatccataggttcttggaaactgtgattttaagtgaaacaacatataatgaaagcaattttaccatagactaattgatataaataagagttaagttcttatggcaaattttgggtcacagaaacatcatcaagtttctaaataaagatcaaaacacttttgatattaaacattgaaataaatgtgagctgtacatgcatttaagaaagattaataaaagcaagaaataaatgtgagctgtacatacatttaagaaagattaataaaagtaagataattatttaatcaataattccagttcagggtcatgagtggatggagcctatctcagcagctcagggactggtaaggtgggaaccaagcctagacaggatgccattctatcttagggggcactcacacacagccacattcactcagacacacccatgagcctaacacgcacatctttgggatgtgggagaaaacccactacccagagaaaacttatgcagatatggggagaaagtgccaactctacacacacagtggctcactgggaatagttcttttttttttttcccatcagcgttatgacaccatgttatttgagtatctgctatattccccatacaaaaatacattgatttttgagccaatacaataatccaatgctgagtttttattcctttgtatatttgccattatattcttattgaatgactttataatattcaatatgataaataatctgaatttgaaaatgagtttatctcaataaaatattactcattattccatatgttaagtttctaataagatttagtttgaaaagaggattctgcttgtttaaaagaaatatgaaaaatgtctggatcaaataatatatatgtatcctgcaactcaaggcagtatgaatctcatatggctccaggctgctcagtttctgaatttatcaacttgctggcttagaccactgtatacagcagatgcattgggcccaaactagattttatatatgggccactattccttcaggcttaagaacagtatttttatactgaggaatagcttatttatcatgaaaccatcatacatcaaaagaagtcacgttgccttaaacttatccagtacatgaaatttatcaccctcaaagttctagattatcagaatttaatatattagtttaaaatataaccagttgataaccaagaaataagtcaatggaaacctctttaattatctaagcagctcatcttgtttataataattgtataacttacagatacatactcatttatttttcaatcaaaatatattatattgaaagacttcagaagatttttttcttaatattaaccaacattacttatagttaggaacagagtgagccaaaaaggattctcaccactacagagaataaaactagcaaacctggggaaagatccattttccaaaacctgaactacactctatgatggtaacgtttcaagtatttataacacttaagtataagtcaagagttgattgaatgaggcctttcatgatgtttatgtagagtagtcaaaccagaattatttatgtatttgtttatttttaaaggctgtcatttgaaagttatcacagtataaaggtaaaggatacaccggagtttccattctagctccacattcctggctgtgtgaccttggataatttagttaaactaaacttcagttttcacttctgtaaaatgaaggaaatagtagaggttctattgtcatgaatttctagcaagaaatcaatgaataaatgaaatgatgaatgaatgttgcttagcatgttgcctggcacataaaaagctctcagtaaatattaactgtaattaaaaaatatctaaaagccggttgctttcttttggttatttttttaatatgacttgattttattcataacttactgactatattttcttcccttctggaatgatgttctattgaggtttctttttcttttattccagaatgttctctgagcaatctcttcatttctgcctcattcatcagataggattgtaggcgttcattttggtagttctgcatttggttttctgtcactgcttatgctgttttcttgttctaactcagtggtttaaaaagtaaaattcaagtaaggactaaacataagagaatttactgggactaatggttatcaaaattgggcataaagggatgttattaaaaataaatcacacagagggagaacagctgatgacagcagctgtgaaatggatgtacatggtgggaatcagtgagccccaaagaaacaaacaaaaaacactggagggccatgaaacttacatgatttacaagggaaacccaagctttatgaacagcctctgaagactacagaggccaagcaagtcacttctggatgaaaatttggataagacagcaatactgaaaggagttatgttccctgatcaaatgggagctacagataagaaaagaatgagaaataaaatgaaaatctttaccgagtttgatttctttattgtataacctgcactgaggggacaccatctctgggtataccactatagatacacttaccaaatgcttagtgattattgcaatagttagaagagaatatattttaagagccaaagttacaaatctatggacaagatgaattaatattagaacccatgttgagatatatagggcccaagtagtctatgacacaaaagtttgtgtttttatttaaatagaactctaaagacttagttgtttgaaatatatttaatgtagagaaacatttttttgaaaatttggtttactgtaaagatgaatggagatgtctaactttttgccttttttttctagatatggacccacctctctattttcaagagcattaaattcagttaaaaactaaaaacaaaaatactgccaagggattgagacggtaaagtaacatcatgcctgatagaataaactatcaagacagcatgaacaaacccaactgaaatggaacaagcaagcttaacacaagtcaaagaagctctctagagtgttaaaatgaaaatacaactaaacagaaccaaaactgctattcatgggaatagcaaatgaagaattttcttcagaatctacacggataacttctatgagattattcaaaatgtggaaatttttttcagaatttttgtttccaaatggaatttaatacatttcatgaaacaaatgaaattttatcagaaataaaacatttaaattaccaaaagcctagcctccttaggaaggctgttttaggaagacatgggtagaaatattttcatcaaagccctgatcatcttccctttttgaggtgaaatcactctactctgctggaaacctacatttagttatttataaaccagtattaaatgtatattgtttcaaatctctatgtaggaaaaatatcccacattcattcccattttactatgaactgtataaacttccaaaatcatcatgaaaagaaaaacatcaccctttctgctaattaagtgttcttgctttttttctagtaatgggtatttgaaaaataacaatatgcaagagtatgatcttacagtgaatatagccactaggtcaatatgataatttaatgtgagactttaaaattgagctttccttttatgctactattctctaaataacttctttatttgctatgattaaaatatcttttcatcaaatttgatataaatatactagatatggtaaatatatttatcatttaaaataacaattgaattgtacaataagcactatatcattgcccaatttttattttgataaaatctttttaagtgatatcatttcatgttaggctttttgtgctgcttaatattataattaataattcatatttttgtctttctcctctctgacaacttttatttttaatcggtgggcatgtgccaaattggtttgttatttatttataatgtaaaatgacaagggaattgaatatgtgaaataagatagattttctttcatatgacaaaaatttcttagtaatggggatgcttcttgcttacccttatagattcaagggttttagagaggttaggtcaaatgtcacacttctcatataacaacatgtggtaagtgcattaaatagactgttcattttttaaaaattcattttagttttgtgaagacatctgggcacatgcataaaaaacaggacaaaacaatatcaaaatttgtaaaagactccctattccgataaatcctatagtgtcaattaagtaaaaattctgaccaaacagatgtatttgtattctttcctaaaaactaaaacaggcaaacgtaataggaataaacagagaacgtttcaaagatacagaatttccattgaaaaaatcaaatgttctgtctgtaggactttatagaacattaaataatcttttcagtactgtccataaccagaaaccacataagctggatgctagactattgactagttatgacaaaaaattcacagtttgatctcaagggcatcagcgatcctgggctcaggtgatcctcccgccttggcctcccaaagtgttgggattacaggtgtgagccatcatgcctggccatcgtgccaacgtattgaagtggaaagaactaatgctgagcagagaatgggccatacctgggtggttttaagaggtgctgctataatgaaaaatcacaggctcacccaagaactaccgtggaatcagaacctctagggatatggccctagaatctgaattttaagccagttcctgaggtgcaattcagtttgagaactacagtcttaaggcaaaacctttctatcataccagagcttccaattgtcaggccctttgaatccaccctttgtgtcaaaccttagataattcaagagacataacaaacgtgatcatgttacatgcttcctcacagatttcagtgtctcccatttcttctattagtttaaaaaacatagtccaccatcacagggccctgtttaagccagctcctcctctgtggctctgcctttgtggtcaacctgtgcaaaactttgaggctgtgacatcacttagtcagtctccaacatttggaacaagagaactttttctaacaatttgatcccaattcctattttaagcttgagcattatgaaggctgtatctgtatataatattgaacacttcaaaacaattttagatcttaattattttgttattaaaatgttgggggtgtttaagttgacattgagtcagatgtaggaactgatatacagtgaagttaaatcctttagggtaaactcattcagtggtagaggctgaactacagagcctaggcattctgacattccaccactgtgcttatcagcttgctccttgagcaaaccttttcctgcctttatgagaatatgcccattttatgggctctgtatctatgagatattttacctatgcttatgtacacatggtgtttatctttcaaagctggactatggaaaagcctaattttacaaacatgttagtaaaagattatgtaatctgaggtgattacgtttaaaatggcaatgataatgatgttaattccagtcctgtgaggtactgtttctgatctggaaagagcagttttcttttttaacagcttattttgtattttcataatccattttaaggtttggtattaatatagacatgagaaataaaatataactgttgccatgccaaatgtatatcaaaaagttgctaatagccatgactgctatttggttaactgtatttcactatttaaataaaatgatggaaaatggtgtgtctaggatctcattcataataatgaaagacaatagaaactattagcataggtatgatgctaatgaatggtaaattttcaatagagatccatcgaccagattgtttgaaaaatgtttcctgtgggtacgaaaaatgcacacaaacaaacacatgcatcaaaatgtccataattaagtttttagggaaaaataacaatatatgttggttaaggactttcacttaaatggcattatagatctttcagaaatgagagttgatttatacttcagtattttggttcccaaaggttgggacagtgggtggtagaggagaagtagagtaaatggaaggtatacatgtatgtgtgtgcatatgggcaactttaagcaccttgaatttaatgaacaaaaaatgtcattattctgtgtttatatatttttgtgtgaaacaagtacctttctctatcactggagtttacatggattttctcatgatatcttttgagaatctctttaaacactaaaatacatttttccaaatgaaaactcccataattctgctttattaatatctgaatgaatatttccattgatttgtccagaagaaggaactgagtactgtttagagagcaatctttttcatgataattggcagcaatgtttccctgctatcagaaagaaaactatagaaatacgaaactttagataaacatggagataaaaataatattatggagtccaactggtatctttgaggtgaggacaggctgagatggactccttggcttccttctgtccaaaaatttcctgtttccctatttcctacggttaccaccatggaacatgttaaaatctcagtagggactctgtttcaacttttcctgtcaaaacacagtgaaaaagcttaatggaaaaaaatgtccttcctatctccatgccaggcacagtgtaagatccacaaacttaaaagccaggaaaatattcttttatgtgccccaaagctgggcaagtgacctagtactacaaaaattcccaaataggcatgtgacctgactaatgtgtgctgtgagatgagtcaagaaaaatggaaccatctgtacttttattggacagtcaaataatttctttctgtccacccaaaaacataatttctatgttaagagtgatacaaggagacttttagaaagtctaatttttaaaatcagagatattaaaatatatgaaaagtataacctattaaacactggtggagataagcaaataggcttatgaaatcattattgctttaaaaatttgttacctactcattgtgtactaaggcttctctacgacatacagaagaggccggtgcggtggctcacgcctgtaatcccagcatttcgagaggctgaggcaggtggatcatgaggtcaggagttcaagaccagcctggccaagatggggaaaccccgtctctactgaaaatacaaaaaaaaaaaaaattagctgggcatggtggtgggcacctgtaatcccagctactctggaggctgaggcagagaactgcttgaaccttggaggcggaggttgcagcaagccaagattgccccactgcactccagcctgggtgacagagcaagactgtaaaaaaaaaaaaaaagaaaagaaaaaaagacatacagaaggaaatcagggaaaatgggaaaatgaagggaattaacaaattgcaataatctttaagaagtagagtatgaacaattttccttttctaggatgaaagctaccaacaactgaactcttagagtgagtgatggcagaaaaaaatagcaatcaagaataggggcatgttagtttttagacatgtttacaaaactctgccttttatttcttaaacccataggtcaaccacccatcatacctacattaccccatatgacaagtggatttgttgtatgtttcaagtttttaatcttggtgggaagggggagggcagagaagtatttattggtaaaatatcataataaaggttgagcctgtcaatgattgtacctaacaataataaatatgtgtaggaagtaagaacggcaaaaatgaagccgggtaggatactgtggatatggtgacagacaagtatctatacgaaatcctgagatatttgtcctccatttcataaattaaagtgccccctcttttgctttacagataaggaaactgaggtgcattataatagcaacagcagctgatgtgtagtagatccataccacaagccaggtacgatgtcaaacatttaaatgtatcatttaatttaattttcatagatctcctacaagacaagtgctattattttcattttacatacgagaaaactaaagctgacagagattaaataacttgtccaaggttgcatagtaactaagtgaaagagccaagatatgaactcagatctgtctgatttcaaaacccaggcccttaaacactaggccagtggttttttaaccctgattgcacattagaagcacctggcaagcttttaaaacctactgatactcagaccctaccccagaacaattaaatcagaatttcttgtacctgggccctgatgtgggtgtttgtttcaaagcctttctgggtgactgtaacatatagcttgggtaaagaagaattgttgggtgtctcccatggaggtcagtatatctgtgccaatatgtgaggtagtacaagactcaagtgtcctcagtctgtctgcagtggtttttcccttgccccatcatgttcactttgacatcttttttttattatgatttttggagaagtaatatacaagtgacaatttttttacaaagcattgtcacagcagaacatggtcataagtccatcaaagagaaacctgttcatatctatgtacaggctatgatgaatgaatacaaagaagactatgtttattactctcatccccaaagggaagtataaagctggccttaaaagctgttcataccaaagctaatcactaaaatttggaatggcttcctcctctcctttcacaaatgcaatagggtagccactggatctaaggggaaaagatccaattaccactctttacaatgctttttcacttaggatctcaagacgactgacagtcattcaaaacataaaagtaaagtgaaaatatctctagtagaagtgaaaagaaaatgtctgtagtaggaagaaggcctaaatttgtgtctatactctgccactttactgcaatgacttgaggccaaaagtaaagtgacagagtatagacacaaatttactgccatgacttgagccttgatttccttttctatatgtacttaagccatatcatccttagggcagtgatccaaaaaatgtggtccccatcagcatcatgtggaaacatatcagaagtgaaattatcagtccctaccctagactctgaatcagaaacttggtgaaggggcagtaatctgtgtcttaccaaacattgcaaataattctgaccacctccagctgactctgatgtatccacctccatggggttgttgtctaagaataaaaggagatggtccataaaattgttattttttttactatctactgaaatcagaaatttcaaaattctctcacagagatattttagagaaataatgttacagcctacattagttagataataacctcatttctgaatttcactttgaatgtgtagacgaggcacaagtcaaccagaggttatgcaattagcttggagtcaaagagaaagcaaggagtagagctgagaaggaaaccccagtgtgaacttgatttttattcaatcaaactgttaaggtaccaaccacgcactttcatctataatcacaatgaaccttttaataaacatgtttctatcctcttagcttaaaaaatataacagtagctttttggattttaaaacagattgacttctatacttctgggctaaaggcagctcaagagtcaataagaatcacaagctttccacagtgagaagaaagtgcaattgcccagtcctctctatctatgaagtgcagacagtattcctcttcctcacctcacactttcgattattgcaatggtggaaaccatgataaataaaagcgcttatctagtggtttggttttcactaaaattacagacttctgtaacattatttggataccataaaacacaaaccaaattttaggagatgctttagggtgttttttcccctgccctcctgtcggaagccctctatctttttactgtaatttatctgatatagctaccaagatgcttgatacttttacatgcaagggtgctgaaaaacaaagagcgagggaatgggttgttaatgaaattctctgattgtaaaaagcactctggaatgatcaggtggtaaataataataagaggaaataacataaagtgcttaggtgctacagcgatagtcaccatataaatgcagaagagatcagacatgaatagaatttgcattttatgcagctgctgtgtgtgtatatagaatatacagtagctaatttttcaataatgctggtaaaatattgttcaaaatctattcttgctgtcttctcactttaaaaggcattatatagaaaaacacccatctgtcctagtgcaatggtgaatgtgtgcaaagagcctagaaaaagagcctctttgcatacgtgaaaaaaaagaactcaaataaaaggagataatgaagaagagacaatagtaacactattagaacagctatgcagacaagcacaaaggtgatctttgaaaaacatcagggataaataactctgttaatgtgtggcagagaaactacagttaagacatacagtaatataccaaaaatatagacatgcttttattttgtctactgggctattgtgatagtgatggttgtttttgaatagaaaggaagaagagagtgggaagtaggatttcgttgtttgttgttactgttgctgctcagtttagaacaacaacatcaactacacaccagacccgtccaacagttccacaaacaatgcttaccatgaatctgccctcaattttcttgttgttattttcccttaatacttattgataacccaatgcccattcattagatatgctaaatcctcgtccatggttactctcctttggaagagactgagaagatgctaagagggagttcctcttacacataagggaagagtctgtttaggaatctgagaaagcagaggccaggataaagagaccactagtcaatcaatactaagcaccgaagactgaatcacccaaagatacaattatctcccttcctttgttctgtctcttagtcaaataaaggattgtttgtagaaccttttctgttcctgatctctaaaaagcaggactggacttgcacatccaactataattcaaaatatctcacacttccaacttgaaagaagacataaactgtttcaaagaaactcagagagagcaaatgcatattcacaaaacttacacttattcctagaataggaaaatggagagagaactaaccacataagaaagggctaatcataataataatagtaataatgatgatatcaatcaatactttggattctagagaatgatttatcacaaaaattcacctgtattaagggagactccaggacaaggaggtcattaagctacatttccatcttcaggattcagccaaactcagactctccggaaagctgtaaatgctctcagaacagactttagtaatgagattggaatgaacactgggcctatggcgtaaaagcatctccctgccccttgttctaaaagttaactattaaaccatgtgcggttcatcctgatttggtttactcaattctagaaacaaggacatgctgatcagattgccctgggcaattgaatacctactgaagcctttgggaagacagtgttcttcccaccacccctacttaaaaggcttctgttaccagactatcaattctgtgttactggtgaaggatagaaagtatcttcttttgaaggacaagtttttcactcactgagttttctgctttgggtatatactcaacatgttaagtgcttaatcttttttcccccattcccctttttctactgtagtgtgttttgtttgtttgttttttgtttttgtttttttttaattatttgaagagtcacttgtctggatgcttcgttctagtagaatttggctgatttttttcccaacaccttttagtggaatgcagtaacagatgcatggagggagaattggtcttaacagtatttttaggtttcatctgtgtcagagagagatctcttccctttattgatttcttgcatacactatccacactacagcttgaaacagctacaacagtgtttgaaaaattggttgttcctcactgttcaaaccatttttcaaaacagtcgttacaagcttcattttactttctgttataaggagggttttgtttgggttggtttcattttccttgtggcgtcatgctagcagagaaacacagtcaggaatatagcttttaaatgtggtatgattgggattataaccatatcagaatctatattgaaaatttattagattgagccatgtgcagttaaaaagaaagaagtcagaagtcttcgatatttttcacaaacatgaacaccatctcatgcaaacgttaaaattcaccaaacaaatgataccccactgttggaaagatattttctcatgtcaacaactcaggaaggagtggggagggaatgggacatatacatgtaaaatttttctctatatttttgataataactctctgtgaatatgttttactacctaggtaatgcttatatttgtaaaaacatatagttatatcagaaagtcaattttgaataaacctgagaatggcaaactataatttttaaaatactaaccttttagaactgttcattttcacttttatttccaggactcactatcttaaagagaagaataaaagttgaagatccttgggattaacagaaagggtggaaatagccaaatgtattcatatttttggccaggcgcagtggcttatgcctgtagtcccagcactttgagaggctgaggcaggcagatcacctaaggtcaggagctcgagaccagcctggccaacatggtgaaaccctctctctactaaaaatataaaaaattagccaggcatggtggtacacacctgtaatcccagttcgggaggctgaggcaggagaattgcttgaacccaggagatggaggttgcagtgagcaaagactgagccactacactccagcctgggtgacagagcaagattctgtctcaataaaataaaataaaatgacgttcatatttttaaaatacagcaatattcatttgtttaaaaaacaagattgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaaaaaaaaaaccaagattgagagcacagttatatagtgacttttgatacatacacaataaaacttattgaattttcaaaaagtgagaaaaaaactactctgctttaaatttaaagtaataaataataatgaagacatatcaacattggtaactgtcagagtgagaaaaggaaattgaacattcaatgtgaccagaggaagggtgaacatgggagatactgcccaggaaaagtgctcatgatgagtaattcaaagacccagaatcttaacataaattttttatagttttcttttcaagggactatttgaaaaaagatggttctggggtttttgttgtagcttctttctttctttctttctttctttctttctttctttctttctttctttctttcttctttctttctttcttttctctctctctctctctctctctctctttctttcttttggctttgttgtagcttcctctttctctctctctctttctctttctttctagctaaaatttcactctaaattccaggaaattttcacgagatccttttagaggttctgacacaaataaagtaaaagtaaacctgttgtggcaaagttactaactagtctacactaactctcagtccttgctcaaagcaaaataatggagtttggggtgcaatctggtgaactcaatggtccaactgcataaaggcaaagaggaaagccaggcttgggcacttctgtagaaaatgaagattactggtttgaaggccagtcttctcactgcttcactgtatgtggtgactattgttaaattagatatccctattctgatgaaaaggcaatgtgctatttttggggtatacatgtttcaagctgtaaactgcaaagtgctgtataaaagtaaagtggtgttaatgcctcataagataaacatatagattgatgatggaggcatttaaaatgctttaattgcccactttaataaagcactaaataattataataaaaacaattcttcagaaaacttggtgggaaaaaggcctacaggatatgtttgttaagaataattagattttagttttggaggaaaaggtaggacaagtcacaggaggcactcgatgagaagtcaggaatgcctagtacataagccacacatattaagttgtagtttcttcaaaactgacaataacatgtcctccaaaaccaaagggaaaatcaaaggatgttgcctatacttatgtaccttttgctactggagatctagtcaatctatagccttggattcatagttctataacatgacaacatagcaaaatctcaccaacactttgttttaaagaaattggcagctgggtgcggtggctcaagcctgtaatccatgaactttgggaggccaaggtgggcggatcacaaggtcaggaatttgagaccagcctggccaacatagtgaaaccccgtcgctactaaaaatacaaaaaagtagctgggtgtggcggtggatacctgtaatcctggctacttgggaggcagaggcaagagaatcacttgaacccaggaggcggagcttgcagtgagccgagatcgcaccattgcactccaacccaggcaacagtccgtgactccatcaaagaaagaaagaaagaaaaggaaggaaggaaggaaggaaggaaggaaggaaggaaggaaggaaggaaggaataaattggctatgcctccaagtgaattatactataaacttctttcccattaccaataatgtaaatatataaccaggcacaagcatgtggaaatggagaaaggatgaacgttagtcttagaaactttggtttgtatcccatttccaccttttaacaagtcatttagcctctctaggtcaagattttcttacctattaaatgaagataatggtacccatctcacaaaattgttttaagaattaaatgtaaaatgcttggcacagagaggtcactcaatacatggcagccaaatcaccacatgcagtaaaacccagataaaatatattcagccaggactgttgctctgtgagtaggtctggtatccatgctacaaaatctattaagcctaaataatttggtcattttagcaatactctttagagattttttaatgacatttcccaaaggtcaagctagcttatggttatgtggaactgctgcatttataagagagtttagtgggttcataaaataagtcttgctccccaaatccggatcataaagaccttctatcataaaggataagagtgacatttaaaaaaccagtttttaaaaaatgatggtagcaaataaatgcagatgatcaggatgacagcaagtaccaagtcaaagcaacacggagaagaaataggccctagcctgcaggttacactttaaacactgaggagaaatgggagagtaaagagcaacactgagcctcatcggactgtaggtgaaaaaagattcaaaatctgactctaaagcaataggtaaagaaatattttaaaatgcttatctgtaggaagaaaagcagtaaagcagaattcctaggaattgagaaacacttaggaagaaaatgcttaagtagtacgatccaaggtgaggctagctgcagaaaatacaaatatttatgggttaaatcaggactgaggaaaatataaagccaaatatgggcagctctgagggggaaaaaataggcagcttggtactcaactgtcatcacaattcatttgtgtttcacgtcccactgtttgtgacattaacagaattttgaatttagcaatggactatttttgtattgtgaatctctgcagccattttccatatgtagctaccactgtaactagcaataacagccttttgagctttaaaatgcttccaattaataagattcaaaataggggtcacctaagagttttccaagttaattccctttgtctactctttgaagcagagtggtattcctgctattcatttgcattgaggccaaattatttgaccatttcagtaagatatccttaggtagcttttgcttttattgtcattttccaaaggattaagttagttttagatttttgaactgcattttcatttaactaaaataactaaagcaatctttttatgagggtatttaaatagatcaaatttataccaagttcctactgtgtgtcaaacattagcaaagcaatttaaaatgttattatttatatatcaatacatacaaatcatatgtgttatatattaatgagcttatagccattatacacaggacttttatgtgttattattgttgtggttatttctgttgttcgcaggtatcagttatcaagtacctattatgttccaagaactctaccaaggactatacacactcaccatgtaatgaagatattattggtttattttccatttgaagatttagtcacaaaaagtaacttgtccatgagcatataatttgtgcattctcttaaaatcacttaaacttccacgtaacacctggattgacgtatgctttttcttacaaaatatacttcaattcaataaagattctttagtcacctactatgtggcacctgctaggatagttatctttgtttgctattatgctaaatcacagatctgaccattagaatctcttccttcctgaaaataccctctttaggtaaaactgtatttcttatcattttccatcactgattgaataaagaaaggtggcactatctggaaaacataagagcgttggatttacaagtttcttttaataaaacaaaccaagttaatcacaaattgttgcaacaaaatatgtgacatgaagggcatttaaggcacatttagacattatttctatctagaaacagaaatttagtccacataatgtcatttatctactgagctaaatcgtattacaattttcatctataaaatccagattcttaatgtgtgttggaaagataatatctctgacccgctctcagtaagaaatgtgttttgaattgttttgttagtaataataatggagttgtactggacaaaatatattttcagcaagtttctctggtaataaaaataactataatagtagtaataatactagtaatcaccaataaataatagatagcatttattgaactctactatgtgccaggtactgtgattagcactttacatgtattatcttattaatttctcaaaatattacatgaggtaagtaccgtaaatccaatttaacagaaaagcacattgagatatagaaatccaataatttggtaaagatcacacagatagaaaagaggtacaagtcaggattggaacccaaggaatctgactctcgtatctatctactctaggtgggggatatagcaggtgctatggtgtttgttcaagagaatactccatttgtgttgttttatctaccttattagggttggggcccatttggtctgtaagccaaatctgaagacagctgaaatgagttaaggtttgaattagtgctattcacactatctgccaattaaaatgctcccttctgagaagctgtagccagttggcataaccttaggacataatacatgctcaaaaaagtatctgatgaatgttaacaatggtttctctaagtggtgattttactttctttaaaaaatactttttcctattgtctgaaatattttcaacatgggcacattacttaggtgatcaaggggaaattcaggactttacttaaaaaatgtttttgttttgttttacaattaggttgttagtctcagttaaaacataactcctgctgggaagcctttcctgttgctgtactctctgaccttttgaaggacagtactccttactctgtctgcctcagaaccttatgaaggccacatactattgttaattatcagtcttctctgctttatgtgaagtcccttgaagattgaccccattacttatctacctcttagagctctaagcatcttgagtgcctaccactcagttcaatgaaaaaacccagaacacacatacaccagaacaagcacaaaagatgaaaaagaattattttagggttgacaatgcacactcttggtatttgcagatgacttgtttctccccttacattatgtgcaggtccccatggaaagaagtttcccacaagaagtgtcttgaatttactggtctcttctctggaggattttacaaatgcatcaaggaatacacacacacacacatacatacacattatgaaataatatgaggataattagaagtaatggggaacacaggaggcaatttctaaaaaatgaagcatattttttatatatataatgtatatatgtatacctgtatataatgtatatatgtatacctgtatatataatgtatatatgtatacctgtatatataatgtatatatgtatacctgtatatataatgtatatatgtatacattatatataatgtatatataatgtatatacacatacatgtatgtatatatatacacacacgtatatatatatatatatatacacacacacttttttttttgagacagagtttcgctttgttccccaggctggagtgcaatggagcgatctcagctcactgcaacctccgcctcccgagttcaagcgattctcctgcttcagccacccaagtagctttgattacaggcatgtgctaccacgcccagctaattttgcatttttaatagagacggggttttgccatgatggccaggctggtctcaaactcctgacctcaggtgatctgcccgccttggccttccaaagtgctgagattacaggcgtgagctaccacacccagccacatttatattttatattaagtaattttgttcctttcctaccccattataatataaacttcatgaaagtagaaactttattttattcactacagtatccctagtccataaaagaaggcatggcattacatcctcaataaatatatgtcgaaaagaaggaaaaaggtatagatgtttccactgtatttcttatatttttctggaaacaaaggggaaaggtgttcccaaaaggtttccaggaaaacttcaatcaccaatgaaactgcaagctcttgtcatgttcctcagaccactacctaattaattcctttatgtgcaatacatcctttctagcctgttgatactcaatttctggcgctgctgtaacttgtggagcaaagagtgccacgtgagaggtgcttgggccccttcatactgtgcctcacctgcgaactggggaggccactgccatttaggctccagcatcttttacaggccagctgagccaccagaagggaaggggagaaagagacatgcaagttctcagaatgtctggtatattcactcacacacatttctcttctcttctcaaaaaggatcctggcaacaaatcactgattaatgatgagagaaatggaatcaggaggaccccatgataccctctcatcctagttttgggagataaaatctcccactgtggggaggaggaagaccctacagggttttcttatgttttgcagcttccaaattgtagtagggtcctattctataaaattgctaccaacaactgtatacttagtgatataataccatatggaaccttgagttttacttaaagagtagattatgtggcaattcatagttatcctagtatggataagaaaatatcctagtaataacataattattctagttatgagtttttttcagacaagaaactcttttattcatctttttatctctagtgcccagactcaacatatgactttgtatatagtagttcttaataaatgatagcttaaaaattaaataatatttttaaaatggtgagatatggcttaaaggggttcaaacaaattcagagttttgtctaatctaggtgtttctagatttatgagcaggcaatcacatattattgagtatgtattagtgttttagttagtgttaatacagtataataaaccctcattgattgttgtagagaaatcctactattttacactcatatactagaaatgtttaaagtcacaattttaaaatagtggacttcaaactttattatgcacaactaacctgggcagtttcctaaactgcagatccaggctacattctcagagcttctgatttagaaattctggaatggggttcaggaatctccattttaacaggtgctctagataatcctgatataggtaatccctaggtaatcctgatacagttggtccttggactacttaccatggactaggctacaaggtaatataataataaatctatacagttcaccttttcaatacgaagagaagagactagcctattaaatgtgacttaactatcaaaattacccgtgaaaagaataggcaatttgctaagacttctcaaaatgaaccaagggaggacataagggcgagaaatattaaatttcaagccagaaatgactctttttaaaacttcaaagagactgacaatctgcttaaagtaaaagtggaagaagaatggcagcagtacagaagtgttttatgaacaatttaggaaagcaacattgattcaagaggtttatttgataacatgttttaatggttattataaaagtgaatgccttctaatctttgatttgctgctaaaatatatatgtatttatttacatgaaattttttttttaaattccccccttaactccctactttccacacatttttagcttgccaacattactgcgttaatggtgtcctttttttctctctctagaaacacatgccctgggattaaaaggggattactttggtctacttccacatccatgtcccagggaaggtactgcttctgcttccgacctgacctttaggtatctgcagccttcaattctttacagtgggagttgctttagcattgatttcttggaaaactaagagctgttttcaaaagccattttcaagacaaataatgaaaattattttcttatgcttatggatgttacaaactgtgtaacaagcttttctctttaactttgctgcaagaaagtttaaaggcaactgtatagcacttcactgaatatagttttatgctgacctcacttctaactccatttttatatcctttcctttattgttttatttttcttacctatttctaattcatgtattttgctgcaatcatgtatttatgtttattttttcattgtcagccattttaattcccttattggtgcaataaatagtaaataagacaaataaacaaaacaaaaacatatgtatgtatgtgtatttggtatttacatcgcatgtactcaaaataaaaaataaaaactaaccacctaaaataattgacatatttcattattctttgggctatagattcacttgactgcagcacttccatttagggagatataaaattaaaataccaccatgaaaaaatccatatgaaatttgacataggtattttcagccccaggtcattaattcagttctgactgacatctttcagttctgttttaaaatttttgtgttcagtctttcgattacacacacaaaaaagttttggcttaatcagcctaataaagtgtatatttctgaaaacatttttatgtaaacaaatatagaagtatacatgatacatacacatacattttttacttagagtcttcaaaccaaatatttcagtcctttgcttccagtattattttcttttaagtaaatacttttcattaagcaacaaagagtgatagtcatctcaacaccaaaaacttgtattcaggctaagtttagtctactttgcatattttcctctgagaatgatccagccagtctcagtctgattctagtaaaactcaggtaatgtggaagaactctaattgagtattagacattttaacaattatattcatattgatatgtccttatacgaccactctaggtgaaatattactatgcttgggacttaaatatgatttttgttcttttattaatttctgaatctcatatccttccagataccaaaggaatacagtaccacctgggaataatgtcaattttcactttaaaaaaatattttgttgcttttcccctcagcatgggcaaccaatagctgattcatactttcattacatcacagttggattacagaagggctctttagtctggcctccgcatgtctcttgcaactcatttgtagacagcccagaaactagcagctggacttcatttttgttccagcagtcaccattttatagtgtttctctaagtcactgtgagtttcactgatgacaagtctaaaactccacaggtattcatatttagtgggttaaatcagagagaaaggattatgcttaactttctataggttcatgtcactcaactatactttgccattcacttaccatacgtcaaaaaggtggaataatactattcttacatagaggactaataagatatacttagcaaaagtaggtggttgcaaaacatttttttaaaaatcagagtgctgtatttttaaaatcttgcatagaactctggttcaatttttgagtccttccaatttctcataactctgtggtattcataataaagcaggcagatggttaagtctctgaacatatgctttaaatgccccctttgctatttctaaataatggaccaaattttgccctcaaatagtcacaggaaactttaaggaggctgcctcttgaaatctgaggacagaatgtgatccagtgggaattaaacctttaaaaaatatattttctaaactttcttatgagctctattccctataccaagacaaattacattttttaataaaataggatatagtaagagaaaaatcctaaccaatacaatattacttggctcaaggaatagattagaaggcaacatatgttttatttatttatattttaaaattctgattttctaaaacatgagagtcatctgattaatttctgtgtgattaccagattttccatttttattattattcctattactagtatcatgtagatgttatattgttaaaacatcttgcaattattaattagttaatttagtttaaattatgattatgcctttgttttaaatcaatgtttttcatagttattaaaagccaaaagcactatttttccagtcacttactttcatttcaaaaacagtttgttgtcgatgaaagcgcattttccaggttatcacagaatatgcaattcatctgcaatggatatatatattctggtaatgttgctcacataacctagctgtacttgtaagagtatctctgtttcttaatgtctatattttatacatggaattaaccttcatttgcacactcatatttctatgtatttaaatttattcctgaaagacctctgaactagtctctcctgtcttacgatgtccacaaaacttagcagtctgattaacattacagataaaaagaccacacaattgacaataaggacactttagttattatagacgtctgaagtttaagtattccaaaactataatgtccctttagaaattctcaataaggattagcttggtcctaatgaaaacagtgtttacttttaaaaataaatgcaatagttgtacccaaatatgttcgaaacactgtatgacgtgtcataatcaacaatgttgaaaataactaaagatctttaaatcaagtgataattttacacatatatccacaaatatctgaacaaaatttataattactattgggacaaaacattaacatattcttctgctaataaagacaaacaactttgagaaaatcctctctcattctcacgtctctaactttcacaataaatgcagcactgaaactaaatttccaactcagaaatacgctgagctccaataaacaagttgattttaaaaactcaccagactaacagttatgctttttcccttatctttcctttgctttcccttgttctttcactttccatgcacacacaatcacacttacctgcacaagtctgaaacatcagtctatgtattttttttgaaatgtactctgtaccgatgcatttttctgtgtttctttctaaccctcgagaatgttaagaatttaggaagagagccacagcttaagagtgcaattatttgccagtaaatactcaatttgcttgtcctgtgatttttcttctaacttgcatattcaataatccgtccctgactgcgtcacgagcacaaaaagtcttttctccaaaggagaagactttcgccaatcaaccttcagccatgccagggcacagcttgtcagggtgatttgttagctttaattaataattcctcacactggccattttcacaaataatgcagtgaggctgggaggctagattgctatgattcagacagataaaactacagtggaaaggggatggggaggggtgtgggggaattcagatgccgtttataaacacctctaatcatactctttcagtttacaatatagaggacatctcagttgaattaccacgttatgtccaccaatttgtattcagatggaaaccatatgttcctccactttatctgctagggactccctggtgccaacacagtcattgggcagacaacattcacaaaagaggtctctagcctctggattgcaaaagtttactgcagggtgaagttgagaaatcagacatatactgcacttctcagtgagcttgggtaacagtctggaaacacagaagtatgagttatgagtgtcagattttctcttatcctgctatgtgatactgggcatttcatttagccttaaaaaaaaaatctcatacctcatcctcaaatcagtttgcaacaatgactgatttgttcatgcattctatgaacatttattgactcccaaatatatgctacacactgtattaaatgctgagaattttgcttgaaagtaagacttttccatttaactgacaatccatgggcttgaacaaagccaccaaacagatagtgtgcaaataaaaataaggatttctaacagtttctgtgtggctcaaccaaataatcagtaattgacaacacacttgagtccattatgcaaaagtaatgctcggggtaaaaaagaatatacagagattaaaaaatatgtttttcaaagattaaaaaatttccctcaaagtgactagagcactaagaaacatattaatatgttcataaacaatttccaaagattcacaatcactttaggaacatacaaataaaaaaattttattaatgtccttaatcttatataagaatatatgcctgtgtttgagactgcaaatttattaatttattggatacatatttattgagcatctactctatttcaggaactgaataatattggagataagtaaagcacagcctcgttattcaagaagctcacaatttagtcaccagactctaaaagagaaaacacacatctcaactgaaaactgtaatacaatatagccagagcaatgacacaaatatacataaacatgtaggatgggcctcctagaagtgatgcatcaactatttgtaaaggttgggtagaagtaccagtggtgagaagaacattctagggagaggcaaacctttgaaccctttctcaaactgttactagaagcagagcaccagttctagaaaagatgggatttaatacatgacaatttcagataaatgtttcagatggtaaatattgcaggatttaaaaataaacttattaagaaacaaatgttccccaaaactataatgtcttgatatcatcaaaaaagcatgcagcatctctagcactggcacatagtaacatacatgtctttctcactttgtgtgtttcagttctctgaggcaaacatgaaacatgcttgacacacactgcctttctgtgttttcttgcctatttatcttcttttactatgggcaggcttctactgcttctgttttcactgtaccataagataaatcatatttgcatgactgttaaaggaaggggaaaaatctgtgtccattttgtggtcacacatctacttctagtcagatagcacatgctatatgggactaagagtgcaaatgttaaatgagaaaggaaataatactcctaaacccccaaaaagctctttcatagatagtaaatactcctagaaactatacagaattcttggtgttatttaacattttgctttatattatatttaacagtgtaaggcaacagccagaatactatttaccatagttcagtaacatctagccatttaaagaatttacaaagtttattaattcattaaatatgtatgtattgagctcctactatatactgagcacttatcagtaaatgtttgatttttattcccacaatgcttacacataataatagttaacattcattgagtgctgactatatgctagggactaatctaaggactttacatatagtatctcatttaattcccacagtaacattatatgttaggtactattaccacctccatttagtatattatgaaactcacaagtagagaagctagatatacactatgtgaattcattctacacaatgagaccagggcaactaatgtccaccaaaaatcagatttattactttatagttacacagtcacaagtaatgtttatgttgtgaaaattaaagaaaataagtccgggcacggtggctcaagactgtattcccagcactttgggaggctgagctgggtggatcacctgaagtcaggagttcgagaccagcctggccaacatggtgaaatcctgtctctaataaaaatacaaaaactagatggggtggtggcagaaagctgtaatcccatctacttggggggctgaggtaggagaatcgcctgaacctgggagatggaggttccagtgagccgagatcatgccactgcactctggcctgggtgacagagccagactccatctcaaaaaaaaagaaaaaaaaaaaagaaagaaaatgatatgcttaatgtgcatagcacaaaatctagcccagaataggtgtaaaatatatggcatttgaagtattcagagttaaagattaccacatacaactaagacttactgtttctggaccaaatgaccatatattattgaagcctatcttagacaataaatgtaaataaatcttagctaaagcaaattagccttggtagtctgggagggttttcctttgaagatgttaataatatagttgaactggttgtgtttaagaaagcagagctgacagacaaaatagagatagatgacacaggaactcaccagttaataatagaaaaaattcttgtttttccaagtgattaatacaatattacattgtatttaatgtagatgaaaaagcttatttggtactcactggggaagccaccactcagtataatcatatgctcttttcaaataatcccatgctgctaactttacagctaactgccagcatttgccaactccgggcactctgatgccctctccacattctttcttctctcttgacattgactaagtccagccacccataattcttgacctaaactatggcacaaatatccatgaaacagaacatttatttttggtgataaagctggttctagatgaaatggtggtatttctttatggaggagctgcaaggaggctctcttcatttgcttgtgtgtgtaagtaaagtttctgatttgggataaaggactgcctggaccctcaattattggtgtttattctatggatattggctgagatattttgtatgggaaaaccagcagatgagttaatgagcatccgtctgagccatactaacctagtggcacctcctgggaagccagggcgttctagaatctgtttatttctcaaatgaaaatcctaattcatagaagttaaaagtatagaagacaacttcacgtactctttcttcatgatacctggattggttacaacttagtaaaattttagcctgtttggtccctccttccttactggctgtctgagtctctagccttatataggaaaaccttgtcttctaattgaaaatgatgacaaacagaagttatgacagacacatttcaaagtagatgctatttttcccaaataaatttcacatacattctaattcctaaacttatatattttcacatactttatataaatacctgacaccttaaaatgttttacttagtgagacctagataatgaaggaataaaaaggtgacttaatcccagtttttctaaacaagaagtttagaactcacgtattttaaacttgttaagtgatgatcaatataatgggctgtatatttggttgagagttaaaaatctaaagttttctcagagtactttaaggcattgctttctcagtggaaatcttcgaccttcacattctcaaaaggagaaaaatgtttcttgtcagaaaactagtcatggctagtccataagaagaagtccaagattgtatcagcttccctgtgaccttgctatgagatttgctacaagtaatttaatgcttttctatgtctcagtttactttttatctatgatacctcaatgatattattaagataatgtggatcaagtgttttgatcattgcatagaacatatgcatagaacatagaatatagaaatccccaaatataagaatgaaaacttaaattgttagaatgacactaactctgctacaaccttaaatagcatatatagtacctcagtgtctccatttttttcagctataaaatgagaatagtcatctttatgtttttcattaaacagtatattggaataaatagagattattacaaaatctgttgaaagatttcaacaaaatgtcatacatgcaagtgaggtgatgaatatattaattggcttgattaaatatttctaaaatgcatacacagatcaaaatatcacattgtaccccataaaaatacataattatttttcaattaaaaataaataaataaaattaaaatgtaatcaaacctctgaagctgattttcaaatatattagaggaattgattttaaaatatcaaagcgtaagaagtaaatgttttcaagcatattcagacacttatgaaggaagactattaaaagacagggagcaggactgccttttctttgtgtggctggctgcattttatgatggattcaaaaccccagtaatgagaaaatataatcagaaaaagtgatttttagcaggctgttgaatgacacataaaataaaatgtattcattaatgagtcagcaaaaatgttatgcatgagctttcagagccagaatttttaagcagctttttcatacttggtacagccatgttcctgaagtatcctctcacaacccccttctacctctctctctctctctttttttttttttttgtcctgtactgccaggttggaataatgaccaaagggaggggcaaaacaaacagatatgctcactgtggcagaagtcactccaaagatcaaagactcgattcagccgtggctgccaaaatcagaaccacagtgggtgctcatcagcacggtgccctcagaaccacatgggctacccttgataggttagcagcttggggtgcaggccccgcatcctgcttagaaccacctgctgagaactggatgtgcacattaccttacccactcacaacatttgatttcaactcaattctgctctagtattatgtttattgaatgacggaagtctaacagacactgtaaaaatccaatttcacatcttatagtacccaaaagggaactgtgattttcctatatcagtgagcaaaatcttgagcaattagtaaacaagatcaccaatttctagtatttctatgagatatatttctttagttttctgtaaggagaaaataatatattggtaccttagtatccagcaatcttatattcatttatagggttatctcaagttaacatagtcaaaaacccagaagagggaaaatagagcccttgggaaatgaaaagaaatgccataaggtacacgctgttgcccaaatacatcattacttaccaaggagactttaatttggaaccaatttattcttctttaatacacagtaacaccagtaatctggaccctccattcatattacatgggaagaaaacactttcggaagaaagtacaatgatatctgtaagaaatgatggctctatctcagaatgaagaggagacagaggaggtgagggagaaataaaagtatgcaaagctaagaactatgtacagcttgcaaacatctctattattgagtcctgcagaaatcattgtggtaaagctctgcacaaaaaatagtgttcataattattatgggtttaattgtgccctcccaaaattcatatgttaaatttctaaccccaagtatctcagaaaatgaccatatttggaaatagggtccctaattaagatgcagtcgtaatggagtaaggtggttctctactcaagtatgacttatgcctgtagagaaaggggaaatttggacatgggcacacatacactgggagaatgctatattaaagatgaaggcagaaatcagggagatgccttacaggtcaaggaattccaacgattgccataaactccagaaactaagcaagaggcatgaaacagattccctcccacaaccctcataaggaaccatcccttctaatagcttgatctcagacttcttgcttccagaactgtgatccaataaatctctgttgtttaaacaacccaatttatgatattctattatggcagccctaggaaactaatacaataatgattatcaggaaatcatcatgtaaagactaaatcaagttcagaatatattgtttaagaaggttgaaaaatataagattcattgcagaaaacgaatcaatatgcttttgcagaaataaagcattcagtgtttgagtggcacaaatatcgaaacaataaatgatttctttacatggaacatatggttttcaatttttcctaatccaatgagatgttgccatctttactaaaaagacaaactgaaatatactctacagaacacgtcaaagaaagagtccccaacctccaagaagcattttgactaagaaggaagataaatatcaacttatttttatttgtttgtttaaaatacacagcctaatatggatgaaacggttacaaagagaagttctgggtaaagaagaggttgtctacttagaagaaaactactaataaatggggtttgaatctacataaaaattaaaaggcattcatccagatgagaagttaaagagaattctaagtatgaagaatggagaaacatgagaggactgaacaaagcaagagtaagagaaggtaggggcagaaacaacagcagagggaatatgagaaggctagctggtattgagagtgttatcaatctgaaatgggcacagaaacggataaaaaagcctgtagacaggtaagaaagacaagaaacagtaacattcccatatttaaacaagaagttgaaaacatctagtgcaagaattaagctctaatctttaaaacaggtgctcttaaatgcttttgcatgaataagagactgtaccttgatttttcttcaaaaggattcaatagtgggatggaaatgtgtgtgtgtgtgtgtgtgtgtgtgtgtgtgtgtgtgtgtataagctaagctgttactgcaggtaggtcaatgaagaaatacttcatggaacaggaagttatagcgttatacaatgtgttccctggagaagtttaaaaaaacacacacaaaatagccctatgaagtttgtttgctctgttaaatagctttaaaattctacccctactaattgttcttaacattttatttcagccaattatcaatttaatctgggagaagaaagatctacttgactttctgacagccaagtcaatccaactagaaaattcaaaccctacaagaaaactgctttgcaacatttttaactgacaacagaaatccatgataacataatcacctttttctttctttcccaaactcattctctctaaagaaaataaacaatggtacaaagatacttggatgaaatgaaaaagtgaagagagctattccctctttatggtaataggatgttcttgttcaagatggttaaaaatgtaacctgagttctttttcaattctctatagaagttggagatggtcttgtctacatatctaaagtaactgaattatatcagcaaatataagaattacagcttaatttcacccattttctatcttaaataattcataaattaattagtctctttattttattcattggaaaaatgttggcttagatgatgatattcaagtagggacccaaaatgttaaaaacgaagataaggaataggttttgcatagatactaccttttttcccactgatttctatggattttctattacagaaataacttctgcagagcactagtacttctgcagaacagagtaggatattctcaaaactgggatggtgataaaatgaataaaatcagcatcaagtgatgagaagcagatgagtaaaggaatatgccacagcactaaaataaaatgggcccttaattaaaagtccttgattaaattttaccttatgaagagaaatattgaaaagaaaaaggaagaaggagagatgaagggaggaaagatggaaggacagaagaaaggaagtgagggagaaaggaaggaagggaggaaggaaacagaaagggaggagggagggagaaaggagaaaaaagtgagttaaaaagcaagaaagaaggaaagaaaaaaaaggtaaagccattatagaggtattttctcatcctttccccactggctggccctctaatcttccttctctgcttcccaccccaatccaaatgtctgggacacaagtaggatagttgggaaaaaggggaaaaaaggaaaatttctttctccagctgatgctcactttggtaccaatagctctaactcaacagttccaagtgtttttaatctcatgtggtcctttgagaataaatgaaacttatcaaccttctctccaaggaaggggtggggagaaagaaaaagcatatttacaaatacatataaagtatacatttagataaaatataaagtatatttgcatacattttcaaagggcttatataaactctgaaattcatccctgcaccatctaattatccattagcttaatatgaaaaaccattggctctagaatctggaccaagccataataaatggttggggatagggatttggagaaatggaaatgagatacaaaacaaaccgagcaaaaacacacacacattaaaaataaaaaggtgttccttctctccaagtcaacccttaaggatctggctcttcattgttcctggaatttagatcaataaaaaatatgacttgaccaataactatttaattaataaaaatagataaaattatatagcaatatatataatattgtagcaattcttcatgttttaatcattaattctacattactccctgttaactgtctttgatagtgcactaatatataatactgccctgattttgaacattagtctaatacttacaataacattgaaaaccaacaccatttaatattgtgattagcaactcatcagacatataggaaattacaaggagactctgcaacagatacaacaaagcaaataaacaataataaactaatttcaatgttttaatggctatatgtaagaggaaacagaccttgccttaactgtactaatgggaattgtttatatttgtttaaaacataataatgtttcgcatagtaattcataatcttcaaatgccttaaagtatatttagctcatctgatgtgactatcaactctggaaagtaaataggagagatatcattatccttttttcataagcgagggaagagaggctacaaacgattaaatgacttcattaatatcacaaatctaacatgtggtagagcaaaggctagaactcacaggttctgatacccagtaattttgctaccatgctacacagtactcaaaaagtattcattacacatagcttgcttaggcacatgtgttgtcttactttggaaatgaggacaatagaatacaccctcaaatgagttgatacccatagcacttattctttcacgataaaattttattttggcacacagtaaaacagaaagtatattagctatttaacaggtgcaaatagatatttttgaacgtgtactgcatatcttatggatgatgtttgcatgtagtacgtgtccatgtgtggggactagtgtacgtttaatcattttgttagaaaaataataccgttgagttaagcctgtgttttattgttaatcatgcatttagtaacagcacaagttgacaaatcacttataattgctacatattatagcagcacaattcacaattgcaaaatcatggagccaacccaaatgcccatcaatcaatgagtggataaagaaactgtggtgtgcatatatatattatatacacacactatcatacatatatactatatacatactattccatcatatatatatgcatatatctgatgcatatgtatctatttgcacctggtaaatagataatatactttcaaatatatctatttgcacctgttaaatagctaatatactttgttttactgtgtgccaaaatgcatatatatatatatatatatatatatatatatatatatatatataatggaatactatgcagccataaaaaggaatgaattaacagcatttgcagtgacctggatgagattggagactattattctaagtgaagtaactccagaatggaaaaccaaaaattgtatgttctcctgatatgtgggagctaagctatgagggtgcaaaggcataggaatgatgcaatgggctaggcatggtggctcagacctgtaatcccagaactttgggaggacgaggtgggtggatcacttgaggtcaggagtttgagaccagcctggcccacatggtgaaaccctgtctctaataaaaatacaaaaattagctgggcatggtggtgtgcacccgtaatcctaggtgctccagaggctgaggcaggagaatcactttaacctggaaggcagaggctgcagtgagctgagatcatgacactgcactccagcctgggcaacagagcaagactccatctcaaaaaaacaagaatgatgcaatggactttggggtcttggaggaaagagtgggaaaggggcgagggatagaagactgcaaatatggtgcagtgtatgctgcttgggtgatgggtacaccaaaactcacaaatcgccactaaagaacttactcgtatagatcacctgaggtcaggagttcaagaccagcctggccaacatggtgaaaccctgtctgtagtaaaaatacaaaaaattagctgggtttggtggtgggtgcctgtaatcccacctactcaggaggctgaggcaggaaaatcacttgaacccaggaggcagtagctgcagtgagctcagtgagctgagattatgccattgcactccagcctgggcaacaagagcaaaactccatcttaaaaaaaaaaaaaggaacttattcatgtaaccaaataccacctgtaccccaataacttatggaaaaaaaaaagaatccacttcatgtagtaatatatgataagcacttagtaaatgccaattgttatgttcttgcctgggcaacttttggttgtcaactgagtagaaaaaagcgccatcttttagaaatctgtaattccttcttatctgtatgttaccttcattttcataaaaggtaagcagtaaagtgtattgtatcatacagtgatgaattttggaaattatgcataacattttaattatagcttgaatatcctttatctacaatatctgggagcagaagtatttaggagtttaggcttttttcggattttggaatatttgcattatatacttaccagttgagtacccctaatccaagagtctgaaatctgaaatactacaatgagcatttcctttgctcatcatgtccatgttcaaaacatttcagattttggagcatttcagatttcagattttcggattagggatgctcagcctgtattttaaatatgaaagacatgcacttgttaaggacttttgcagagattttactttgcaattatgagtcagcccatatatgacttctgttacgcaattgcatatttctcagaactctattttttttcatttgtattacttaaatgtttacttaactgggaaatagaagatttgttttttgttaaagtgcaaataaatgacaaaacaaacctaaataaaaaattagttgatttaaatactcaaaaaacccaaaatgcttcatgaataacatagtagaacatactttgagaaaaaaatataaacatacatatatctgacttcaactatcttgttagttgatttgtgattacttaattagatttattaaataactaaaaactgacttacaaatttataagcatatattcaggtttctgttgtaattaaagtaaaaaaaatagttaaaaatttacaatcttattgtccttatctttcctgtttttacttgggaaattatccttcttacttaaaaattttacttcctgtttttatctctgaaatatatagtctaatatgaaaatacacaagatggcagattgcaggggtgagctcatttcttccttaaggaaatgatataatagaaattataatctagtggatttacctgtactatatttctctcttaatattcaaagcaacccttccatcccaaataccagagccaaccttgaacagaattccaaagtgtggatgaaatttacctccagttcctcttccttatcccctctttgtccacgtttccttttgaccttttggcccttcctttgaccttatctaaagatgtatttctggtgttagaaagtgttagaactttcctcttcattttcagcttaaactgaagtctttatttaacttggattcctaactattgcatccttagcccatattaccaacctatgaattgaaatgttgccatctatctgaccaacctaataatgtcttgcatcctgctctcaataggtcacactctcttagataccagtgaaagacttgagatttttctgtttcctgcatttatctcagccttccatgtgaatcacctgtattaaaattttagtaatccccactttcggaggctgaggcaggcagattgcctgaggtcaggagttcgtgaccagcctggccaacatggtgaaaccccgtctctactaaaaatacaaaaaagtaaccgggcatggtggcacacacctgtagtcccagctacctgggaggctgaggcaggagaatcgcttgaacctgggagatggaggtgcagtgagccgagattaggccactgcaccccagcctgggtaacagagtgagactccgtctcaaaaaaataaaataaaataaaaaataaattagtaatctcatttctgattcacttgatctgggcttacttccttttcccagctgggctctctctatggttctagtatgctttgtagtgattaaaaggattaggataaataaaaccactgccataaaccaaaaaatttctggtctacctcaagccctaatggtcaacttggttttccctcgcccctagttattctgtttatcaaacagaaaataaatactctttaccaagtttcataacatatatattaaaaaaatctactaatagcatttagaaggtgagaattcatactgaatcttctacttctagatcaaaagcactagaatactcagagtactctagaaatgtatgatggaggtaggtgactcattcttttagaattcatctgtgggaggcaaaataattgcaccccaaaatgcccactgcctaaagcccagaacctgtggtacatggcaaaatgttatgttacatgaaaaagcgactctgtaaatgtaatgaaggttgttaacactaaaacagggagagtatcctagattatccaagctggcccagtctaatcatcttaaaagcagagaacttttttggctggaatttggaaaagaggtgtggtagaaggggaaatttgaaagatgtcaagtgtaataatgattcaaggtgctgctgctggctctgacatatagggacagcacacatgcaaggatctaaagatggttcccagctgatagcaaggaaatggagatcttagtcccacaaccatgaggaactgaataagcatgaaagtggattttttttcagagtttcctccagttaagaatccagccgacaccttgattttggccttgtaaagcctacagcagagaaactggtagagccaatctaaacttctgatctgcagaactgtcaaataataaatttgtattgtcataagctgctaagtttgtggttggtacaacagcaacagaaaacaaatatattatccaacatactatcccagtccaaaggccaacagacacattagtttaaaatcatagagtaaagaattgggacaggaaccactactatgaaaaaagaaagttcttaacactataaatacattttccccgatattccttcttttagtcatatcctcagagaaagtaaaatacctcgagactaaaggaaaaagaacacagggagtgtatatctactcaagtgcaaattgtcctcaccaaggaacttcacaaatgtgctcttcctcacaggcaagaatactatactaacagtgcaacattactcaaaccaactaaatccactctcttcaacaggaaaaatctgaaaagagcttgaaagtttataaaggcatgaagataatgaacatttaagaaacaatgaaaaaaagagaaagaaagtccaggcaaatgtacccaaaattcacagatcacatgcctactggggtatgttttgcctactatacaagttgtcttataatcatacctttaaaggaaattatcttcaaaaactatgattatttatttttatatgtcatcaccaaagctagtttttaaaatttatcttccaaaatgaattttctttcttactcatattttttacacagctagcttctggtcttaactgaacaaaggaatattggaagaaaggcagttatttccaatgattttcggcattgaagatttagaaaagttaacctttgaaaatttactcaacttcagaacctaaaactttttgaggtataactaccaacaacatgctgaaaacaaatacttttgcaatcgactagaaataattttcacagtaaaaggtaaattctcagcacgctgcacatattctactttataattatatcacagtatgaaataatatgaaagaaaataaggggaacaaaccaatataatgatttaaaattcttatagaaacaggataaatgaagttaattttatttttctgttgagatagaaaatatactgagctaaaaattactaataccacactttgaatcttcccttttgtcttccatggaggccacacatggaaggatagctccaatgacctgggtaagggcaatgcaggatagaaatggccacgtgagaaaatgtacacacattcctttcttttgaataccacattctgcttcctagaggtccctgtaaacttattaaaaacttcagtcattttgtaaggagataccataatttcaaggggctttgaggctcatttatagcaaattaatccccattttatgtctgtccccatttaatatttctaaagggggtggataacaaatctcgccaactctctttttaagggctattcagatactaaataaaccaggaacatttaaaaatacaatctcacaaaaatctgctttgcttaaccttctctccttctttaaaaaataagaaaggcatgatgttctttttttgttaattaattcattttagacaattccttaaattttcattttaataaatttttgtgtgggtgcattaattactctcaaagatgctttacaactgttacctattaaaagcctttgttagtgaataaaaaaaaagaaaagaaaagaaaaaacttccagcatgctcccttccttctctattctgagcaggtccttgctatcaactgctggagtatgcttgctttgcacctagagctataattattttgctttaattttacaaaaccttttgttccattcccacgagcccacctgatccttatattacactcgctctattaaaacactcatgcagaacaaagcatggctgtactgattcataagtaactttttttttttcctcagtaaaatgccactggctaggcttcgggacacagtcctgggcttcaccatcctatgccaattttcatatgttagaacaaaaaaaatatgttgtatcagagtgttgtactcttccccaagatccttcctttgccccacttgttttttgtgtttttaaacatattttatcttatacttaactttactctggggcaatatacatgacagaatgttgaggatggtggatatattaaaagattgtaatcatgttgatatttcttttattcatgtggttaaaattcttaaaaatgacttctgttgccttatttaattttttttttctttctccttactccacctcttttccttgagatcttgcaatacatgtgggcttttggcaaaaaaaaaaaaaaattgcagtgactcatcaagaaaactgtttgtttgctctgaggagcaccctgaggaccctctgggctgcacacggagccctttgatcctaggaaatttatttcttccagatgttttcccgacagccacctttctgcaatgtccctcttcattatgtagcataagaatactcaagacccactgctatggtacagttttcctgaatggagtgtgacagggagttgacatttgattgagctgttggattcttcttgccttaggcacaatgatggaggaaggttaacactgaggaaaggcagaactgggtctgttcaggtacagtgtctttaggattaggatggaaattatgtgaaccaggccaaagaaattatgtaaaatctacaaatctgcagaccattgatcatggacctagttttcttcaaccctgtaaaatcttgatgcctggatctgccatgttgttactcctccaattttttttctttttttttttttttttactaacatacaaagtgcggacaggaaagttaagcctttggacaactcttgttttttcttggcctggctgacagtgctagcggaaaggagaagggagaacaagggaagaatgcagagcaggtacaaaggtaaacatggtgtggtgggctgaataatgacatctcaaaatgtgtccacgttctaactcttggagtctgaatattaatttaaatgaaaaaaaaaaaagactttgcaggtataattaaattaagaattttgacatatggagcttatcctggattatctagatgggccctaactacaattctatgtatccttgtaacaggaagattccacatggacagaagaggccaacttaatgtgaccagagaagctgagattgcagtgatgtggccacaagccaaaaaacggtagtggtcagcagaagctgaggaaggcaaagaaaaggattctcccctagagcatccagaaggaatgcagccctgctgacatcttgcttctcgcccaatgataccgattttggacttttggcttccagaactgtgagagaatagatttctgatggtttaagtcaccaggcttgtggtagtttgttatagcagccacaggaaactaatacaaatggtaaccatttcaaaactccattgttcagagcatttgtgaaatcactgaagtctcaggttgaaggcacagtggaaaacaggatgccaaggcttgaagacaaaattctctgtggagatactggagatattaagggcacttataatctacagcaagtagggaactaaaacagggcaaagagagtgcacaagggcattcaacagaagattaaacagattatgaatgtaaatgttctaattttctaatgctggtttgcattttttatgaagtaggacaaatctatagtattttccatttaagttaatgcttacacacataatgtattaccagccattttccccctaaatcaattatcagtatcattaactttagtgacatttgatttggcaaatataaactatatttggcacatatatactgtattataaaaataaagatcctctatctgcacttgaggtaactttcctttagctattcaaagaaaaatctatttttaaggtttaacccaaagataatatggaacctaaacccaagaattcttaaatagatatattaaaacaataacttggctgggcatggtggctcacacctgtaatcccagcactttgggaggccgagggaggtcaggacttcaagaccagcctgactaacatggagaaatgctgtctctactaaaaatacaaaattagccgggcatggtggtgcatgcctgtaatcccagctactcgggaggctgaggcaggagaatctcttgaacccaagaggcagaggttgcagtgagccaagatcacaccattgcatgcagccaaaaaacacatgaaaaaatgctcatcatcatgggccatcagagaaatgcaaatcaaaaccacagtgagataccatctcacaccagttagaatggcgatcattaaaaagtcaggaaacaacagatgctggagaggatgtggataaataggaacacttttacactgttggtgggactgtaaactagttcaaccattgtggaagtcggtgtggcgattccgcaggggtctagaactagaaataccatttgactcaaccatcccattactgggtatatacccaaaggattataaatcatgctgctataaagacacatgcacatgtatgtttattgcggcactattcacaatagcaaagacttggaaccaacccaaacgtccaacaatgatagattggattaagaaaatgtggcacatatacaccatggaatactatgcagccataaaaaatgatgagttcatgtcctttgtagggacatggatgaagctggaaaccatcattctcagcaaactatcgcaaagacaaaaaaccaaacactgcatgttctcactcataggtgggaattgaacaatgagaacacatggacacaggaaggggaacatcacacactggggactgttgtggggtggggggaagggggagggatagcattaggagatatacctaatgctaaatgacgagttaatgggtgcagcacaccaacatggcacatgtgtacatatgtaacaaacctgcacgttgtgcacatgtaccctaaaacttaaagtatgttaataataataataataataataataataataataatacacattcaaaaaaaaaagatcacaccgttgcactccagcctcggcaacaagagcaaaactccatctcaaaacaaaacagcaacaacaacaaaaaacccaataacttaaaattggaaaagtccaatagcaaaattattgtgaccaaaccacccagtttatccctttctctagttcatcgttaaaaacacttggtagcagcattattaataaagaactaaaaatacacctgaactctatgattcttcttagctatatggcttttcaacaaccaaaccattaatcttcgtaatcaccatgaagctaatagatgtagactacagatacagataaagaaataagattatggaaagcttaaagagattctagatcaatcagcaaatgagaagaactgagaaaatcaagtagaaatgctggctgcgttctctagtacctttgaaaagctactagagatagaatccttcttttggagaaaatagtccaatgacagaacatgtaaaagatggacagagtcatttattttttgctactttcatattaacacagagtattcatttggcagtagttttcaaaacaagaagaacagtctatttttaaataaaattaaaaaaagtaactgatgattaacataactactgtaccaaaagaaagataacataagtcattcaaagtaccaggaggctaaagaaattctaatagttatccctatacaccttcatttcaataaacatgaaaaatgggaatctcaatgtgttgtcttttcaatttcctaataataccagggggactcaaggcagttcaaatctcaggacttcagaggccactgagttccactatctggggtgctgagcagtcgatatgaattccaacttcatactctccttgtctccttgttctatttgctttaacactatgtacacctaacttatctttagaaggacaggatgcatatcctttctataaaaaaactatgcagattttcatagtgccatataattacaggtactctttatttgtttatgaacccttccaacaacccaataggcaattgttaacattcccatttatcactatctcacctatttctgagttcctagagggttgagaacattcttttcctgttactatcttctcttagttctatcacccctggtaagaagttaagtagtaactagttgacatagaactcacggcaccgaagaatgggtggccaggatcagtgcagattggttcatttgggtttgtaacctttgtgataaattattgagtgctatagagataaaatataaaataatttttaaaaatcctactacaaaactaccttaacccttttagcacagattatgatcctgaaagctaataatctgtactgtgctataacaaatataagaggatgcctttagtatgataaagtttgctgtgatggagaaatggttgagataaatgggactttaaaatcaagagtcaagaacatttggaaagatatgagatacacttaggaatcttacaaatgaacaaggacttgtctctagtttcttagtcataatgtttctaagacacaaattaatcaaaatcccaggttatcagttacttaatataaattttccaataaacaccccttgattacacacttaggtcttcaaagtgggtagatttatacaattcccctctacacaggcaaattacatacacaaaaattatgaagttatttttttctttgaagtagtttagtgaatttttaaaaatctgtaatgaataaaaccagactttaaatcctgaataaaaccagactttaaatcctgaataaaaatgttctgtatcaatgattgtcatgatatgtgtcttggtaatagattattgcataatttttttcttaataaaatggtatctccatcaaacatgtagatcatggagtcttcccatagggacttttaagatcatgtaatccaatccttcattttacagatgaagaaacaatatgtgagtgttttaataaagcctactttaagtttttcattaagacaaaaatggttgttatatgaagagaaaaggagaaaaagaattaatagtagaaagttggaagtgaagagtgaggaaaaacagaaaggctttttcattggtgcagagcactaagcagagatgcattctctaatatatatccatgtcattgctagagactagcttaaatagtacaaagttggtaacatccttctcttttcttttttttgagacggagtctcgttctgttgccaggctggagtgcagtggtgcgatctcggctcactgcaacctccacctcccgggttcaagcgattctcctgcctcagcctcctgagtagctggaacaacagacatgcaccaccatgcccagctaatttttgtatttttagtatagatggggtttcaccatgttggccaggatggtctcgatctcttgatctcatgatcagcccaccttggcctcccaaagtgctgggattacaagcgtgagccaccacgcctggcccgtagtatccatttttaaaataatcacttagattataaacacgtaaacaatttagacaggtttacctctagggaatcatatgacttaccataaataagcaaacatattctgtattaccaacatgctaactgttcattcatttacactgtatattacctctcacttccccagaatatgcaagttgaaggaaacataacaaccattgtaaaactctatcttaaaataaatattattctataaagaaaaaacaaacatttttaagagtcatataaaggcaaattttaatttgaagacttgatactaaggaataaatatatatacctaatatgtattcacaaaagttaaaaactaatttttttaatgtaggctgtggaatcagactccctgggactgaattttgattttgccccatccttgaccttgggcaaattttttctctctgtgcctcagtttcctcaccagtaaaattaggataacaacagtgactatttacaagagttgttgtgaggatggaatgccataaatttacatataaatcttttagaacagggactggcacatagtaattaataaatgttagctgttacttctaatatgtacaagcctgttaaacattttgcaggggggagataaggtgtttctcattaatgggacttgttaaggcattttgtctttcaaatggctgcctaacttaattcataccaatattttatttcagtaggattaatgaaatagtatgaggaaaagccttagtgtggtttctttagacatgtttgagacagatattctcatccttttaaggggagtaatctaaaatgctacacccatttgtggcttaaagtaactgagaagtgactctcacaagatgacatgatttagctgtgtccccatccagatctcatcttgaattgtagctcccataattcccacatattgtgggaggaacccagtgggagataactgaatcatgggggcggtttcccccatactgttctcgtggtagtgaataagtctcatgagatctggtgattttataaggggtttcccctttcgcttggctctttccttctctcttccctgctgccatgtaagatgtgactttcaccttccgccatgattgtgaggtctacccagccacgtgaaactgtgagtccattaaacctttttttctttataaattacccagtcttgcatgtctttattgtgagaacagactaatacacaaggcaaaggagaaaatgggggagcagaagaggcttagcaggatgcatacatcttctgatatggagaacatgaaagcactcactgaggaaagtggaggtgctggctcttcagcaagcaaatgctccacctatatgctcccacagtatcttatacatgtctcaaagcctttaacctgctgctttgtaatgatttgtttacatatacttttttttgttattatatggtcttctacttgaagacaaaaactgtcccattcacttttgctcagtagttgctcagtggcatatttctggattgaatgacttagttaattaataacagttactacaatgggggaggctattgattttaaagcgagagctaagactcacaggttctatccaatggaggggcgtgttgaagtagaagtagctagctattatggtactgacaatggatctctgatctctgtgctggggataaatgctctaagtgagcatgaaatatttttgaagtttatacatgtgtaagttttttttccccttaaccataataactttcttttttaaaaatgcatgaatatttgagtaactaagtgcaatgttaatgttgggtgcaaatataatctgcctaataaaccatggaaaaagcctgaaaataaattcaataaatagagtcctagataatgtgttgtgggagatgagagaataagcaattaattatagatggtggaattaaggtaattttagtagagaaggtaatatttgagcaggatcttgatgcaaatactaaatctaaatctgtgaaaatagagcttatatccttaatgtagaaactggctgatatgcagagataagttgaaagtcctgtgaataggtgacataaacatcaaaggtattcctaattcccaatatacttgaaaaattggctattatttgatgcatatatccctgtatggcaatcagtccagtaaataaaataataataatgtcctttaaaaaattcatttattcatgaatattcattcatccattcactctttcaacctaatgtgataatctactgaatatcaaattccgaactgtgctgagtacattggaaaccacggtggtcaagacagaataaagtctctgcataagaagtaggttcagacaattaaattaataattataatgcaatacatattatgttaggtaaagtactacatgttatggaaatatgtaattataagcaatttatacttaaactcattacataaatatggcagaactatatttggataaagtgctggtggtttttattgaccttgaatttcttctgatttggtcttgtttacctacagagtagactgccacatctgggtcttacttatactgtttgctattcaaaatcttgcctcttgaactacctatttaattatggattcatgaagcacaaatcaatttattttcttaaattccttaagactaaacatggcagcatttttcctactccagtgtttctcttctgttaagatacatcttttggccaggcacggtggctcatgcctgtaatcccagcactttgggaggctgaggcgggtggatcacgaggtcacgagatcgagaccagcttgaccaacatggtgaaaccccgtatctactaaaaatagaaaaattagctgggctggtgacacgtgcctgtaatcccagctactcaggaggctgaggcagaagaattgcttgaatctgggaagcagaggttgcagtgagctgagatcgcgccactgcactccagcctggtgacggagcaagactctgcctcaaaaaaaaaaaaaaaaatacatcctcaggaagatgatggtgatgatgtatgaaactgaaaaaaatatgcttagttttgtgagattagatctacagggctgagaagagtaaaatcttgtttggactagtatattgaacaaaaaccacataggagtcacagtggaaacaattataggcaataccaattcttatcattttaatgaggagaagttaaagttggtcttttcgttgtggttcttaaatgcaaggtataacctatagtccataacaaatttttctttagaaattatcaagtacacagtgggttttctttagaaaccacaattctagattttttaaagcagaaaatatgctgtcctccttcattttaattcttttggaggaatagaactttttttttctttctatagttaactagagttgccacaggcaagaggactaacagagtaaaatactaactgatccaatatatactgcatttatctaactggatttcatctagctcaacatcatggctttgtagtctaagcagtagatgaacagaaacaataaactgggcaagtaatgttttgtgtgaataacagaaaagagtgaacagaaatataacacttcaccattgcacaaaatacaattaaatatgatttttaaaaacccagccactgatccactgcccaatcataaaagaattgtaatcagttcaagtagtcttaaatatagtgaaaatgtcctcaagatacacagcatgagagaacaaagagttttcactatcatctgctggactcagggaaggtgtgctatgtggttatcatttgagtgctctgtgtttaagttaatcaatattataaattatgcatgtattttagaagttcataatttctattaacttgtaaagttattgaaaagaaggatgaataaaccatactacaaaaataagaatgtgaataaatgccagtttttcctcagattacagatgatataacatcgctgctattttaagaaaatgagactggatcagatgtgaacatttatcccttctctttaggatagcctatgaattcaacacattgacactaattataacaatagctaacagttaactggagtactaaccatgtgcaaagcacactgtaattatttcacatatattatctcatttaatgctaacaacaatactatattataaacaaggaaactgaggcaaagggaagtcatttgctctagatcaccagggtagtaacgggtggatgtaggattcaaaccagacatactccagaatccatacaatatcagaatagtctgaccccaaaagacacacacacacaaaatggatctaaccaataccttgggaacatcatctaacttttctgggctttagatccttcagctgaaataggagttgacaaaccttttccaaaaaggataaaatcttaaatattttaggctttgtgggtcaagaggcaaaatcagagatgtcatgctatttaggtaattatataattggagagaaaacttgctgtatctcagccagttagatgaaaaacacataatacaacaggaaaggataatcttcaaactattaaattatattctctttgtacgtctaatgtggagacaaattatattaagaacacggtagctgaaataaaattatttcagattagcacatcaggtgttgaatgttatcagtggttatcttagggggtgacagaagaagattttagggacagagggaagttttttcacttccagttaaaatttattttttaagtggtggaattgattgttatttattattattatattttactttgtgttttggagtagttttcagtattttttcctggttttattgaggtaaaactgacaataattttacacatttaatatgtacaatgtgatggttatcaaatacacattaccacggtcaagattattaacatatccatcacctcatatagttaccattgtgcatgtgtgtgagtatgtgtgtgtgctgagaatacttcagatcttactctctgcgtaaatttaatggatgcaagtcagtattattaactatagtcactatgctgtatatttgatcaccataagttattcatcttataattgaaagtgtgtaccctttgacgaacttctcctgatatccctgtccccagctcctggcaatcaccattttattctttacacttttgaaatctactttttttttcttaatttaattttaagttctgggatacatgtacaggacgtgcaggtttgttacataggcaaacgtgtgccatggtagtgaacagccatgttttcaatacatcacaagccatagtagtgagaaacaccatttctttttttttcttttttaattattattatactttaagttctgggatacatgtgcagaactttcaggtttgttacataggtatacacgtgccatggtggtttgctgcacccatcaacctgtcatctacatcaggtatttctcctaatgctatcccttccccagacccccactccccaacaggccccagtgtgtgatgttccccttcctgtgtccatgtgttctcattgttcagcttccacttatgagtgagaacatgcggtgtttggtcttctgttcttgtgttagtttgctgagaatgatggttttcagcttctttttaaaaagattccacataaaagtgaaatcacacaaaaaaaggaatttcagaaaaactaaaaaattgaattaatatactgtcataggaaaaaacagaatttccaagaggagtgggggaaaataatagtatcagaaatataataataatagatctttttcctgtggaaaatagtacatagaaatagaaagtactgaaaaggagaatcagaaaagattatggctccagaatcacattatcttctacagtttgaagaaaaaaaaatgtggctaaaagaaaaaaagtatttccattacacaccttttataatgactagaataaaaaaatactaatatcaagtattgacaaggatattgacaaggatatggagctactgaaactcttatacattgccagtgggaatgcaaaactggaaattacccaaatgtctttcagtgaattaatggtaaatgatcttctgtatatccatacaaaggaacactacttagcaataaaaaagaaacaaatcgtgaaacatgcaatgatatgaaagaatattttattttatttttttaaagacagggtctcactctattgcccagactaaagtgcatgatcatggttcactgcagtctcaacctccctggctgaagtgatcctcctgcctcagcctcccaagtagctggaaccacaggtgcacatcaccatgcctagtcaattaaaaattttttttccttagagacagggtctccctgtgttgtccaggctggtttcgaattcctgggctcaagcattcctcctcccttggcctcccaaactgctggaactccaggcatgagctaaccatacccagccatgaatgagtcttaatgcatcaagctgagtgaaagaagccagtcttaaaaggttatatatatatatatatatatatatatatatatatatacacacacacacacacacacacacatatatatacatatatatacgtgtgtacacatatatacacgtatatacacatatatatacacatatatacatatatatccatttatatgacacgtatacatatatatccatttatatgacaactcttggaaagacaaaactataatgataaaaagatctgtggttgccatgagttagtggtgagaggatggataaaggaagaagttcttcagtgtgatggaactctttcatattctgatagtggtggtggtgcttgttacataaatctatatatatgttaaaattcatagaactgtataccaagaagtttattaatgtcagtaaaaatattcaacattttcagaggaaaaaagggagtaactgattacatattgaattattggaaaatacaggctcaaataaagccatggtttctcctactaataagataatttggtaagagataacactgttgatgaaaaagaaacctgcagttctacctccctgccattagttgaccaaaatgagaatgtctaacatagctacaaatttaaataattctctgcttgtttaaaacatagtctctaatagttcattacagtcattactgcctgttaatcaaggataacactagtatttgaattttgtaagtatgacagcaaggtaaagactgttacttaagccaataaattaccatatttcataaaaatctaatgattctgtgaacagactatgtagttcaatttttcttctaaaccctgtaactgcaatgtattttcactgatatttttaaagagttttcaaaggtacatttttttattgtggtaaaatatatattaaaaattgaccattttaaccatttttaagtgtacagttcagtggcattatgtatactcacactgttatgcaagtatcaaaaccacctccatctctagaacattttaacttttccatattcaaactgtgtaaccattacataataatcccatttccccttcctcctagcccctggtaacctctattctactttctgtctctaggaatttgactatactaggtacttactcggcacaatgcattaaagttttatccatgctatagcatatgtcagaattttatttctttttaaggaggaataatattccattctatgtatggaccacattttgttaatccatttgtccattcatggacatttggattgttttcaccttttggctatcaactgtgcattccttttgacattattgtcagccaccagttttttcctcactagtcagactcaagtcatattctgacactctttaggaatataggacatttcatttacaatagttaggtttaaacaggatgtattcatttgctctcacactactaataaagatgtacccaagactgggtaattatttaaaaaagaggtttaatggactcacagttccacatggctggtgaggcctcacaatcatggcagaaagtgaaggaggagcaaagacatgtcttatatggaggcaggcgagagagtgtgtgtgtaggggaactactctttataaaaccatcagatctcatgagacttattcactatcatgagaacagcacaggaaaaaccgcccctgtgattcaagtacctcccactgggtgcctcacacaacacacgaagattatgggagctacacttcaagatgagatttgggtagggacagagccaaaccatatcaggggacctttcaagtttggtcacaaggtctaattaattattttcatgcataggatctaaagagcaattgtatatttatcaacttatgtgttcaaatttggtcattagcttaacatatgtgtttgtatgcatgtcacatgcatatctgtgtgatgatacatagagctgtattatgcataatgttaaagctttattattgtctggttagagaagcagtcactatccagaaaaatggtttccaatgtgaagaagcatgttaaatttgacttcactgaattgaaaattttaagatgaaacaggagttgggttcctataagcggttagcgtgcaactagactccatcttttaacaaccaaagcagaacatctgggtgggtccaatgcattaacattttaaaaaaactttataggttttaatatgcagctagaattaggaacctctgagacaaaatgatcctgagttgggggagctaagagtaaacaagtgaaggtaattttaaaagccggttagggcctggagcatactgagatgaagggaagagaaatttagaattataaatagcaaaagatccactcaagctagaaaagattaagtatccttttagagttaagagtagaagaggcatcagttacaaggataattaatatctagattataaggatctgctattataaaacttatactagaacaaaagtcatgaaaatggtctgcggaagtcatgaggtgagaagaagataaacaggtaaatatttaagcagattatagagttctggaaatgtcatcaagtctcttgattgtgtatatttttgttccatttaaacacttgtcctgaggtttataagtgaaacatgatgtaatttatcatctaagtaaacatttatcttatacaccaaagcacggtgaatacacacacacaaacacacacacactcatacacacagacattttcattaacaagaactagtaccaactacagctcaggaaatatttgttgattaaatgaatcagtctgcttacagtatgcattttcttttgtgctgcagaagttgcaatacaaatgaaactaaaacttctgtgtgctgattacttttctcagtctgcttatctgagaattaaagaatttttaaaacaattttatgtattaatttgcaaacttctttaataatagatgttcattgtaactggtgaaacaataaaagctatttaaagaaaaaattaataatctttcctgattcctttttttgttcccaactctgtgaaataaccaatgtgaagaatatggtatgaattattttctatagctttcttcatgttcatataaacatacgcaacatatttattcataaatactcattaccctgaaaattatggtcattcttccaggttaacagctatagatataattcattcttttcctaatggctgcattatcttcaataacatggatgaatcatctgtccatatcatatgatatgcatgtagtccaattcaagaaatcagtatactttttttttttttttttacaaattttactaaaagtattactaaatttttacacaggatgctcaacaaacactgaagacctatctggtaccagctttggtgaccaagaaagaaaatcagtgaggtactcctggttttttgccctccagaaagtcactgactatcataggggagacataacagtaagttttttttttttttaatttgagagaaacttctcagagaatttatagtaacaaatgcttttaaagcaactatttaaaagaagtaatatatcactagcaattcattcttcattgtttccaatgcatgatcagtatttagtagcaacagaagacttccctatatgatgactcaaaaacaaatttccaaccactaagaactcagataaaggaccttactcttgagacctcaaagtgatttacatttccactagtacttctattgtaatatatgatatttataaactagccttattccatggaactctaaatatttaatgcttcacatatatcatttgacttttctgcatgtgtcattaagataggagaaagtgtcccctacagataaggaaaatgatgttaagacaaaactgacaacacctgaatcaagtctccagatagccccatactctttccttccaattatacttgctgccttgctagtggtaagcaatgataacgtagacagtattatgtcatcaattagagagtctcacttagcttgatataatcagtttttatttaaaaatgagagctttccatgcaaactgtttttctatcttctaaaaggcttgtgactaaaacttcactgacaagtttttcaggtgagatgagtgtaggttaactactgagcagccagagtctagtcaggcccctcacactttccagtgctacaagaagatgagcagatgtggggttagatgtggaacccaggttcatagctgtacctgccaaccctaacctagagaagggaagagaacactgatggtaaccatggcaacagtaacaatgctacacatctatcacttattgattatctaacaaagtcttaaaatatcaagtaatgtaagcaaagaacaattcagtgaaattttagcaaaggttaggcaaattttatatggtcaagatagtacatttgcaaacaagtagaagaccttgtcaaaaatctaaatcttctaatatccagtaactctcttgtctgagccaatttattttcctacatctttgaagacattttattaaaaaaggttataactgagaattcgacagtaatcagaagagtgatcttcattctgtattcagtgtctcttgaccccctgaaagaatctcagctcagcatggcttcctcccttttccagttgactcagagaacggtgctttcaaattgccttttgggatacatgaaggggtgcatttagagccaacctgaagtgtaacactctttattgttcctgagaaacgtgtgcccaattccctagaaatttactgtttcaaagagtcacaagctcctgattgcttctcatcagtcttgaagagattagataagcttcctccctcttacaaaagctttttcttcattcaaaattcctttgagaacaaaacattgaaccagaattggatttttaacaaaatattataagattgttgaaaacatttttttttctcctgaggagaccaaacaattcaaaagatatattaatgcacattctgatttagggctactagcaacatattgcaaagagtaaggtggtgccaaagaacaaagtcccttctgctaagcaggaaagatattttttaactgccttactttagaagatttcaatggactgctaagggctttcacacagataatctcagaagtcaaagctcaagaagtagggggaagaaacaactactggaggaccctaacaggtagcattgcttctaattaccgtaaaattgttatgtatactgatgccccacatcccattcccagactcagataattattctacagtaagagttggctttagaatacttgttcaagtgtgtcagtaatagaaaatgacctcttcagaaatgggggtgtttacatgcagtgctcctaaagttggcacacatggaaggtaattcagggttatgtttgcagtggcacccatcatcagcaatgtttcaacccccgtccatctctctgtcctggttttaccaagggattcacttcaaatgtattcctcactggtctttagaaaacagtgctagcaattcataagtatgtttgaattttcaaagtttttctttttctttttctttttttttttttttttgagatggagtcttgctttgttgcccaggctggagtgcaatggtgcgatctcagctcactgcaacctccgcctcctgggtttaagtgattctcctgcctcagcctcccaagtagctgggatttcaggaacctgccaccatccccagctaattttttttatattttttagtagagacagagtttcaccatgttggtcaggctggtctcgaattcctaacttcaagtgatccatacgcctcagcctcccaaagtgacgggattacaggcatgagccaccgtgcctggccccaaagttttgcattttgatagcagcaataaggctgagtaccttcataggcctttacctctgatcacactataaggctttaattaagttagtcttaagaagaaaaatgtacaccaaaccccaattattaaacattggaattattccttcttattggtctaataattacaattttttacttctcattcatttttcaaaggtttttttcagtagatctaggttattggaacgattatatgtgatatgatggggtattgggcacagacacagtaaatcaagatgatgcagaaatgaaagtctaatgctaaagatcttaccaatcttcccagatccccatttttcaaaggaggaaatgtatagaggacattacatttatttccagccattatgatataattataaagccaacctctcaacgcactctctctttttgggaagtctatgacagcaggtattacaattctactttgccagatgaggtgcgtaaaccatagaaaactaactagcatccaagagaagaacagacttggatgtgggtagaataataggaagaacacttacagtcagatatatcagagtatgaatgcaggctcaagcttttttccactaaaatgtatacagcaatgtaatctcactgagcctcagtttctgatactgtgaactaaagattatgacatcaatctacagtcaatgctgtgagaattaaatgtgaagagttttatggagagggcatctgctaaatgtaactatttttcttaccctcctaaattttttcagtcttttagacatttgggctattagagaactaatgacctctgtgaccacactagcttaggctataactaaatgcaacagatttaaaaacaccaagcaggagatagcacagagtttgaatcagtgaggtctaatagtaatacaaacctcacttactggctttgcaattttagatgctacttaatcgttctggggctcagttttttcattataaaatgggaatggttcctactttgctgggtagttgctgagtgtggtagcaaggattacagacaactctttatacagtatctggtatattaggtaaatggattgtaatatatattgttcagattttttattaattaaggtttgtacatagactcatctcctgcacttaatatttctttttctacacaagaccttgaaagggttatgataggggctttgatcacatattagctggtttggctgtggtaatttagctcctgagtattgggattacagtaccagcccctgccattgactatttaactatgacttggataggaattctaggcctgaattttgttcgtctccaaaatgaagaggttagaataaataattcctaagattccctgtcgctataacattttctggttccagggtctttttactgagctatagcagataaatcctcatatctttagagcttaagctacttctctatggtttaatttccacattccctctactctatttcttctttaattgcaaaaggggataatttccatcactttgcaaacaaaccaatatctctattctggcttagtggcataccatgttattaatgcatcatacttaaaaaaagcctggattgttcttcaatccagaaatccagtcatgttgtaggtagtaataatgagaataatgatgatttattttcaaggttttctatgcctccaggtgcccggtcattgcacatgataaaatacaccaaaattaaaaatgagattaaggtttaacagataaaaaatacattctaggaacaaaacacatttttggtatgcatctctacattacacaacagccacttaaaaataaacaaaaacaagaaatccgttaaccaacaacagaattttaataattattaactagaaagaaaataaaattaacttgaccttatcttagaaggttgtcagagatctactctgtttatgcaagtgagaaatatgttttgaattataagacctctatttcagaagtccaagctctcctcaaactcagaggtaaaccttcaggaaggatttaaaataaatgtatggattttgttagcatgtgtatattatttacctttgaattaattttgatcttgtcctattcttgagctatccttcaattggtatttttgtgtgtatctactatgtgctttcccactgcattcagaataaaattaaaattcctcactctggcatttctctgaccacacctccagccattctgctttgctcactttgctctggccactctgaagtccttttagttctttgaatacagaaagtctgattcaaagctttgcatttgaatacaggattttgtatatgcagtttctgtctggagctttctcccctcccatactccgttctctaccccaaattcttcacctggctgatattattttctgtccttcaatgttcaaatcaaaggacactctctctgagaattctgtcctgaacacccaaaggacagtataagagatttcccccactcaatgttgtcttgcatacataacactttatgtggaccacagcttgtaatgttgtaattatgtttgcacttattacatgtctaatttccttaggagactatcaatttcatgatgaaggtctaagggatcatttctatatttctactattaaatatagttgaataatgaatcaatgattctattgtggtagactcagtagggctaagaaatgttaattaaatatggactattcccttaaaattttgttttctagtaaaggaataaggcatacacataaagtgctataaaatatagaaagtaattcctgtctcaataaaagtgtagatgagtattgcattagtttcttagagctgttgtgacaagctaccacaagcttgttggcttataaataatacccaatatttattatctcacagttttggaggctacaagtccaaaatcaagttgtcagcagggtcactacaggtggtaagtaaatttgatagttaggggagagtggattgtttctgtccaggtcaaggaaagaaggattcatgaaattcataacattggaaatgaacttggtaggatgggttggatttgcatatgaaaaaattgaatgatggacattccagatgctggaacaatatgaataaaggtgagtaagagaactcggcctgagtttatagtacatacaacccggtaggtgacaattaactaagaaatgggatcagagttagattttaggatgtcatgtatattgattagggattgttatacacagaattattgaaagttttatctgaacaaaggcgacataatcttagtactcctatattaggaaagttaatggggcagcagtgtttaggataaactgatctccctgctccatctctttcaattaggagatttttgtaagcaagagaagataaaatcctgactggaacaggtatcaaagaaagagaataaatgagacttggccacttactggacatctaggatgtattaagaggaggaaagaatgatatattttgagtaaagatgtcctagagaattggagttagagaagctaggatagtcaaaagcaggatggtttttaagtagaagaataaattaagttttgatatgctgactcagagaaactagtgtgatttctagttgaagatttaaataaggatgttggaaatataggactaaagttctgaagacatatcaggactggagatataaatttctgagttatccatagtgaaataattgaagtcatgtaactctgagaagctgtgtcaagtcatgagaagagtatgaatgtggagtatgacagatgtgatcacatcctgtgtctactatttacctgttgtatatcctggggcaaattgcttaactccaccattttctcatatataaggaagaaaataattttatcccttaattaggattacatgagttaaatatttaaaagctctgtcatgtttaagctgcttttatattttggtgcataattctcataagaaatacacttattttgccatctagtatcttaaaaatatgtgatgtgctttaaaaaatatttattttcctgtgattctagtatatgtgatcttttaaactttcatgacctactaatgcgttgcaacccacactttggaaaactgatcctcccatacattatggttctcatccaattcctcctctagtcactgtccccaacaagcattctatgttgaaatcacaccaatactatcaatgttctcctgactttcatttattactccctcttcataggcttcttgctagtatcacattattccttcatggcctagaaaaaaatgataaccatttacttcctctgctattccatataatgttttgtctataagaaagatgcgattttcccagataaattatgaattccttaataacagaaaatatgtgttatttatctgtgtatcttggtaaaatattttgttataggaggcacagaacattaattcattattataaaggaaagggagaagaggtttgaagagagaactttgttgaacatctacatctaggaccctgctctggtatcaccatgtctcgattcctccttctctatatgccaaagcttccatggaatttttaaagggcagaactattgtctctttgtctttgaggcacaaagacttaaggccactaactttcagtacatggtggagagagggaagacctggatgggttaaaataaaggaagaaactagaaaatgtccagaatttagctttgggtaaaataacaggtttttaccgtagcctctttggattggtaaatgacagaatccaatgaaagcaatgtgaaacaaatgaccagagcaagtaattcattttaaaatattaaagcttatttctttttttttctgactctggaaaacttttctctgatggaaatgacccctggcaacagtgacattctgacaccatgcgtcgtacacacccttgggaagtttgaattccacaccactatggttctgttcagattactggtttcatcatgtctgtaagcccaattaaactactgaagttctaatggtcttatgtccactttgtaaatcatcataaagaatattaagtcaaccaaataaatttgcctctacaggactcgttgctcaaccaaaggcatgatactaggaacaaaattaaaaaacaaaaaaacaaaaaaaaacacacaaaaaaacctcttttgataacaaccaatgttttcaggatactcctttatatatgaatttgagattctgatgaaggggactacaattcaacaagtctcaaaaaatgagcccaaggcaatttgctcctcaggaaacattgcttagaccctgattgtagtggaaagattgaagcctcagattgtaaattcagatagactatcacgtctaggtctctaaggatgatctgcgatggtggtcaatatggtttgtgtaacctttgtgccctaccctgtgcctcaatttgcttatttaaaaatgaagtcactagactttgtttcttacatcctttcccactataatgtttggtgatgctctgcccttacatttgcctaaacttttcaatcttaaaatatataaaatgtttttataaaattcttttatgtccttaaatgttattgaacatgataacagtagaattcactaagcctaaatttcatcattttaatattgcctcagaggtcaagttttatgagagccttaatttgcatcaccagaagctcatttaataaaaatgaaagaatcccttttggaaataaattttaaaaactgatggtggggaagaggggcagataaatgtatgtaaaaaagaaaaaaaaacaacttagaaggtgtcaaatggttctgagttctaaagaatattgtggtcatattagtgttgaaaagttggtcctagctttttatgcactaaaagtacattctgctaatggttccttcccaaatccctggcctcttgacccaatacttattgtaccacttgtcccatttccctgaaacaaaatctataatatggcaagacgaactgaggtatcagagcatcatctaccctggaattgggcatatttatttgtggagttgattctagtgtgtgggatataaaacacacaacttaagtggaaaaatgctgaagaccatttcataggtgaaaaggatgtggtatgaatggtcaattctcactttggtcaggaaaaagaagtgtaaagtcaatgaggtaaggggctgggagatggatacctcgtatgatatgataagcagaaaggttgtgtttggcaaattcctttatcatcttcttcctgactgtcaaaaactgtattcaacctgtgtttacaataaatattctctgacagaatgaaccctggatttctgacttttaaaaagttttgaaattaaactaatagcagctatttcatgattacctattattgtgccaagggttagaaattacaaaaatgagtaagaaagagagagcccctgctcttagagaccttactgtctgtgggtttgaactgttgtagttatgacaacaataacaataactatcatttattcactcataccagccaggcaccatgctcagtgggcaacatacacaaagtgccaaagtctccttcatttcaccagatgcaatcacagtaaggtaaccttgctctgtccgtgcatcatcgcttaacaaaaatgaacttagcaggaattcagaccataggcagagacatataagcaactccagaactgtctactgtcaacacacaagaactacagtcaataaagagtgcaatgaactacagtgaaaatggaagcaattgtctgaatcacctttagtgtactctgttgactgggggctgtgacactctaaaaaccacgatacagtagactccacatctggcattccaacaatagaagggtaagtgttttaagactcttagcgaaagaacttgcaatacattaaactgtaaaactgaggaagacatcataagcttctggattttattaccaaaatgtacattttgatctaaaattaaaaataaaaacagattgactttccttgtagtatttcacaacctttgagtgcagcattaaaaatgcttttcttttttttcttcaccaactataagcttctgttttcttaccctgggcgtctgaatcttttatatgcttgggttctattcactgcctgttattcagacgttgaaatcccaaatgttaattgttcttccaagtacattgacaaaacagcagctaaataagggtagaccagactgtggtagactctgacatgcatttatggaacaatggggctctgagagacagccttgtagctcacgggaagacataagatgtgctattttgactgcttcgtagcagaatggggaacacacgcacacaagggaattatgcattttacttagttttgcccaaagtcctcaaggcaacagaatcttgtgatgtcatcatgaactttctttctctccatttccattgacacaaaggctaaaaatttctaatgacatcacaaaggaaaatgaaatctactttgattccaaaagaaatcttttaccttcagtgagactagtaaaaataaaataaaataaaataaaataaaataaaataaaataaaataaaaaagcaagaatctttccagacagggtgtgtgtcactgtgctcatgcacagtgggtgacaccctccctaatgaaattcaaaccagccaaaagaaaggattcacaatttaggttggataaaaaagacatactgaatattgagaccaacaactttttttttttaagaagaaaatcatttaaacatatatttcttcagggacattcaaatttttactcatgtctggttactatgttaccaatgtttttgtccttttttgggttggtcacagaaacacagaagaaggtacagaaagctttgacttacaggaatacagtgcagctcaatcttttgtttttaaggtgcagtgatttcagtctctaaatgtaacttcaggcagtctgaaaagaaacaggttaaaatctctttcagttataattggtatttcagatttaattaaaaattaaactttcataatgtttcaccatccaaagcaatgcattatcagtcaagcgtggcttttctttttttcttttttttttttttttctgttaaggaaaaaaaaaaaaaagaaaaaaccctcttcccagagtagttttttaatgaaaagaaaaggatctaaagaggagaaaaaaagcaattctgaaaaacaaaatacgcctccatgttaaggacttcataatgatatgactagaaactcaatgtttctgaattttagctatattctgattaaaaaaaaactcctaaacaatttctacagcctaaagattacagaaaatattaagttcagggaataaagaagaaaatctatgggtctgaatacacatattaaagggaaattatgacttcaaatggaattgtaagaaatgctagatctcctactttccagtgactgaattgctggtgaggtagatggtgaagaagggctaaataaacatatttaacaacacaaaatggccattgaaatgtactgtattatgggtttagcgtgccccatttcacatcatattgtacatcttgtcacatgcagccactgctgtttgaagcagcacaggaagaccaagagagtctgaacaacactccctggtttaagtaactgtaagcatgttgcttattttttaaatatgtacttataattccaaattaagtaacagtccaggcattaagagctccaagtatataataaatattaggcttaaaatattatactattttttgaatcatttctttcttcaaacaacaccatctataaataatagtattttttaaattaaaaaaatcacatcacacactagaattaaatcatccttacttttagctttgaaaaactgatacaatgggatttagaaaaatttagtttttaaaatataaaatgaggtaatataattcgctttcattcactttacagcgtggcagaatactttctatatatttataacactaaatgtcatatgtttacatccaatttcacattagtgcaaggtaatattttaatatttccccatatgagagcataatcacaaatcaccccttaaattgtactattattagaaagcatatgtagttcttacttgggattcctgttttctttttctcttgaaatgtatagaggaatattttgggtaattggtctatttgatgtacatagattttaagcgtaaacatgctcaggttcacagtaaattcactcatgaatgagattagatttaaaaaaaatcactgacattgactaactaaacttttccccctcctctcacatgcctgaattaggctaaaaatgaaccagcgtaaaggcagaaattatggaggcgtcaccagggacaactgaatgagaggaggggagtgcacattatttccttataaggcagcaaaatattcataaaagaaactgacaaaaataacttgtgctcagaaattatgagatataatataaatatattgaataacaataatctctgaaaaatgattcagaaatttaaaactgcccacctctggataaatctaattcaccaactggcattgttctactcaccaacaaaatatggttagcgaaacaaattcattctctagtttagacgtgaaaaggtgatagaaactaggctgaatatttacatataaacatataactaacaactagtaattcaattcattcagtcaggtttccttctcctcaatttgccagatgttgaatgaattgaactatcagctcaaaataattaaatcaattatatgaatagatggtcagtgtaccaattttcattccccccccatgccatttctccttctcctctttgatctttttcttctatttctgcttgtttcttctccactttcactttctttcttattcctttttccttcttttttttttttctcttggtgagggtaatgaggctcaaaaataacatcttgtatcctgttgagggaaacttggtcacaactatccttccagatgacaaactcattcttaaatgtctgtttcccaatccaaagaaaacagagcaattgaaaaaatagagactcaacatcacttacaactaccaacaccagccctcttaattcccatgctgtactactcatcacgaggagaactgaaatttatttacattatacctaacctcaaataggaccacaaataagactaataacaggaccattttgtggcactcaggcaaacggctgggcaaaacagatggatcttactttgcgccaggactcaaaaaatatagtcgccaactcactgttggcgactacatatcttggcccaaagatggacctggaagtaggaccagttgtctttgatatgaatagtgctcctcttcttatctcctcatggaacaaatcagtaactctgtcactatatagtggggttatcaggtagaattgcttaaaagactggtcatcaaggatgtaaaatattctgagggaatgtcaggtgagatgaaggaacagaaagtcaggacaaataccttatttttggcacttttgtctattttcaactttctgtttttttttttttttttaattcaaattcactactgtacactgaacccacctttaaaatagatttcagagtatgtgtcatcaataagaaaacttgtttctcacatttcaggttccaaaatctgttaaaattttaagtcacatagatcaatctcagtcattattaaaattgaccaccagtgtcagacttctttaattggaagaaaactatgtaaggctttatagattacagtcaacatccaatgatgcactgagcaacagctccgtaatcaatgcaatatacaaaatccggaagaatgcttctctggcagagaccctttagcaaaagagttgtacattctgcactccttaaagattctgaatggctttccagagaagtagcaaatgcattatattgcagtaacctatcttgtaagtcacaaggccacaaacaaagcctctagtcaataaaaaaacaaaacaaaacaaaacctgaaggggggtgagaactacagatcttaccattgactacgaacaaagggctgcttctgaccacattctactttctaaaatcctcacacagaaggagttttagatatcaccaggtcacagaacttcaaggaaagaacaacaaagcattccagcttaggaggtctatgttaattcaggcacttctcttattgctcttccaactattcagtactgactgtatcttgctcagattgcttttgagagttcactcatctctctataatttatttattcagacattgtgcagatttgatttttaagagacagccctgtttgtggtcagcatagaaggctaattataatactttaattatttattttagtatttttttctttccactatttaaaaactttttattataaaatatttcaaatatatgagagagggcagaatacagaaaaatgaactctccagtacccatcacccatagtcaattgtttttccaattatactttcacctactttttcttccaccagagcatctgaaagacaatcccagatagcttattattttatgcatgaatactttactatgtgttactgaaagatgacaatcataactaatatcattccacatcaaaaataatagtaattctttaatgtcattaaatatcctgtccatgttaaatgattgacttttaaatggtcttttctttttataactggttagtttgaatcaggatctaaataagatgtacacattatattcaaacgataattatcctttaatctataaattctccatttgctttttaaaattttaactttgtattttggaacaattttagaattatggaaaagttgcaatgatagtacagagagtacccatatttccttcactagtttttcctaatgttactatcttacataaccatggtaaatttgacaaaattaagaaattaatattgacacaatactattaactaaactacagactttattcagatgtcaccaatttttccattaatatgttttttctgttccaaaaatccaatccaggataccatactgcattttaattgccatgtctcctcagtctcttctgatctgtgataacttcttggtcattccatgtttttcatgactgataattgtgaagactagtggtcagatattttgtgaaaccttttacaactttgatttgtccaatcccgtaactagattcggattataggttttagagaagaatacaaaagaggtgatgtgcccttcttataacatcaaaggtatatgatatctcggggtatgttaaccttggtcgcttgcttaggagaatgtctgccaggtttctctatacttagttttaataaacataacagtttattgagatataacttatataacatacaatccactcttgttatgtgtataactcaatgacattaagtaaatttagagttgtataaccatcacctcaattcatttttagaatatttttgtcaccctacaaagatccttcatacccttagggagtcaatccctagacccagacaacaaatattttctctctctataaatttgccctttttggatatttttattaatgcaatcaaataatatgtgatctctttcatgtagctttttcacttatcataattcatttttaagattcttttatgttgtggcatgtagcagtagtctattcccttttactgatgaatactattccactgcatggatataacaccacattttatttatccatgcatcagccaatggacatctgaattgtttccagttttttactgttacgaataatgctgccatgaacattcacataaaatacgtctctgtgtggacatattttttttcctcttagatacctcaaagtggtattgctggatcataagggtaagtttattttaacttttaagaaacttccaaaccactttccaaagtgactatactcttacatctcccctggtaatataggaggcttctaatttgtctttatcttccaacacttgttactatctgtctttattacagccattctagcgggtgtgaagtagtcttttacggttttaatttacttttccctggaaataataatgttgaccatgttttcaagtgcttattaggcatgacttcatcttctttggtgaataacttcggtgaattgtcaaatattttgcccagtttttagctgggttgcttgtctttttattattgaagaattctttatatattatgcgtaaaaattcttatcagattatgatttgcaaatcgcaatcttgcaaatattttcgcctgtctttggtttgtcatttcatttctttaatgggtcttttgaagtgcaaaagttttaaattttgttgacatcctaattaccaaggattttattgaatcaagcttttggtgtgatagctaagaactttttctaacccaaagtcatgaagattttctcctgttttcttctagaaattttataattttagctctcacatttaggcccatgattaaatttttgtgcaggatatgaaataagaactaaaatatgttttttacagtcctaggttcgtgaatattcatttatatcgcatataatcctagcatcaattacagagcactgcttattgaaaagactatcccttcccatgacaaattgccttggcacctttgtcaaatttaattgatcaaaaatatgatgaattttctgaactttcaattccattccattgatctgtatgccaatatcatactctataaagtaagttttaaaaccagaaattgtacgttatctaattttgttttcctttttcaaaagtattttcactattttggatcttttgcatattcgtgtaaattttaggattagcttgtcaatttctgtaaaaacgcctttattctttttgacaggattgtgaattgaactgttttcttaatttcattgtttgttgctagtatacagaaatataattgatttctgtacaatatctcttcttatattcagttaacttgttgaattcctttattagttcgtgtgtgtggtgggggaggtgtatgtacattgcttagaattttctatgtacaagattatattgccggcaaataaatagttttactttttaatttccaatctgtatgccactgattgtttctttctgctggtctgtctaacccttctctttcccttcccctccccctcccctgcagctgctgctgcttcttttttttttcctctaatttgcttctctctctctttcttacatgtatttatcattctgcactggattgaatctcctgtacaatgttgaacagaagacataagaactgacaaccttgcctcttttccgatcctaggagtgtatcggtcaggttttcatcattacatacattataagttcttcatagatgccctttgtcaggttacagaagttctcttctattccttttgttgaaagattatatcacaaatggatactggattttctcaaatgtttctgtacatctattgaaatggtcatgtgttttctcttttattctattaatatgctatattgcattaattaattattggatgttaagtgaaactcacattcctgggataaatcctctgtggtcagcactgtataatgcttttctactttgccacatttggtttgtgaatattttgttgagttttggtgtctatattcatgagggaatctggtctgcagttttctttcattgtgatgtctttgtctggctttgctctcagtgtaatattgtacaaataattgaaagatgacctttcttgctctatttctagaaaagtttgtgaaatactggtattggatagaattcaccagtggagtcatctacatctaggattttctcctaactataaattgtataaattgtatgtctttttattacgagtctgttcatattttctatttcctcttgagtcagttttggtaatttgcgcatttctaagatagtccattttatccagctaattgctaacaattgtccagttgctaacaattgtctaattgttaagcaatgacaattgaggtcaaccaatgatcagtcacaggttgtatttctaactatcaagcaatgaaaaggattatgaggttataatatttgttcatagtatagtatgagatcaggaatgagagagaaggtatcaccaccaaccccatagaaatgagaatgattatgaggttatactatttgtttataatatagtattaactataactatacctcataatccttttcatttctgtggggttggtggtgataccttctctctgattcctcattttggtaatctgtcatcttctctcctttttccttgatcagtctagcaaaagaaaaactaagttttggttgatcttttcaaaaaactaagttttggtttcattaattttctctattattttcattatctatttcattgatttctgttcttatctttgttatatccttccttctgttcaaacagaatttagttttatgtttatatcatgtctatacttacctaaataatgacgtgatgaggtccttttgtttaggtgaattttagatacatttttatcatttcatttccacttaaaggatttccttcagtatttctggtaaggcaggtctactagcaacaaattgtctcagtctttgtttatttgggatatctttattttatatttatttttgaagaacaattttgctaaatataaaattcctaaatgacattttccctttttttccttcagcacactgaatacgtcatccctctacctcctggctttgtttctaatgagaagtaagctgttaatcgtagtgttgttttcctgtatgtaacagtcttttttttcttgttactgtcaaaattttctctttttcattcaaaagtttgactataatgtgtctatgtacagattttttttgtgtttatccaacatggagtttttgtgcttctcaaatgtgtagattaatgttattcatcacatttgggaagtttttggctattatttcttcaaatatttttgagccctttctttctttcctcctcttctctaccattacacatatgttagtatgcttgatggtctctcacaggtctccgaagctctgctcattttttcattgttcttttctcttcaaattagaccatttctattaattgatcttcaatctcattgtgtctttattctgccatcttaaatattctgttgagattctcttgcaattttttaatttccattataatattttttaactccagaatttttgttccttttaaaataacacttatgtttatattgatactctctatttaaagggtaattatagtaatactttaattatttaacatgatttcctattattttgaacatatttataatagtgctttcaactctttgtttgctaagtttaacatctgctatctccacttcaacccaaatataatttctttttttttcttcagacactttcttttaaccacttcttaaattgggtatgagtcacactcctgtttattacatgtctcatttttttcttgaaaattgacattttatatagcatattacagcaactctggcttctgacttttccctgttgagggttgttgctgttattgctgtgtttgtttatttaggacttgcctaacataactctgtgcagcctctcttccccatgctgtgccgctgctgatgtttctgctcagtttgtgtaatttccattttcgtttttgagctgggactttcccctgtgttaacacagtttagtggtcagccaacgatcagtcacaggttgtacttaaacacctagggccactatgctaacgcctctaattgatatatacgtgtgtgtgggttgtagaatgcactcaaagttcaggcagtttacaagtgtttttttgatttttactttccatttgttctctcttatcttctctctgtgtgtccaaagccttaggtcttccccagagtatgtgtgcagcctttcagacctctaggaatatgtggtagcttaccaaagttcactatgatagtatccttttccaattctccctgctaaatttctggccaatctgccagttcttttctactctgaattgtaacttcaggctacatatgatgtttattctccctgcttgtttgcccctgagattgtcactgttttgaccacacctaagggcatggggtttttctatgttctgctccatcaaattatcgaatcaccccctttcagcagtgaagttgtgggttttcatgacttgtcctgccctggcagaactactgatacaatggaactgtggggacggataataggaggaagcactcccggctaaaacactgtgggctcctaactgtgctagttgtcccaacataacttttaatttggccactttcactcccaaaagtatccagcttctgtgatatgatttatgaccttttaatctatagtgggcataaacgacttatgccatatgccatttcttcagcgaatgaccactgcctaattcttttcttagtaatgcaggaatcaggggcctagctgcaggtatccatgcatgtggggtggcgggggggaagtctaactgccattgaatgaacgttttcataatggttacatgtgtatagaaaatcttcaactgcccctcctactacatctctagaaagtttaaaggtttgggggggattaagaatttctagggaagtgtatgggatatagggataaggttaccaaaattctcccatgggagataaatagttttgcctcactctatagagtttggagaaaccactcagcgagaaggactagaattactttggttaataatgagttgctatgaactttggagctggactaacctattctaagcaattgtaaagaatatgtcatttagacttaatcttatacaaaacaataatagctcagagatctaagcaggtccaaatacttacttggatcaggttagtatttgccagcttattttctcacagattcctgggctcactcaggttatacttccttgggaacacacaaagggaataagctccttttggaactcaaataacttgtaaatcagaaagttcccatatggatatagagaataatatttactatataataatttttcctttacatgatgatccacaataaagttcccttgagaatacacttccctagagcatttaaattatgaacggatttacaaaataactcctatcacatgaaaagagataaacatatagtatctgcttctaggaattatctaaactcattttccttcagagacttaaatagatgaaaaaaatcagcaaactttgtttaggaaaaattcagaatgtataaagcattaattgtgaatatcttactgatatctttggatcaacataatacttcacttttacaacatgttgaggaaatcaaagtattcaccaaacttcatctcattaaagtgtcataacctttaatctaggaacccgtaatagtaaagattactgtttctgtctggaaaacaagaaatctaatccatgaaacaaaatcctgaaacatcacatacattgcttaaagatgtaagtctgaggatggagaatgtgatggaactccgtcaccttgttgtataagtgtgtccggaattggtgggttcttggtctcactgacttcaagaatgaagccgcggaccctcccggtgagtgttacagttcttaaaggcggcgtctccgcagtttgttccttctgatgttcggatgtgttcggagtttctgccttctggtgggtttgtggtctcgctggctcaggagtgaagctgcagacctttgcggtgagtgttacagctcataaaggcagtgtggacccaaagagtgagcagtagcaagatttattgcaaagagtgaaagaacaaagcttccacagtgtggaagtggaccccagccggttgccactgctggctccggcagcctgctttcattctcttatctggcgccacccacatcctgctgattggtagagctgagtggtctgttttgacagggtgctgattggtgcgtttacaatccctgagctagacacaaaggttctccacatccccaccagattagctggatacagagtgtccacacaaaggttctccaagtccccaccagagtagctagatacagagtgtcgactggtgcattcacaaaccctgagctagacacagggtgctgattggtgtgtttacaaaccttgagctagatacagagtgccgattggtgtatttacaatccctgagctagacatagtttctccaagtccccaccagagtagccagatatagagtgtcgattggtgtacttacaatcccttagctagacataaaggctctccacgtccccaccagacttaggagcccagctggcttcacccagtggatcccgcacccgggctgcaggtggagctgcctgccagtccgtcgccgtgggcccgcactcctcagcccttgggtggtcgatgggactgggcgccgtggagcagagggcggtgctcctaggggaggctcgggccgcacaggagcccacgtaggtcgggggaggctcaggcatggcgggctgcaggtcccgagccctgccccgcgggaaggcagctaaggcccggcgagaaattgagcacagcagctgctggcccaggtgctaagcccctcactgcccggggccggtggggcaggccggccgctccgagtgcggggtccgtctagcccacgcccacccgggactcgcgcttgcccgcaagcaccgcgcgcagccccggttcccgcccgcacctctccctccacacctcctcgcaagctgagggagccggctccggccttggccagcccagaaaggggctctcacagtgcagcggcgggccgaagggctcctaaagtgccgccaaagtgggagcccaggcagaggaggcgcccagagcagccaggactgtgaggactgccagcacgctgtcacctcttataaggttatcaatagggcaatatccaggctacaatgaaaaagaaacttgaagtctcgaacacctattgtgtatacattagagtggattcaaaataaatatttaaacagatttctgttcctgtggaatggtatttttccagcaaacctctccagcgattgtttttattaggctttgcaatttctataaaaggatatcaaccctgtcccaacttcattactatttctgctattaattaacaataaaaaaaataggctaggcatggtggctcacatctgtaatcctagcattttgcaaggctgagatgggtagatcacttgagtccaggagtttgagaccagcctgggcaacacagaaaaatcctgtctgtacagaaaatgcaaaaattagctgcgcatggtggcgcatacctgtagtcccagctacttgggaggctgaggcaggaggatagcttgagcctgggaggcggaggttgcagtgagtcaagatggcaccactgcactccagcctgggtgacagagtgaaaccccatctcaaataataacaataacaaaaaatagttgtatttcaagtaatataatctagataatctaatataatataatctagataatctagaattcactgtcattcaatgaattatatctgtgtgaagtgttctctatttggtccaaatcttttaaaaatgggaatactaaagttcacagtaataagatgttgtcagtctacattgaggactacaaagaagcatttctataaaatatcctttgttgctaatgaaagttaatatttatcttgatatttacattataatacagtgatccctatacatactgaagagcatcctagaaaattgatttttcttagtataagcattgtatttctttaaaatatataatcagagcccaatctgtaaatgtaggtaagatcctttataggatgctttttaaatgtaggtcaaattcttgcctccttctcatgtttttccactgtttacccattttattttttatttacttaatttatattatatatttcacttactgtcatttatatttatataaatatatttatacataaatatatttatattgtacatgtatgtatcatttaagctatctcaatttctttttgtaacaaagagatatctatctgtctctactgtatatttgtctatctacccttccatgtaacaattcatctaaatttactatatgataccccaacatttcagatgcaatctgaaaatagcaaccttagatcctctataaactcatctatgtttttgtggtgactttagttttcttctaccttcgaagctattcaaatcagaatagcctcaaatctgccttaaacttgtctgagacaaagtaacatatttgtatcatcagagctcagtattaacttaaagcttaactaaccacctctttgctaagtcacctgaagatgattcttgcctttctgtgcacgaataaaataatttgggacctatggaacaacaccaaccattttcaaataactaataaggcatataacatagagcagacacaactgattatatagtttgtaccctgtccaaggcacctagtccaggagtgtgtttcactcaataacccacgttccctagcccaagctgcatctgcttgagcaaagggtttcttttaataatttgcacaaaggtgtccgaacaggcagcttttttctaagttgtattgaaactccatatgagataagaaaggccctctataacatgtttctatagtacttctaacagaatataattaattgtattaatattagctggctctctagctgttacatgtaacataaatattcaggtaacttcctagtaatgactaacctcatgagcttaggtctccatgacttgcactaaagaatgctttaaaaatagaatgttaacaagttcggagacatggattatttgtacaataaaatacttttcttttaaatttagcttctggctcccattccttcaggcagattttatatattagtagttaagtcttaatgaattatctacaggtaggctatacataacacatttttacattaacttttcgtgactatgacatgaatacatgcccattgcaaaaacaaaataaaacagtacactgaaaatatagaaaatatgaggaaagattacgagcatcaatagtctgatgacacagagacaataaaccactactggaccttcaggatttcattccaacgtgacacattttaatcccaatttggcttacccattttcccctgcacacaacgagtagcctcctatttttactatttggtattgtgcttaagcaacggaaatatttcaagtatttctatagcaattgttttctataaaattaatttagtaattgatcaagtactatcatatttaatagccctgcaattgatcattattcatgatactactcattgttattgcttattacttcatgaatttggttttattcaatcatgtcatatggagattttatacacacacacaaaacacgcacacgcacacacgaccggctactacataaatattaaaccatttctccgaaataatatggaggttagaagtagcttctagatgaacaaaatgaaatggcaaatttgatgcttaaaagtcaaaaatttcatatcaatgccaaagatacattattttagataacactctttttctttatttttatttttactatctttgctacaacactacaacattaatatgaagaactgagagtcagctacgcctataaaggtaaagtgccataaaagccccaatgcatctctctcaagagtctaatcttattctatctgaggagctatcctctttctgtgaactctgtcatgtagaattacatcatctcccatggctcagattatctccaatttataaaatgctttaacaaaaactgttacaaagtgggctctgttatatattcatataacttcctcttcactttggttaatacggaaatacacaatacatcaatatgtttcattaaaacgattgttttgatatagtaataagctgggcaaatagaggaagtatgctgggtgcaatttatttacattttaataagacctcaaacaaatgataccacacaggaagctcagaattaggttaaggagaaatggtggctaaaaaatgccttgaagtttggaagctgtaagtattatctaatcaatagtattacttttgaattaagatagaataaccattccacagggacaggtattgtggtctgtgacaaacattattcaatgcagacattaaaaatttaggggagatagaaattttcaaaatttgataaaattttaagactaaaccttagaatatatgccaaatgctaaagtttaaaatgaatgggcctatgaaataaaaatctcatgaaagcccaaagtatgggagttttcttccttaatataccaaagcttactgctaaaatccccatttaatagagatgataacttcgccattcacattttgggtttctcctactatgcatgttaactctttgtgaatagttctaaaaatcaagacaagtatgtactttaatcaaataggagattcagaaagcaatgatttcagtctacaattatagtagcctgcactattcctatttccaaactctgagcaggttcacctttgtttgagacaaattatcactgataatatcttacagattaatgtgcatgacatttgtctatccagtgtagtttccaagacaataaaaaaaattgcagaagtaaatatattatttaagctgcaagtgaagaaacaattataaaagtacaataatgataggaaaagcatgaagaggacagggtgaggtaaatatacaaaaggaatcttgtaagaactgacacatttgctaaaagaacaagaatatgactccgtgtgtgtgtgtataaatctctctctatattaagtctatatgaaatatatttatacaacttatacacacacacacacacacacacacacacacacacacacataataaattgggcgtggtggcttacgcctgtaatcccagcactttgggaggctgaggtgggtggatcacctgaggtcaggagtttaagaccagcctgaccaacatggagaaaccccgtctctactaaaaatacaaaattagccaggcatggtggcacatgcctgtaatccgagctactcaggaagctgaggcaggagaatcacttgaacctgggaggcggaggttgcggtgagctgagatcacactattgcactatagcctgggcaaaaagagagaaactctgtctcaaaaataaataaataaataaataaataaataaataaataaataaatatctctctatatatacacacatgcagaggcatacatatatgcctctataaaaataaatatttcattaggagttttgcaatttccttatttgtatctatccatgaactagaaagtaagttccttgaaagtatgacttatgttttctgtgttgtaattcataataactagcatgatactgagcagaaaattggttctcaataaatatttgtgtgaaatacaaaaaatctaatttcattcatgcacactatgtaaaagaacaaaattaaagaattcccaaaaataagacaaatgataccattacatggggaaagcaagttagattatgctacactacactaagccaataaaattaataccaaaaaaacccttcaagtgaaaataaatctatgtaaatacatgctgaaatcctcagatgattcagactccagagaaatgaaaccccaatgacagcatcatgaaaatgagttgccccaatatcacatatcgtttttgtcatactctacaagaagtggtcaggtgtgattagaaattccaatttcctaatcttacagaatataaacaatctatattacataagtctatgaattttctgaggcattataaacttttatggacattttttattagaatctgaacacaatggtgtttcaatataaaaactcataatttcaattgtgaatcaccattttacatttaaacaattttaaaaattcacattgtgacatgttataccattaggttattaaaaaaactctgaaagttttcttaataagatcataaagttttttctagttatgcaagagcaatttgatagtggaaaatcaattatgctaagtcctttgctgaactgtcacatttcaaattatcctataatgttttaaagggaaagggctatgcatcttaatcccaatgtctagtgaacaatttctggcatatagtaagtgctaaataaaatgtatgatgaattaatttgagttgaaaaatacatctcaagaaaagtctatgtccatgagttacaattggacaatatttaccagaaaaaaaagattaataaaagtcaacgtccattcctaataatcaaataaggattcagaaaatagtatgttaatccactttaccaatatatcaaataatatctgtcttaaatcaacaaccaatatctgccttaaatatgaaaaaaaactagagataataccacataataaaaaacaagaaatatgccctctaccacaacgattacttaactgttttggaaattatagtcaatgaaataggatattaaacaggaataagaaaggaaatagacagtcatctttgttaggagataatttaataactttgaaaccccaaaagaacttaaaagaaattattaaaactattaagagagttgaataaaataactagataataaatacagatagtccccaacttacagtggttcagcttaagattttccagttttacagtgggtttatcagaatggaaccccacataagttgaggatcatgtggattataaataggaagtggcttttctaccaaagaattataaatgaaatataggcaattaaggacactaacaagaacatagcatgcctatacctaaatatatgaaggaatttggggatctatatgaataaaaagatacaatctatttatgtatgaaaacatactatgcttctgaatgggaagactgaatattgcaaagatactaatactgatttataggtttaatacaattccaacaaatattccaatgaaacatttttatgaactcaacaaactaaacaaatcctgactagtaagtaggtgacaaaagccaaagcatttttgaaaaaagaaagataaggaaggattttacctaaaagatacacaaacttattttgaagctctaatggaagcaatatagaaccggtgaaagaactgaaaaagcagatagtccagaaatagatcctaatgttgataaaaattagtaggcaatcaagatgatgtcaaaatcagtggggaaatgattctggaacaattgattaaccattaagaacaaaagtaagtaagatgtttacatcataacatgctaaaataaattctgggagaaacacaattaaaaatataaaacagaaccatgatcatactagaaaaaatggtgaatatttactaaatttcaagctatttaaaaaagaagataaaagtaatgaacatagtcacagagaaaaaaatacacaagaaattgaccatacaaatatttaacattttctcacataaaatcttacaaatcagtaaaactacatgagtaaagaccacaagcaaacaatttataaaaataagaaaacaatgacaaacatgtaaaaaacattctagttccttattaaatcactgcaaattaaaactatgtaaactagttattttgcctgcaatttgtcatatatttatataatgctgctattcaaaacagttaagaatgtagttagaaaagcacttttacatacaattggagaagaattctcaaaggaaccttgagaattttacatcctctagcccagaaatcaactttctaaggatgtatgctaaaaacataatccaagatgcagataaaaatttatatataaaaatgatcctcagagtaggagaaataatagtggaaaatgacctaaatgtcaaacatgaaggagttaattaaaattttttggtacataattaagatataatattacacagctaatgaaaatgagtattttatgactcagaattaataaaattaatgctaagtgaagagatcactatacagactatacaatccaaaatgttgtttagaaatatgcaaacaaacacatatatataaacacctgtacactttagaaacacccatacacttggaaagaggcagagcaaatacttagaattgtttatccatgattggtggtgtcaagtgatttaaatttattcgttatatatattttctattttgacacatcctttcaacaagtgtacattaccttttaatctggaaaaaaaagttattttaagcctaaaatgaatttatgtgggttagaaattcacttaagggaaaaaaatcagataccgataaaaatcactttcatatacatgtagaattactgtgctctttaatctgtgaatctccatacttttgtgcataaagaacatctattgagatattgagatacttgacttttttttagtgctgaagaacacaataattttcctgaattaaaacccaaagaaaataaagtcactcataaataccatatttgactacagcattcacccaatgctctgatggcctttcccgttgttgacttattgataaaatttacctacattgctaatattaataattgttttggtaccaatttcaggaataatcaatctgagaatgtttacttggcccatttagacaataccaaggaaaacacccccaagtaactgtaaccagcatagtgaacagtgtatttgcgttttcacatttcttttccatggaataccaaccttgcctagtattttgcgaataacaatggatggaacttggattttcaacagtgcttaaaaaatagctgccaaagtcaagacatgtaataaccttctaagtaagtttgctggctccatattgtgtttgaaggcacaccccctccaaacgtctgcagtcaccatctgctactcaactgcagaataatgcactgaagtctggtgttgtttggcatgggcaaagacagccaatgtccaactccattcagacatgtgcaccatatcaggaaccttatgacacagtcctcaacatcaatgcagcactttcaagccctgctgcacatcaatcaagtatgtatgacagtcaagctgatagataaaatctaagccaactctaaatacctactgtgcatggatctctctagtttgcctgcagctcaccttctattaagatgatagctttggcctagtcttccatgccaaaataagtgcatggagtcactctggcaagaagaagcgtctacatcaatgtcaacaaacaagttccttgcgcccgaccctaccatctgtcctcctgcttcccacctaccgtactttatgtggaccttgatgaatgagattctaatagtccaagactctagtttagccagcctttgcagatggggtcaacatgactgccctctggccaaatacccagggtgacatagctgatgggttacctggaaagtgcctttttgcaaatttaatgtcagaaataaagcaaatgaaggcgttcctacaggttctgagtttcgggtttatggaaaaaagtgatgcattcaatgcttaaagtgaagataatttttcttttaaattatttgaaaatcttataatgctaaagcattgataaattccatttcaacactacgggtaagggaaataaaatgaatgaataaaagtaaaactggggctattctaatgtatttacaaagtaggtttgagagaaagacttgaaaaaaatctcagaaatatgtagaaataagacttgatagtgtaacattaatatagaagcagattatttcattctgcgttagatgcaacaatattagagcatattgcacatgctaaatggggaataatagatttcatacctattctacagaagttgtatggcacttgcagatttcaaggtagagcagtaaaatttaatataatcttaagtatgagatataaatagtttctggaaaaatctaattgtttttgccttaaaaagatattacatgaaatatgataaatcagtattgtcataaaagtagtaaataaaattattttgttttttgaacatgttgacaaaccatttcaattaggtcattaaaaaaacacttaaaatggagcctgagggcatatgaaacaaacagaaatttcaggaaatgccgctagttccaatccaactcaatttaataggatgatacaatgataagaccttatttttccttcaaggaaagctaaatgtatttctagaatggtctctggacacatcaaaaatagaacaagcaaaaacaaaacaaacattctacctaggaaacaacatcatctgaaactctagacaatttaagtaataataagaaagtgaatcttcaccaaatgagaaaatgaatgtgaaaatatgttacatactataaagcaccatacacagaattattcagagcatctattaaagtgctttgtacatagtaagcatttactaaatgtttgtagaattgactagaatttaattgaaaagagaagtataatgagacttctacaagtagaatcagatccttttaataccatgggaaaaagtttcagtcaaattatatgactaggtacatccgttgtctttgatgttatgaatcaagatgagatcctattatatcaaaagaaaaaatattgttgaatttctctttggagaaatcacagtaaaatgaaaaggatgattatttttaatttctaaatatctccaaattttatagcattcttcggtcaactaagataatgctatagaaatcctacataaaacttgaacttacaatgtcctggcctaatcatctggctaatctctttgagttttcctgaaatatgttcacatcccattttctatgggaattctcccactgattaacacagagaatgagaatttggcctgtgctctataggcaccattgaaatgtggccacctgaggcatgtagggagggcatccagctggcacaccacatgttgccctggagtagtgtacaatgagagggatattttggctaagaatacctggatgatctctataaaggtcctgattatgaaaaggacttcagcattatcattgtctcatgggcataatatgagccagggaaacttctgtttctaagttcatatattttccaaagaaaggacttataagaatataagaaaaaatcaaagaactctatgaaagagaaacactgggccattgatactagattttatgtactatccatatcactagaagaaacttttttgagagctccatgcattttaaaacttatgctaaagcacactatagacttgaccatcaaataaaacataatgaaatctgtaaaataaaggatgcaaaaacatagcgtgaaaatttatgcctgcagtgcagttgttgtactatattttataaaaatcaattaagttcacatactactcacttaagaaatatctgctgattttatttttattttacgcaacttgtgaggaagaaaatccatgcatttgaactgtagtgccaataaaacaattttgtcaattttgagtctatttttttcaaaacaccatacgtgattaaaacacataatgcactagtatttttgccaaattttgtttttaaaccaaagctgtttttgaattacataagcacaaaatcagaatttcaaaaccagcaaacatatttaggggtgaattttaaaataagcccacttgattcattgttagacaaactttgagtgccagggacatttttgtgaaattccactggggtaaatagggtagctaggaaacgctcctcaaagtgaaaaataagtatatgcattattttcaataagttttgtttagcattttcaccctcatactaagtggttctggtgatatttacaatacaacatgagcataaatcttaaggaatttatgatgtcatcaaatgctaagagacaattacagctgggttttacatttgtgtttatatgttattttgcatatagatcccaaaaaccaatgaagagaaactttgatacaaaacatatcctgaaactaaaagacagcttctatctatcaatataaccagttgatagtatttctaagacagagtttgacagtaagtgaaacaaacaaacataatgttttaaatatgccacttcagccactccagctgtcactcaagaggctttttttaatatcattaattcaatgccacacaaacaggaattcggtctttccaataaattttggtgacaacttgttggcagaaaggaaactaatatatatgtggaaacttttattttgtcatcatgtatgtttgtttgaacttgcttaaaatattgtaattgtgggcctaatttacaccttttttcctaaaagctcaaacaaatcacaatgatcacagtgtccctaagactaatgagtcccaatttataccacagaaaatagaagctcagagagctaaagagtactggcagaatattatactgcaagaatagcaatatagcaagtatactcacttgaaatcctaataaaaccataaaaactaccactttgtatttttcattagcttatatttttacttaatgcaaaatattttgcagaaaagttttctagctagctttattgctagtaagagaataacttttattaattgaattaatttttgtaatttgtgaccaatgaggtttgactcacatcgcacattttctttaggaactcagatacttcatagatcttaataccctgatgaaaatttaagtcctaaaaggccaggaaatactgagattcaagttggctcctctaccatctttactgacagaaattcagagtgccaaaagtcagcactgctggttgctgatcatcatatctaaacattgattcttctaattgtgtattttgagacttgcttgattttagaattacaggtggaaagtcacttctctttgatataaattgcatgcaataaagaaggaggcagtcctacacaataaatatgtaaggaatggttttccacctctgcatgctgcagaaaatcccactgagttaagtagggttctaccaaggccacttaaacatattagcctattatgctccacatttctttattgttctcaaaaagctaatgaaatgttccagtgtaatgttaatgctggagtacttttaaaggcattttagaagtgatgtttctctcataactccagaagggggttccacttcctaaaaacatttaggaggccatggggagaccatgcagcctctttactcagactgtttagactcatagctggagaagaaaatccttaaagataatcacttaagagtttcggtgtgagctatagcatcatcgcaaagcgacaggaattaaaaggcagtgtaccgtactactgaatagataggtttaaaatactgtgtactgtctattcacagataacattgatttacgttggtaaatctattggttcagcacatcagtgcagtattaaggaatcaattgtttctccagagtcaattatttttagaaaaataaggaaatgtgacctatcactgaaagtcagtatgtagaattaaacttggccagttttcttcctcgctggggtcttaattttttcaactgtaagataaatgaatcagacttgtcagtatctatgatcacttctagcattaaagttttctagttttaagattctaaataccaacactgtatgttgaggaatagcaaagtaggaaaagaactgggaataaaactatcactgaattattaactttccaacaatcaaaattctgtaattttgcctttagttgccataaacaaccacctcaccttctgaatatcaacaataatatgaatgaaggaaaggttgtatactaaggtcacaggtggtatggttgagattaaagccaagactgagagtatagtaatgaattgagaaatgaatcatacacttttgacctaatatgtaatatgtcttcccaaatcgtcatttttatacattcattttcaatggaaaacaacaacttgaatatcttagaggttttttcccccaagaaagacatcaggctgtaatctccccccacaaaatttaatacagttcatagctcatacccctaccggataatccccaaaatgtcttgttcctttttcaaattagacatcagcattcagtataacaattaatcaatgccaacaatgttccatatgctttattagcattcattcaccgaatccttccatgaacactaggaagtaggtactaataaaaacagaaacaattttgaagtacagaatctcagaggtggttatcagtaattctagaatatcagtctgacatatgggtccctccactttttttcagtgcacaacgtgaacactgtgtggcacagtgtttcaagaattaatgtttgatttatatcaaagcattatgttttttacttcatcttaatagtaatcacaagagtgacttaagcctcctacatgaaagcagagatagaaaaaagatgaccttggaagttacatattttcttttcctgtaagtatgaagacatgtctataagttattagaaccataaaaaaccaaaaaactaataagaataaaattgtgaaagaatattgaaacctccttaataagcaggttcttgtaggatattgaacaaggtatgtatgttgtagccctgatgctatatttgtgtcatgctgagcaagctacttaacatttaggtgcgtaagggtttttttccctaaagtgggaggatttagatctctaaattccttaccaatcataattttagagcaaattatctataaagtcaattaataatttgccttgcttcatgtattacataatagttgctaatcaaaatgaatagtattatactcacagctttaactaacttatagctaagatcaggcttgctttgtaaacatctctctaaaaactcagaagtccatgaatactaagactttttactcctcctgtaatttttgacctctactggaaatctcacctgctacccctgacctcgaatattgcaagtattaatacagtttctgtatatagtgtacttaagccaaaagtcagaggcatgagaaaggtaaaggccgggacaaaggtactacaattcagctacacacttgtaatgcttcccattagttcgttagttatattagttccagaaactattttaacacggtaggctgatactgcaagcaaaaacaaaaatcatgagaacaatgaaatagtaggtcttagcgcttaagcatatctactagtagtaatacttgacaagcagcccaccttctttgtgatctggaaatgatttgatgataaagccaaattctagaaatataactgctatcttttgggagatcaaaggtcatgtgagggggagagctaaggtcaagagcaagccccttaagcctactccagaaatttcactagagggtgctcttgggctttcatgacttctcagttcttcaataagaaccaagtattgcttagataatatattctgcctagtataacttggactccatcatggatcccatatccaatacttcaatatagaattaaaagatatctccagcagaccctgggcctggttttttattttcctgtgtaatttccttgtttctactgatagtacacttgtgagtttcacaaatttaagacaggtaagagatcttaagaggtctccaaaagtctacattctattaaacaaccacagaaacttcctaatacatcaaagtaagattaaatggggattaactgataaatctatttttgcaaatatatgttttacaaacatattttaatcttataataggttcataatttatatacctattggaagaattattattccataagatctgtagagaaagtctgattgtcaaatagaataaatttcaattatttatatatgtattattcatatgtctcatgacatcaaatattgagcaccaagtaagtactgaataaatatttcttgaccctttattgcacatacatatttttataacacgttccaacaggatgacatataattaaattttaatctctacaccatatgtttgaaattttttctataaatgcagtttcacctttctggaattcacgtttaatgacttattctgtttatttctaatgataatcgctttttatatactttccatttttgctacgtttttaagagaaaatgaaacatggaaattgttttgttatgtgattaactttttaatgtttctatttgtttattagaagattaagaaggttatttatttctacattaaaatattggcaatggcatatatcaatgcatagtgattttcttaagaattgcaatgagtgactcagtaaaattcttcttcactttcaggatgtaaagaattatggctactagccattatgcagggtgatgttcttatcacacataattgaaaactcaatagttttagcatctttagggttgacagtaaaattctgaggttgactatggaatgctaagtctttgaaggcacttccaatttggctaaacttacagtttcattattccttaattgaattaagtttaagtttctcttaaaatcagcttgaggcttttgacaaattagaaatttgggtcctgaatagtagccctttacaatatatgaatctgcataaagatgtgttttaaatgcctatttgataaaaagataagcctggtcacttatggattctagctcctttcaacatcctgcatggattgcaaccagtgtgaaaaattggggatctttaaagtggtctcagatctcttataaagcagtcacctgggctcttaaactgtatggtgcttctcaaaaagggctccttaagtatcctatctgatgtatgttattccccaattcaacttgcaaaggacagagtcaccagcatatattcaaactgtatttcatccaagtgggttgtcaataagcttaaatcactctatgaagaactggcaaaattcccatggatactgtgaaaataaagggaatcaatgaagagatataattattttagtctcagatttaattaatttgtgggagaggtcattttctctcaaatatattcaagtttcttcaaacacaggtcaatgtttgccagctgataggaaaaaagaaaacatttagtctgagtttcccacgtttatattaatctctgtatcacagctaaataaaatgtttcataaatcttcatataggcaaaagagagttcaagctaaggcagagtaacaagtattgccaatagaaaataacctcttaagtactgtttctactatttcctgttctaatttttctattggagagaatgaaacaaagtaatttcacacctggttttatgaatcagctcactaaagattctaggtagaagttacacgggagatgcaagtataacttcattattttacaattagaacactaagacaaagaaagaataaaagtggcgtgctatcccatgccatgcagttagcatatggcaggtcttactcagagtccccagttcctaatctagtgttctttctactgcaaaggtttccagtgctgcttggtttttcataaaggatctgtatatcatgtcaaaatttcatgttgactttccttgaaatttcagagaaaaagaaggcagtataagaaaaattactcttcattgtctaactcttcaagtcagacagcattcctatgtgcaatgatcctcgatacagtctaggtcaactgatctctatgagttttcatactcattaaaatgtatgcatcacaaagtacaattaatgttctcactgactttagggaccttgcatgtttcatccgttccctaacctatgccatcctgaatccaagaggcaccctgtatttctctgaaagtcagcccagcatgaaaatactgaaataagagtgcaggtgtactctttgctttaagaagacacaataagccaaattctgaacttaccaaacagacaaattatggggtgattattcacattttaaaaggattcaccacaggatgcttttaaatcataagctgctctattgcattttaaataagttgatttataaagcttcctttacaaggacttttcactatccagggttcatggttccttatccaaaggcaatgagagcttggtgagcataaagtcctattacctgctaagccaagcttcctttcccaaataagagaataattaggactgtagttcatttttgaaaaattaatgagtctctcactcctgaaaaatttaatataccctgagcacttattatgtgcctggcacagtgctaggcattttagataatgatcttatttactcctcctcaccacaactctaggagattagtacaattatcccaatcatggatgaggaaactgggactcagagaagttagagttaagtaacttgactaaattcttgcagcaaataagtgatcgtgccaggattcaaagtcagatctgtctggagctcttgcccttacatattttacaatataatttcagatgaaatttaatgacgtctcttacctctgacctaactgagcataattgcgctccaaatgtactattccagtgcagcaatcctgtctgtagcaatagggaccagtcacacagcctgaatacaaaaagatagggggctcactaacaaggttgcctattctggtcactgcactgccatattaagcccggatttatctcctgcaattcctacctattggatctaactttgctctacagtcattgagaacaattaaaatcccttccccccatacctatcatatttctcttatggtttctttcttctttttttttttttttttttttttttttagtatccagtgcctccaacctttttaaaatataatgggtttatccgctatttacatatattttattctttcttgaaactggttcttctggagcacagagaacttataaatgctatttctaagcgtttatgcaactaaaaattattggaacaatacacagtatagtggataagggcgcaagctcagaaacccagactgcctgggttcaaatccaggctttaccaattaatggctcgatttccttggtgaatatatttaaagtctctgtgcttcagtttcctccttcaactatgaaatgaggacaacagtacctagttaatgtggctcttgtgaagatttaaaagaggggcaatattaagcaaaaggcaatataaggaaaattactctacagtgtctaactcttcacgtcaggcaacattcatacagcaatattcatatagcgcttacagcctgctaggcagcaattagggtactgcctaggttgtaagctttatataaatgtttgtcattattattgatggtataggagtgaatgaatacttaactgccttggaaaaatatgacctatatcattgtatgagattgattttattatccagatataaagaagtcaagctcaactagaaaaggcacttgactggagaccagagatgtgcttctagtcccaactctttcaaacactccagatgaaagatcttggactttatctacctcatctttttaaacagaggaatgggactgtacctctgcctctaaaatgatatgtttttattctaggattctaggatcctattccacctggaccctgcttaaatttcattactcattatgtttgaaaactaccattacatactaacattttatctgcatgtttatatctgttgacatttcaatcagcttatctgcattgttttcacgaaacagaataagcctctgagagtctatagacaggtctgaaaaaacaaaaggtgttgtgatagcacagagaggaatttaatgtcactttggaggaaataacctaaagtcctactctgccaagccagtaaaatcctgtcctctgcctgcaacacctggcccagtccatgctatcttgctgaatttcagtgcagctctttggataaactcaaattcaggtttggatggaataccaggttgatacaacagtcattttttttcaacagaagtgcaggttggactaccttttacctaccaaaatcacctcattctttgatatatagaacatttagctaattttattatgacttagtatgccagtactcctcatatactttattgtccatccccagatctagtgaaggcatggtgactggtatcagtatcaaggcaattgtcttcaaagaatgtggcaatctattctaacaaagtaaattccacaagggaacaaggggacagccactctaaattcactaatgacaaaaactttgatattttgtaattaagcacaatgcattattctataaataaaaatgatgtccttgtaaatctaaaagctatgaaacgttatattttctatttctaaaattctctaggctcaaagtcaatatgtaagtctaatttttttaaatgcacaaaaagctatgatatttcaaatcttagatactaaatttgtgaattgagtgaacctggcttctcccgcttagacgtgaacattcctgttagtacataaatattaacgaatattttaggccaaaattttgtgtttggtgattgacttatggaatcagtctaagtaggtgtgaaggtgactagacttattttggaacatgtacaatttcataacagtaacacggccgttaaataattctctttaaatgatatttaactctcattttaactgttagcccttgcattatgaagcagcttgatgctgaagtaaagctaagatttcagtaaaaagaataagagctttatattctagaaggtagaaatcctagaaaaatcaaagaaattaaaattttggaagtttttgattcatttcttatattttaaataggattctaaaataacatatctcttctatacataagaaaatagtctggttcacatattttgatttattgaaaagttattacagtacaactcaggttgccgaatactaacattgctataccagcgttgttttggtaaatgtttgcattataactctggttgtattacagcaaaacactcagaagaaagagagtaacttttacacatattacatagcatctgtacagtcatcccttaaaatgcaacaatacaactgcaacactttaaatactttaaaatacaaatgcctttgaagaacataacttatatactatttattaataggattaaatcaacatttttatggctctctaagcttatcccagaaactcttccattatttcagtgagtaacaagagaattttttttattgtttatttttttttagatatggtttcactctatcacctaggctggagtgcaatggtgtgatcttggtacactacagtctctacctcctggactcaagtaatcctcctgccccagccttctgagtagctgggaccacagatgcataccactacacctagctaatttttttttttttttttttttgagatacaggttctcactatgttgtcagactggtcttaaacttctgagctcaagcaatcctctccttggtctcccaagtactgtgattacaggcataagccactgcacctggccgagggtcttatagataggtaatattaacaccattttgcaaaattttaaaaataaggcaaggaaaggttaaaataagttgtacaagttcaacaagtagtaagtgaaattcagccagactttgaacatagacatcctgttttagaatctcaatgttctttctatttttcccaaagcaatctcactaactaatgtacgtattagattgcactgatatagtaaggacaaagaaaacccattttctgtgtatattgctattgccttagaaaatacaaatagctactgaaaagaccaatgctatgaagcagtttggtaatacctattaaaaattttaaatctctgctacactgtattaatattttatatcttaaaaagttaaagaataatagagcctaacttagatccttccaaatttgtaactcttcaaaatctaaaatgaatttctaattcatggcttataactgctcaagtaggaaacttatgacaaaaccagagacaagcccttccaacagtgcctatgacatcacagatatacaaatctgccccattttacagtacccaaagaagaccggaattcagctgttatcagacaataataaacttcttctggtaagttcgtctcttagtcttagatttacattcccactgtcagcaagaatttttaagttaaacatttttgaaaagtaaaaattcaataaatagcatttacattatccacagaatgtattttcattgctttggtgctaaaatattttattttaggctgttcttttttctcttttccatccacctcttagctcctttgctccaatccttgcacctttccacccttgttctctctctccctgaagcctcagggaagagggctgcaaactgtctggatgcctggaccctcacgctcctgagattaaacccagacccgcccatggcaagagtcccgttctttgtctgaagcaagtgtctgattgagttagatatggagtcgttatcacattgaaaagaaagcctggattttttttatctttggtattaaaatatgttatatttgtattaaaatattcatctaataaactctcccaaagaaaacagtttcattatattttcaccgtattttctcattccattcttaaagccacagtgaaaggaaagttgttgtggtcaccccaaaatactctttcccacttctaatcaaggtctggttaggacaaagctaaacaataatttctactttgtatttaaggacaccagctactgtttacccactgatgttatttatactaatagggggtctctgaagtgacacctaaagcttgctaaaggtttcaggagggcttttgtaaagtcaattttctcccagtatcgctttatccccacagagtaagcagatgggagagttctttttccctcaaaataaggcttatagcattgactagggaatttaaatgtatctttacaattctcaacttgatctcccaggaagagcttttatagatttggatttttttttgtcataaagtattctatttatttcccagcagctggtgtcaaaaaagttgtttttttaatattccttttaaataaataaaatctgttttcatattgtgtaaaattagttttgcctgctgtgagtttgtggcattatgaagtgatcatttcttcccatgaattatttaaagtgaggatatcaaaatctgatggaacaatacaatgaactatacaatacaatttaattttataatacgccagttcataatagtatctcaaaatgcacagtagttgcaatacattggttcagaattagcagatcaagtataagcccctcagtttcatattttagtatttgagaatcagttctaaattttctagtggactagagaatcatgcatatttggtagtccatagatacctaaagacctttttgctaattcctcatgccaggcactgatgtttgcccagcctagatgacattttttttctttttttgtaaatctttaagacattgagtttgacagctgttaaccctttcattacaaaacaatattggtattaatagcatttcccctggagttctctgatcactttgtcttagggaacaaatgcacctatgtagccacaattattcttactacttattctcactgcagagtttctagaagaagggaaacaacgatccattcaaatgccccactgcacttataagacttacagcaaagctgctaaaacttaaattttaaggtgagtgaggtggcataagggaaatgaatgagctgctaatgaatagggcaagacatgattagaagctataacaaagtctgactcaaggaaaggccaaaggttatcttgtatttgatatgtgtgttttaataaattataatcaaaatactacactgactttttcctcagtggattttctagcattctataagagatattttgtctgattaacttgctatattgaaaagtgggagtcagtatatattacttacaaattctcaaatagcctctgaaaaaattccaccacaaagattttaaaaaatggaagtatatggaaacaagatgctacaagatgttggaaatggttttccaaagcaagaactggcttaaaacatagaatagcaataatgagcacttttcttgttagttctacatactgtaaactaatttatgccccaaacagaactctggtttccctattatccatgttgccacttcctcctctaatctaactgtacttctctcgtctcagtgaaaggtgccaccatctgccctgacagttgatcaggccaaacatcagcaactctttttgcctcacccaccacatctaatccatcaataagccgcattaacccaaacacaaaagtacatcccaaacccgaccattcctcactatctctgctatcacgaacaaaaatcacaattatctcttatctggtctcctaactgatttctctgcttccactgttgcaccttataatccattatctaaacagaagctagaattcttgaaatgcaggaaagatgatatcattcctttggtaaaattctacaagttatatatagtgcaataagaagaaattaaaattcaaaaccatgaccagtaagtctctccattatctgttcatgaccatctttctgttctcatcttctaacatttttcctttgttcaccgtgcttctttgcctattctgtctctaaaacaagccaatcttattcctattagccctggtctagctatattgcctctgcccagactgctctgttcctacatctctgcatgactgatttcttcactcgtagctcaaatattatctccacagaaaggtctttccttgtgtggccaagatagccaaagcatccccaattcattctaccctgctttacttttctcttagaactaattactagtatcttccttatttacatcctgtatgtatgtgagtatgcacatgtacctgtatgttcataatctctattacagtataaattccatgaggatgaggttcttggatgtgttagttatctattacagcataacaacttacccccaaacttagtaacttaaaaaagcaaacaccattccacagtttctgtgggtcaggaatctgggctcagtataggtaggtgcctatgggtcaaagtttctcatgaggttgtgatcaaactgtcagctagagctgtggtttcatctgaattctcgactgaagaggaggagacttgccatgtgggggtcttcacatgtgaaggtcttcacacaggggtcttcacacagggctacttcatgacttggactttgctttttctcagggagagcaatccgggagagagtgatagagggactcaagagaaaaaccacaagctttttaaaaacttaaccttggaagtgacatcctatcacttctgtcctttattaaaaatgagtcactaagtccagccaatactaaaggagaggaaattagacaagcaggtgaaaatagaggatgtggagatcaggtggggccatcttagaagctgcctattataattgcttaccagtacattcttagtgttcagaaaaatttcggactttcagtaaacaaattaatttaaaaaatgactctctcatgaattagttccattggacattttgccaatgatcaagaaaaagtagtgaataaaatctcactcaagtagtgacattcaaaccaaaagagatcaccccagtaggaaggtttcattaggatgtgtaagcagaaagtagcagtacagcctcagtttcttcatctgtaaaatataaagagtagttgtaccatactgtcggagacctaatgaggcaattcgtgagggcctcatgaatcaaaggcagtggatagatgttagctattatctattcttaataagtataaatgcaagggaagcatttttagggaaaataacacaaatcatgtttttataatgatggtatttgatacatcaggtttaactcaaaaaagaatttaagaaccactttcaattgtttcctaattatattagcttaaatatgagactgtaaccaaaaagactaataaaattttggaactcatcaagtgtactgaaaataggctagaaagctttccatatatttatgtaaagttttgacatcttcgaatggacataatgatgcatttgcaatctccacaatcatgagggcctaaagggagagagatgtgtagagccctggaattgaagatccatggtgtgactggggggggaaagtctctgaaaagttaaaagaagacagggcactgaaccctgatctaatatgtaatggggttatgaaatttaggcagagggtagtcatagaattattcatgaaatcctagaatagtaatactagaggtcaaacttcatattcagaaaagtacaaatagggtcaggtaataaagcactattccatatttttttttaatgcctgccttggaaggtagcaaaacttaagtaagaagttggagaaattcatagaagatataccaaaatagactgtagtggatgtatggattggagtttgccatcagagaggcaaacaaggatgtctttaaacttatttactgatgtttccatttacaaccaaatggggtagatgcatcccacatttaaagaagccattccaaaagcaggaacagcacccctataagatgttatcattcctgttctattaattacagtgtcactcactcttttactgatagccctgatggagaatcagcatgaaccagccattttcctccctgtatatacattagcaaaactttgaccattaaatagttcaaagataggcttgcctcgctgtctcatgcctataatcccagcactttgggaggccaaagtgggcagattgtttgagctcaagagttcaagaccagctttggcaatgtgccaaaaccccatttcgacaaaaaatacaaaactgtgcttggtgtgttggtgtgcgcctatggtcccagctacttgggaggctgaagtgggaggatcacttgcgtgcaggaggtcaaggctgcagcaagctgagatcacaccactgcactccaccctgcagcctgggtgacagagtgagagcctgtctgaaagaaagaaagaaagaaagaaagaaagaaagaaagaaagaaagaaagaaagaaagaaagagagagagaaagaaagagaaagaaagggagagagaaagaaaggaaatctcagatatatctataatagaggaatctctcaaaacaatttctgcaatatccagtgtggtggatctaatggtgaccttccaaaagaaacgcccacattctaacccctgaaacctgagaatgtgaccttatttggaaaaaggatctgtgcagatgtaatgaggttaaggatttctagatgaggtaatcctggattgcccagggaagccgtaaatccaataacattttcttataagagaaaaaagagaagacagagagagcagaaggccatgtgaagacagaggcacaaactggagttacatagccacaagccaaggaacctctggagccaccagaagctggaaaagcaaggaatgattccccctcacttagagtcttctgagaaagtgtagccctgccaacaccttgatttcagacttctggcttccaattctgggaaagactaaatttaagctgttttaggccatcaagtttgtgctaatttctaatggcaaccctagtaaattaatacacccagaacaagtaattatgttttccagagaggtaatgcaatgtagtaaaaaaaaacattttgagtgagacagatttaggtttagacctggggtttctctatactaattgtgtgtctttgaacaagttactttatatctctatcttcaggttcttctttagtaaaatgatggtaagtttcccttgcagggtcgctgtgtgatatgttatttctgctcaattcagtactcaattaacctgttaatgataaattcacgcatgtgcaacatgtctacagacgttaaaaactgttgttttccttgaaaatcaacatacattttagcaaggtattaattagaacatatgggattgattaatgtggaaactagttgtacaataccaaatgttttaacaaacctttattacaacctgactattcatgtcatttcaaataactttcctggttgtcagtggaaccatattcagtctgttcttttactgtctcatctgtaatatcttccatagtttctaatagagaaataatgaaaaagccagagtattagtagaaaatgtttgcgtctagcttgagcttaagtcagatatagagtcaaaattgtgatcacagaattctcctaaatgttagtctcagaaaattgacaagggcataataatttctaggacagagtagtcaaattcatacccaccattgataccttcctatccctgacattaaaacagacaaaaaaaagtagttctcacaataattttatagaggaagaatataggaatcatgcagtttaggtatctcttattctggaataactccttaatactaaattgaggctctagtgagagctattcaaaatgcataaatgaaagtaaaataaattttcaagaaccgatctttcttacttttctagcaacaaacttttgaaaaaaattaaaaattttaaaaagtaaaatatgtaataaattagctataatatcatttgtagctattgtaatttattttttattcattcactcaacaagcattattaaatgcctagtaaatgtcaggcattgtgttaggcactaaagacgcagccttgaataagacatactactccctaccttaaggataatttaggcaaaacaatcaatgataataaagtgcacattacaggaatgcaatgtaaggcaattataattagggaatcggggaaggcattccatagaaaataagctttaaattgagacttgcaagattggttttatgtcagtggaggtgagcacatgggggaagaaaagagtaatgaagagtattcaaaacaaagagtagaacatatgcaaagaccagaaatgagagtgagcatggtgcaccgaaggcatgaaaacacgtttagtatgactagagcatagaatgctagggggaaaggggcatgaatcagtctagaaaatgagacaggagccaggctggaagattaatattaaggaagtcagaatactgttgcaataacttaggtgagataagatggtaccctggatgagagtagtagttctgatatgaagaagattgaacagattaaggacattcttaggaggaagatcaaaagtaccaggtgattgactgcatgtggaacagtacaggatatggaaaaggtaatgtcaagtttctaatgtcggcaattatgtagcaatactggaggtgagagcatgtttggggcaaagaggtgagtttagaacatgttgagtatgaggtgtctgtgagtcatccaagagaagaggtctagaaggcagtgctcagagagaagcctgagctggagaaatatgtggtggtcattcagatgcagatgctaatgaaacctatgggagaaaatgagattgcctgggaggactgcccaatgtgaggagagagcctaagagagagttcagagaacatcaactttagtactgcaaaggttaagtaagactagcaaggctgcctctaatgagactttatacaacccccttcatagtaagttctcactttctacagcaattcagggctcacacttctcttctctcttttgactctcaaacaaaattataagataagcagggtgggcaacaggacttcttgaagataaaaataatctaggtttcaagaggttaggcttgaggtcatggatctctttatttccagattagttttctttccatgccattactctactcccaaggattagctccttatagcttcttctttgttgttagcctggactgttgcctaggtgtcattttagaggggtgaagtttttttgcattatattatattaaaaattttctccatctggaactgatgaaaggacagaagggctaacctgaggcaaaactcgagagtggcagaactgtttcttagagcttccaacctccctcatctctaccttaccccttctttaaaaacttttgttcatttactcaataattagttattaagataatttgtggatatggaaattaacaagccacaccaagtctctaccttcacggagcttacacagtagtaaaatggcagacataagaaccaatgcactaaaagttaagaaagaggagtgtagaaccaggagacaccaagggcatacctaacctacactgaagaggttaaggaacacttcttagaataagtaatatttcaactaagatctaaaaaatggttgaagttgactgtcttggccactgttgcaaggaggaaaactgattcaaccaacgaatttagaaaattgtaatggaaacgtataggttagtgtgccatcctcttgtatttttcaaaaaagaaatcccagaatttgcaacatttgatccaaaaagaatgaatctcctcaaactgtggaattcctgcactagtactgatatggtttggctctgtgtccccaaccaaatcttaccttgaattgtaatcccagggacctggtggaaggtgattggagcaaggggggcgattttccccatgctcttctgtgatagtaagtgaggtctcataagatttgatgcttttaaagttatttggcagtctctctcttctctctctttttctgtccttctgccgccatgtaagacgtgccttgcttccccttcaccttctgccatgattataagtttcctgaggcctccccagctgtgcagaactgtgagtcaattaagcctcttttctttataaattgcccagtctcaggtagttctttatagcagtgtcaaaatagactaatacaagtactatccaagtataagagaaaacattactctcacctatctcaactcataccatgtaggcaggcccttaatctatctccccctgagtccagatttgaaggcaaggaaagaactataagtaccttgtcttatttatttttcaggactctaagttatattatctccattatacagtagagaaaaatcatctgaaaaattacgcaaatctgcccaagatttcaagccagtaaatggggagctaggtcttcattctggtcagttggctccaaagcatctatttattctaccttgaatatatatacacgtatacatatattttacagatggtgtttcactatgttgcccaggttggcctcaaattcctggcctcaagtgatcctcccacctcagcctcctaaagctctgggattacaggcataagcccccatggccagccaagcatatatatatatatttttttttgagacggagtctcactctgtcgcccaggctggagtgtagtggcacaatcttggctcactgcaacctctgcctcccaggttcaagtgattctcctgcctcagcctcctgagtatctgggactacaggtgcctgccatcacacccggctaatttttttttttttttgtattttgagtagagacaaggtttcaccgtgttagccaggctggtcttgaactcctaacctcaggtgatccaccccccttggcctcccaaagtgctgggattacaggcgtgagccaccgcacatggccatatttttataaagacttgtgcacagatgctcattgctactttatttgtattgctaaaaattgtaaacagtctaaatgcccatccttaagtgaatggataaacaaattatagtatgtctatacagtggaatactatgcagcgaaaaaaatggtgaattattgatacatgctatgacataaatggatctcaaagtcaatatactgagtgaaagaaggacaaaacaagtacagaagattctatttttataatagaattcaaatttttataaaattctaggaaatgtaagctactgtgtagtgatggaaaatagatctatggttgcataagaaaattactggagtaaatatatatatatatatatatatatatatatatatatatatattagctgagagtggtggtgcatacctacagtcccagctactgggaaggctgaggcaggaggatcacttgagcccaggagtttgaggttacagtgagctatgatcatgccactgcactccaggctggttgacagagcaagtccctgtctcaaaaaaaaaaaaaaaaaaaaaaaaaaaaaaaactttcatttctcttgtgtaaacatgtaggcatgaaatggctggataacatggtaaacatacatttaactttttaaaaactgtcagactgtctctaaagtggctgtaccattttactttactgccagcaacttatgaggcttccagtttctccatatcctcaaaaatcttgctatgctcagtcttttaaatgtcagtcattctaaaggatgtgtaatagtgtctcatgattttaatttgccttcttctaacaatgattgatattgagcatcatttcatgtgctcatcatataccatctttttctttttcttttttttttttttttggtgaagtgcctgatcaaatctttgcccatttaaataatatgttgtatattattgagttttcgaagttctttgtattttctggatataagttctttatcagatatattctttgcaaatattttcttacagtctgtggcttaccttttcattttcttaataatgttttcaaagtgcagaattttttaattttcatgaaatctaatttatcaacttattcttttatgggtcattcataaatgaattgtgcactaatcatctcctaacatactacatgagttacttatcttttcactgatggatcccaagtggctagtaaagtactgaatacacattaggtatcaataaacatctgatggataaattaaaatttcaaatagtgaaagcaaaattatagaaacttagttcattggcagcacagaaaataaaatagcctctagtgcaaagccatattcaattttttgttatctgatctagtatgaagtttgatcgatacaaggacccaaatttattaaatcttgttaaagaacctgatgctctctctctagagacaatcctttcttccccaaaatagaaatgtgaaattccatagaacttaaatgtaaagcagtaagtcccctacccacctctgtgcctcacctcgcccgtgactcaagtgctatatgaacccctgcaaataaatcaaggctgctgaattctcaaaagctctaattgtgccaattgtaaataagcctcaggatgaatttcaaccagcagtgtccccaaaaccattatctgcaactataatccattacttttctttcataattaatttttctaataggtcagtactatttgttttgtttaagcgctattccagcaatcccattttaccaacaaccaatgtcaattgtaattatatacatattttctattatatacaacaaatacattcttatattatgcgaaacactaaattgggcagtgattttttaatgagtaataaggtaatatgctacattggtgctcaactgcacttgtcttgaccatatgaattaagagtctagtggaaatttataagcaccttgaggacttccaggtatgtgggtgcttaaataggtactcaaaagatgctgcttattttcatagattttaatgtctaaatcactgggaacaatgacaattaccagagatatagataggtggttagataaacacacaagagatatgtatgttagagacatacacattatagagagtataatagggttgtatacacacctacatatacctatataatgtgtgtgtctgtgtgtttgtatgcatgtgtatgaaatcaaaatgcaattcactggaacactgaagacaaagcggtcaagcagctgagagaattcaccatactgatgagctttcctcctcagagagcttgctcctcaggccctcactcaaaggctctttattctttttagatacaattctaaagagtttgatatctacttttccatccacaacagactaaatgctgaaaactcgagagcataggtgagcttgtgtttgatgctagctgcaagcagcctgacacagggagaaatgagagctctcctagagccaatctggggagtgtcctggtgagggcactgagacctgctagttaggaggaggcctagtgcaaacaggcaaaattgcttggatgaagggtaatcaatctgagcctagttcttttggatgaaacctttgagaactcaatgacaagaggatatggatccaacaggagactagtagagaatacaaattcattattttgctatacaatgctagttgcattttaaacaattgtttctctatgaattttactaccaggcttttctgaaccattctgtgtgaattcaatactgcctggatttttaaaaccacttctgacactataaaccagagaaatctttcttaaaagataataagaagatggggccttgcatttctcataaaaggaaaatgactccaccataagtgtattcattacacactgttgaggcatgaattcagggaaaattagactgaatatgagattaccatcctaactttctgaaacactcccagcgctgtcaccagagttcttacttcaaatatttactcttgatctaaaaatatcttagtccaagaaacggaatgattactccacagttaaagtatatttagtgatctgagagaggagaagtttcatttcactcaagcaaatggttttagtaccacaaccaattaatagcttcatcatgtgtgagccatgattataaaggaatcggactaattttttaaacaaatctataggcttctcacaagggctatttttcacaatggtcaccttggaagaaagtcactccagggataccgtcattacttcagatttgggaccttacctttagaattggttcatgagaaaaaaaaaaaaagaaacactacatgcttcatagttaccctccccacctaacactacatatccctgatcaccaactttgaatatgcctcatttacactgatcaaccaaaagcctcctggaaatggtaacacggcctatttatcctgggctttactgggagggtgggggatgaagagggtttataggaattaagagagtctatttttaattatttcatctgtgaaacatatgaaattcctttggccaaaaatgcaatataaaactcagattatcaagggccttttcgtgggaccagtgaaatggagaaaaaagtctccatgacaaaatagaggacttttgggaatccttttttttctgaggtttgcatgtgtgtgtttctagcttggctctcacctgaactgctctttcataatctactgtagtcattgggtacctggaatctgggaaaactccaaccttactccagcacttgtgcaataacacagtaaggcacatggagtcaagtttaagcacttagtccagggttctttgcaccctgtgggccttcagtaagcacttgttgattgactgaatgcgtggctcactatcaatgtgaattaactatatacatactgcattaaaatccaacaacccaaatactttctagctttcaggaagtaatgcatctaattgacagaaccactcttatgcctcctaatccccacttcctacaaaccagctcaaaggaagagagagaatttgaagaaacaaaaatgaacataagaaaaacaattagctgatgcactctgcaaagcctgtaatattatctagaatgacagcatagccattgttcgtgctgccagagccccgcgtgtttgctagctcacccgaggtcctgagagaataataaactaagcagattagatgtagactgatgcctccatgccaccaccaactcacacaacacacacactgttctgagtgtctgaacacatgcgggcaggtaaacccagaaaatgggcactccatgttggcaggaggggaagaggctgccaacaaacagggcctgtttattatttaacagttggtactgctagaggcctggcaccgctatagagcactctctgtttcagtgcaagtcagcctgattatgagagcgtgtgagccaaatcatgtttaccatagtctgtgagaacctctgtgcccccaacagacatggaaattcttacaatagctctcgtccaaacagagaaaaatcactcctgagatggaggtaaagggccccacgtgcttaaattttgtctgatcagctggctcagtgtctctacatgtagttgttttttccctgctcaagacaagtcattcctctctaatgatacagtttctaatcctctgcctttggttactttactttgggacctaaatcaaccaaatactatgtcaatcacccatctactaatattgcttatgctgtcctgcacgctttggcttttcagcaaaagaatctgctgcccagggcggctacctcctgcttctccttcgccagggctgcctctgcagtaagtctcctctctgccaatgtgggccacaggtggatgccttcctacaaatccaatcagcaggataatgtgctactatcacaagagtggaccttaatgacaaagagccctgcttagatggtcaccccattaactttgatttgattattctgccccagcagaacacttggcttcacaaccacagatggcaacagtccaacataaaacctgtagacagagtagtcatgttgggttcatacattttcaaaatattaaatttcatgtaaaaatataaacatggtaagtattgagagagtccctggttccctaggaaagcactgttttcttttcttttttcttttttttaacaaaccaaggtcagagcactgagacaattgtgctaactaggcaacagggataatctaatcatttcttttgaaattcaacataaatcaacatttcttttaagtgtaagaacctggcttttatcttccatatacaaccaaggcaatctttgatactttatgtgactctattctatacaactgtttttaaattcaagataaaattggctctatataagctagttcaatattttgaaatttaattgtaacttggatacacttcctctgtgaccatgagtaaatcattaaaatgctttctaccaatgagaataaaggcatagcaaactataagtcttacctgaaactgtatgcagtgattgttttgtgttttgttttctaattgacagttgatatttatacactaaattatcaaactactatttgtttttaattaattcctcaactttgccactcaaggaaaatgatatatgctttgtattgttaagtaaatacataattttatacttatcatgttattatggttttcaaagaaagtagttgtccctaggtcacagattatatacacatgcatagcaaaaagactttacaaaaacaaggaaaatatgaaaaaataattgcctagcttggatcaagttaacccctggtttaatttaatcatctcctctactgaggatctgataagagattcttaataacagccccaaattaaggcaatagaatcaggaaatctttttttttttttttttttgagatggagtcttgctctgctgcccaggttggagtgcaatggcgcaatctcggctcactgcaacctccacctcctggattcaagctgttttcctgcctcagcctcctgagtagctgggactacaggtgcccgccaccacgcctggctaatttttgtatttttagtagagacgaggtttcaccatgttggccaggctggtgttgaattcctgacctcgagtgatccgcctgcctcagcctcccaaagtgctgggattacaggtgtgagccactgcgcccggccaaaatcaggaaatctttcccaaaacatcctgtatatagcaacactcataactactactttatggcagaataatggacccgattacaggttcacatggaaaaagttgatatttcagccacgaccaaaatataaacaggatttttcatagggagtagatggtgtgttcatagcgagataggtggtgtgttcatctctgtgctgagatacttcatcttaactagtaagaaacatagtaatccctcacattcattaagaggtatgctgtaagagcttaatatgtatacacccatttaaccttcataacaacctttattttttagtgactactatttacagtgattactattattttctccattttacagacgaggaaactaaagcacagagtggttaagtaacttacccaaggccctgcattatgtaaataaaggggctaaaatttgaactaaggtggtctggctccagagtcaaagtgtaatcactgtgttctgcttctcataataacgatcactctttctgaagcttgtgttcaatttaaaactgtatattccctgaggctgtagaatgttagagctgaagtaatttaaaatgatctaacccatggcctaaagctccaggtggagagaggatgtttgggaagactgtgtagcctcaaaattttgtggataggcacacttttctgggaaaagaaatgagccactcatctagtctaaatgtctcagttgagggattaaaaaaaataaagccacaaagcaatggctgtaaatgctgcatattttaaggaagcaatataaaaagaaccaagcccagaaaccagggctgttttcattatcctgtctacccaaactctcttaggtggctcccttaaagccagaagaaatctgtgtgagggatgccgagtcagcctgtttctctacttggctccacatgactcagtaaagcaaatcaatgagacaagatatctactcatgcaagaaaaaacagaaatctagtgtgatgttttcttgactattcaatgctaatggaaaaaagttggtaacacatttaagaggtaagaagaaataaaattgtctctttacaaagttgactgatttattcatttagtagatacacacacaggtatacacacatacacacaatttatttattttagtggtagcccagaaactttctgaatttcttttgtatttctcttgagtcttttcctgtaatttatatttacttaaaatttatcccttatgttcaaatttttcacatatatatataaagtattcattataatcattttaatttcctccatttctctggttatttccccattgtatttccaattttgtgcatttgtgggatttctcatttagtaattaaatcatgtgatattggtttgtttattgttctgttattctctttgaaaaaaccaactctttgatttattagtgtgtctcttttttattttctaattccttaacttctgactttatttttttaatcaattccttgtttctactttgcagatttgttttttgttcttttaaccaacttcatgagatgaatggtaatacgtttataattattttctttcctgtaatagtcatgtttaaagatatggatattcctccgaacactgttttatctatatctatacatacttattttctgtaaattctgtaatgcctcttaagcaaaaaattaattttaaaaagttattggtcttttttcttatcaattcgcaggagctcttattttttggagatactatttttgtctgagatacgagttgccaatcaaaatgatcactttttcatatcatgtaaaaactgttttttaaatttttatttgcttgatttttcttattcacaattgtggtaatatcagtagaagttcttctccttcctctcccagctttttgcttcctatatggtttttggtcccattagagttttattttcttcttctacttccttcttgttctctcacagacaattttatttctccttatttgtcttatcacttattcaatcctgtttatctagtttttgaactttcattttattttattttattttatttattttattttttgagacagagtcttgctctgttgccctagctggagtgcagtggtacaatctcggctcactgcaacctccacctcccagcttcaagtgattctcctgcctcagtctaccgagtggctgggattacaggcgcccaccaccatgcccggctaatttttgtatttttagtagagagggggtttcaccatgctggccaggctggtctcaaactcccgacctcagctgatccacccgccgcagcctcccaaactgctgagattacaggtgtgagccacaccgtacctggccttgaccttttattttaaggaggccacaatgtcttctatttatttgctagtatggaaaatagatattattttcttgtataattcttcttgtggtatatgttttgatctggtttctttgtattgcttttgtttttgtttaaagctattagctttgcttagctgatagctaaatctgggtccaatgcaggttcctttctgattagttttcatttttcactgagttaattctatcagctgtttgctgcaggaaagaggctggcacagtaaactgaggacttcagggagtttctttttggtaccatatttcctgttatgttttacctttctcaccaactcgaccgtgcacattgttcaagagatatggatctgcttagtgttctcagtgtcttgtcttccccatttagattagcgggagttccaaagggcttgcacaaagtcctgcctgatacattttccaagtcatgatctaatatttccttatttctcttctcctgaaggtgatcaacagtggcaaaggctggtgtggtttatcttctccaccttgccacccatgcatcctgcttttggcacatgtggcaggctggtgtcattcctcattcactgccacctcctctgttatcatctgttgtagaacaagccttagcaacccttctgcagaccacctatagcctcacactttcctgttgcatgtaagtaactggagcatgtgtccatcaacttttggatgttctacctgctgcctatatttaaaatactctcgacattgtccctgttctaaatttcgaaatatcccatggtttctgatttgagagtgtacctgccttctgtaagaaaaggcttttttatatgcatctcattttctatttaattgtttgttgcacagcaacatatgcgacagtgttgcatttagtttttcatctgtggcctcctaaatggcaaaaacaaaacttcacttattagctcctctccaatccttctctcaatcaagtgcttgcccgtccttgtccttaaacccctggactaatcccttgtaaggtgtcctgttgtaaggtgtcaactacagcattcacattcattgaccatttatatttcccctcataagcatatttgcatttaaataggagattttaaaaatctaaactaaactttagactaccagatgaagttataaattaaaactttgattgtagaatgacaaataacatggtatatgtggaaaagaagttagaggaccccaattagtatctgtaaaatgacctcatgtgagtagcaaagttatgtgtgagttgctttaatctttaaaattagcttctgcaatgcttcattgttttctataatagaagagtaataggaaaatgaggcatttgttgtaagtaaattttctagttacctgtttaagcagttttcttttaaactttaagatgaaaatctttacaatgagttcctattttctgaaacaaataagtgacttgatatggtagaaatgtactggagtgagtagttccagattcttaagttctttctgttacttattattaataaagttttgacacatcatttagcccacccaagcctcagttctcccatctgtaaaacaggaatagcaatacttcctttcttgcaatataagttttctgtgagtggaaaatgacataatatgtgtcaaaatactttgtatactaacaactagaaaatgataagagccttaataataaaagataatccaaataaaatattacactactatcaaagataatagaggctaacagggaagttatataaatactttcatgattcttttgtgtgttttttcctagttgtttagccaaggtactcacttctatttcagttctcattgccatcagtgagtctgcctctagaaaaaacactttctgttttcccgcctcctcttctccagtacatttgtatagtttttgtctttgtttctttggtatgttttctgtggctttaaattggctgcaaaagattgcatagggtaatgaaaagagaaagcagctttggagtcagacagacctggtttgaatcctgactgtgtttttgtgctcatcacttaacgtccctgaatctgtttccttatccataaaatgaatttaatcactgataccctgcagggctatctaatatgtgaagttcttggatttcatcaaatctcatttgccttcttaaaagtatattttgcttatttctgtgtttttaattgaagctttatgacatttgacaatggatacattgctgcactctgatcagtaattattttattcaatgaatcatttcactttttttctaaatgtcaccaaagactctagcttccttaaaatctactttttgttaatttccttgactaatcttatagttccaatagtttctctgcttcaatcagctttcttttgtctaaacttcttctgttttctcttgtaaaataatttatcctaatcttaaatctttacgacagagaccatatcttctttggccataatgcatcgaatattctgtaaaaaccacatcactatcaatcaataattatgtgtgtgttataagtatgtaaatgttatagatctcatagaacttatccactctgccttagcttattcctagaagatcacagattactattatatagcatttgtataactctttatcatttgtgaacctttcgtaattatttaatggaggtcttcaaactactagtatagattgattttgttatttctattgttgggaagggaaaacaaagacagaatgatgaaaacttgtcagatatatcccatgttaccaggaaaaacaggattagcacacagtctcttattctctgatctgctgatagtctgttgagctagtgttttcctagcatgaaaggaagaaacatctattcatttccaattattattttctggaaaaggtattatggagatggttctctttatgttcaaaataaataaaatgtccgagtgattcctggaacttgggagaaaggggaaggtaaaccaaaaactagggccagagagcaagaaggaggtaaaggagataaaattcgtggtgggtgaatcctcatccgtcattacatgacagaagtatttaaaaaggaaagctactacctctcctcatctgaggcttcctccagaaccctgtaggagaggaagatacactgctgagtcttcatttggggagcagcaggagaaggcagtgcctccttagccaaatgaacctttcctgacagctgtggggatatgtgtttgtgccaccaggccccttagaaaattatccctaaaataactaatgtttagtcagtcaaaacaacaacaacaacagaaaaatagcagcttcaaagcgaaagttatgtggcgagagtaaataacccaaacttaacgtgaccttcctagcattattttagggaggcgttagggtatagagagtgaaaaacaccctgaggtgggatttacaagtcttaatttcagtttcagcagtttcactttctggctgtgtggtattagacaagtggcttaacctctctggacctctctgatccttcagatttaaaatgagggggttgattactaagtgacgtctaagagcccttctagagataaaaaattccccaatctatgataataataattaacatttgatggtcctttaccacctacaaatgatttccacatacattatctaatttgatcttcatgccagttctgaggtagtattattatgattatgcccatttttggaagagagattcagaaaccacaaaatggcagagttggcattgaacagatgttcccaagaggcaaataccccttcagtaaaagaagcagctgatgctaacaaggataaataagagcagacaattcagcctgtgagctcttgtttaggggtacaacagaatttctggaagctgcattggggtaatgataatccaccatgtggaatgttatctgatgatgtatttatcaaaaaaaactaataaaaagaaaattaaaaaaagatacaataattgttactgcactacaccctaatgaattattgtgttcaaggttcttacaaaaaaaaagtaatattatactcggcttatgttttaattgatttattaatattttatcacaggaatgtaatttaagctcctcatgatttagatctcataaacctttagcattttgcaaattcaaattccaatttaaagccagggcgagcaattaacttttctatcatcttgtcaggggagaaggttcgtgtttaatttgagacaaagtgacagaaatatatatacactgtatgtattactccaatttaatttatgagtcagcaccatccaccttcaaaatgtagatttaatagaagaggaggaagaaaaggccgtgctgtcatgatagggctgtaatatctgccctgaatttcttacatattaaaaaaaagtcactggtttgttgagataccaagctagattgattgcaggcctatttccagttcttttgtttcacattccacttcctgattcttttctcatacagcacataatctcatggatatcacagggagttcttacccccacttctacctctactcctaccccatcctccattttcatgcatagctgcttctacaggtttatcctaaatcttgacaagtgagataaatggtaaatattgctttgagatcacgtcttcatcacctttctcatctttccaaagccaccttctaagtgctctctacctaaaacaaacaaacattaaaactcctcgcaattttatattttaatgtgcagggtgtatctggcacggtaaaacactggcactttcccgtgatcctttacaaaatatttaaggacaggatatgaataaataagctaaaaccacagaaggtagtcaggtgaactgtagggaagtacttccccttggtggttattaagcactggaacagggctgcggagagaggttaaggaattcttactagcgccgttatcctataattcaccaaaggcacacaatgctctatgctgatgagatgagttacatgacatctcctccctggttcaatcaaaggaaagcaatttacatctcaaaccagttctctcatcagtgggacataaaaactgcagaacagagatgcagcaaatgtgcttatttatacagaatcaactcagttgccactgttctttattattttccttctctcccacctcccctgtatggtggccattttgaataggatgcttaaaattctaaaagtgagaaaaagaaccaagaacaattcagtaacaaaattaactaaagataacttgtgcttctgacaatcagtgtcccttgtggtgctaggccaatccctttgttccacttaaaaataaaatcggattcctcttgctggccacaggaaaagaattagaagacgattaatggaaaattctggaaggtagccttgtaaatgtttattcacttttcaggcatacaatgttgtgctacataagtgaatacagtgcatttgtcaaagaaaggccatgttgaattagtgtgaggtcttcattcataaaacaagcttatttttactaataatctctattaatctcagcttaattatattaggcatttttcacttgcatacaacagtaaaaatggccaaaactgcatttactgcacctgcttaaacgcagttatatccctaaaaacgattgcagggaacaagctcccacagacatggcttttaggcagaatatgggattatggcagaggggtttaaatacaggaggtaaaaatggtaatcatattcatcaactacacaaagaagtaaaaacaagaagctctagataattctttttagtggactcactaaaataacaataacagcttgatgaagagaacatgattgtcgaaagcttgtccattttacattttctctttacatagtgcaataaaaaggaagcacctgcagtttctacttgtgcgtgtattcgtgtgtgtgtgtgtgtgtgtgtgtgtgatgttgaaagaaatcatggacatcatatttgctttaggagctactagtctaatcttaagtgcacattccctaccataaagttgtatttgagctccgtgcagtgcagaaacattcttcagcttagaaagtgcagtctttgcttcacacccttttccttcattcagacacatcagcatcttatcactttggacattaaagtaaaagagacttctttgtcatgaatatttttagacaaattacaccaaaatatcttgtattttccattttttagtggaatctactttactgacatataccagcccaccataacatcactgttgtgatgtcctactacttatctaaaaaaagtactattaactacatattgcaggtatttgaagtatataagaaaaccataaactgaattacattgtatggctggtatgatctcacatgaagtttgagctatcattattaaaaacagaaattgcatttagttaatgcatctgacagtaagccagtcaactttcaaggttgtatgatgagaaaaaaaatattttttaaaaaaacagaaaatgcctgaaaaatttcacaagagcatttcacatgacaagagaattcttcctctcccttctgctgcctgcctgcccacctttcttccttccttccttcgttccttcctttcctccttccttccttctttccttcctttcttctttcttttcctccttccttccattcttccttccttcctttcttccttccttctttccttccttccttcttgccttccttcctttcttctttcctttttcctctctccctctcttctccttcctttcttccttccttccttccttcttccttttcttttctcgtgcttctctcccttagtttctctcttctttccttccttccttcaatttggtggaggaggtgcaaaaatttgagtaagaaaataatatttttgtttcagaatccacatgcttttactattcatcatgctaacttagggggaaatttagataacttcttatggcgttttttttttttttttttgagtttatagatatctttcaggggtcaagctatttccaaacattcttataatggcctccaatattccacactgcaatatatagcatgctctaagcaaaggcagtcttttataaaagactgcaatagctagtgaagaaatacttttttttgattacttttataaaggcacagagcaaacgacagtacagtatgtacataaataaagcaaaggttcaaactgcacttttacaactacaatgtcactaatagacctcatcccctctctgctattctatatatataggttgaaatctgaggcttaaaacaatgtttgaacaacaaaacagaataaatgactaacccaatctttcaggttccaaaaacagtactggagagttttctatttttataggtgtttgtcactatggacattcaatatctataattctgaaattacagccgggcgcggtggctcacacctgtaatcctagcactttgggaggccaagatgggtggatcacgacgtcaggagatcaagaccatcctggccaacagggtgaaaccccatctctactaaaatacaaaaaattagccgggcttgttggcgtgtgactgtagtcccagctactcgggaggctgaggcaggggaatcgcttgaaaccgggaggtggaggttgcagtgagccgagatcgtgccactgcactccagcctgacaacagagcaagactccgtctcaaaaaaaaaaaaaattctgaaattacaacaaaattaggatctgaatatgtgttttacaaaatgatttgctataggccttcatgggggagatggcaatccctagtatatcaaacactgtggcttaattttttttaatcttcacaaaactcttcaagaatggttgtcataatgtaagaagtgtcagcattaccagaacaatcagagatttccataggcagaataacattagagattacgtcattacaacagatagccctcatactcaatgcatcttacatggtcagttaaaccaaagggtaggaggcactataggataattgtgagaagagttgctttctaagtggaagaaaggtgaaaataaagcacctgcagtgctgtgctttcactttacttcctgccctcacagtcatcctggagatcttactggtgtgctttaactgtcttgtggcattctctttcaaaagcatcttcagggactaaagttcaggttttatcagaatagacatagtcctgtgctacttgacagaaggcattttactcttttttatggtttcactaaaatcaagagtatcacaaaaacatcttaagatctgaaactgggaatcgcctcataagcatgtcttccaaccctacaggttgtataaggcaagtatgtgtagattgaatggaaccctctatgtctggcttttcagtattgtaaagactttcaaagctcattaagtacttctttgctgatacacaccaagctaagtcccacctcagggcctttagaccttttgttacccatgactggaatgctcttcctctagggtttagcatgcttctctctttattctggtttctcctcaaatgtcacctcttcaggagacttacactgaccatcacatctgaaatagcttgccaactttactctacctatctcactttattatttttcatagtatttatttttttccggaaattatgtactgcttattatctgtctcccctaataaaatttaacttctttgaaccaaatactttgtcttattccttagtttattgctagtgtccagtactgtgcctaatatatggtaggtgctcactatatatttgtcaaataaataatacttaaaatttaaaaatttattctcctttaagttgtacagtttaagcctcaccttattttctgctgataagagaaggtatcacctacaatgacccttcacattctagacaattaacaaagtctatgtggaagaataactattccaggaagaatgtgttcagacctggtttgaaatcacagcctgttgctgtggggcatttattacccaccatttagctagattactgaatagatggagttaaccaaaatgctgacaagacacacaccacacacacacacacacacacaaacacacacacacacacaccccccaaaaacgaaacctcagccctccaaaactctccttactcttgtaattggagtgcattgccactttgctccaagccaaagaacagataagaaagagaagcaaaaatcagaagaactttggaagccatttcactagagctgccacctgtcacttacgtaagaagatgcaatcatccatctgtccaaactggtgaatcataaggtcttaaatactatttactttccccaaaatagtgaatcccttgcaattttatatcacataataacaaagggacatgattcttatttgtttttcctttagatacacatagaacattttctttaatgtggcatacaactttaaaaatataaacaccaattcactgaggtatttttttggtagaaaaaagtgtctatcataattttagtagcaataatagttctgtacatttcttttagcaattacaacctcagatttctaagcactgtgcaaacattaatttactaagttctgctgtgttctctttgtgaattagaatattatcatatcttcattatttttaggtgagagtcacatggctatgacttgccagggccacacggtaaataattttttttaaagtggtaagatgcctctgttttgaaagtggatgcccagggaagattaataaaataggataagaacatacctaaaatggcatctgtttttttttttttaacctagtgcttccattcaaattttgttttgggatatgaagtcacctgatagctcagttcaaaactcgaataaacatccttgaaaatagtagggttattctttaaaaatagtagttatcaattattgagtgtgcaccttgtgccaggcacagttctaagagatctagttctaggagggaaagtgtacgagtccatgtgaacaaggacttggtgtcttattcactattgtatgctccgagcctataacatacctggatggtagtgagggttcagttggtatttgttgcaataagtgtataaataagggaagctttcttggttccagaaaactaaactgtctgaattttgaaacacaacctgtttgtaagttgggggcatcatattaaacattttcttttggaagcagaggagaagggaagagattttatttgacccaatatataaccaaatctaggataatagtgatcctctttacaataaagttcatttattcaacaattatttattgaatacatactatgtgccaggtattggaagaggttctaggaataaagacaaggtccttatttcagaacttaaattactgtttatgggcataagaggaaaatatcttcatatacaatgcaattatgaggcaagatttttctatgaaccagtgacttctgtttgtttttaccatgttaccctcctaatttactaaggcttcaattacttggttttcttctgagtagccaggaggacattatagcaaaaagtaagtatactgattaattacaacatatatccataaagtggaggggatatctgaaaatcacctagagaatctgaccaatatctaagaaattaatttaggtcaaatgattagttctgaaatgtctgagttatctatattagttattcatattgccagttcttaacttgttctatacaaacacaatctgaagcttcatctgggcttcttcaaattggaacctagttacaactcttaatggataagttcaagaataatgccactacaataaaaaagaaataaagaagggcacaaagtattagaagataaattatctagagattaataaagtctttggtaagagtttgcaactctatcacatatgggctaattggaaatcactgcttccagggctaatgacctcatttgaggttaccctgtgggacaataacatggcctacctctgtccactaaacaaattctgtcaaaacataacttaccaaagtatagcttgttgaggggtatacatatctgaatttattttactctgataatctgcccgagaggttctgttacttgaaggcaatatcacttcctttgggttcacttgtaggacacaaaatgcagcttttacaagtatttctgcttgtaaactaattcttcagctatagtatataaacttcactctataagaaaaccaaagaggccaagggacattaagtttggtgtttaattgctatcagcaattaaaaattgctagcagcccacttaacattttcttcttcctctaaaaatgaaactgaaacgtatcttttagctgagagttctgtaatgctgagaaaacatcctaaatacatcttggcaaaggaagaaaagaaaaaaatgtgatattgatgtatttgctttcctagtatattgaaatcaagaactagatacaggtgacagatctgcttccacctgctggctcagtgaatttgtaaaactgaaatctgttatctaaaaatcactagtacattcagaattacttagcattccctttctgtttgtacatgttcatgacaatgataaaacagccccaggaattctgctaccaatcttcatatatatgtccattgacattgtctccatcaaattcaatccaataaaattaaatggagttaaataaagcagtctgcttgaacctcagtatctctcatttcttattgtattgtacctcttatcatttcttatttatttagccaaggttaaaaaaaatggtttccagattcaattataatttccctcctggtctcctatttcttaagtattttttcctttttattttcatataattacaaggatttttttttttggcaattgacatgaacaacattattcaaaggaaaaaatacttaaagtagctactatcttatagcaaagaggacatttccatctatgtttaccataaaaattttcactggattccaacattttcatataatactatctacaaatattgcctgctttgagaagactccaaattttaggaggtagatgggcgataggtaatgcatggaggaagttggtaaagaagacaaatttctaactatgacttccggagttaaattttaaaagaaattgagaagtatacaaaagtgttaagactgaaatatatgcaattggcttacaatttctccaaccacttgaggcaagagggtaactccaacttttgccccttcattgccacacttcttcaatctgcatatggattttatgtttcccctttacggctgcccttaatattaattttaacctcaaataaaatttttttggaaggaagagtaatatacacattataattttctctggagttttcctcccataagcaacagccagatgacaaccaacttctcattagtctcttgaaaaacgaatcagaaattttcttatgtccttcacacaggattgccatctattataaatagtgctgaaagaccccacacacagcaaactgaagcatgtggcatttaatacatcacacagaaggatcaagaattgagtcaacacttctagggcttctacccctcaactatgcatttccatggtacccatttccatggtttttagacttttaaacaaacacatttgtctaaaaacaaatacatatgtaggaaacatttctccagggctctcgccttttcagctgcttttggttgacagatgagaacccacatacagtattctgaaattctgcgtcttcttgtcttaagtactagagaaagaaatatttggtcctaggtggcagatcttacttatatcacttctattaaacgggcaagatagagtcacaaaaagaggacttatgattttcaccttataatggattccttcttggcttccttccacctcctatacatggatttgaacttcattttgaagacacttacaattattctgaatgaaaactatcattttcattctccctctcaaaaaagtttctgaagaaatttgttgcaaagccatgctatctgtaacattacgaatatgttagcatatttttagtgcttcactagatttcataaatcttacttacccatatcaataacaaccagtataatttgaaggaaaaaggagaaatcttgtgtcttaaattatatcatttaaaattcatggatgaaggtagtatccctagaaatgatctgattctatgtgactccgggaaagatactatttcatttctgttttagagattaagaaactaaagtacagataagttaactaacttgcctaaagccttctggtgaatgagatagccaagatttgaaccgtggagtccaacgccagaggcttaaccattacattattctacttctgtgttaagattaatagagaggaattaaatgcataattttggaggcaaacagcttaagttcaaatcccaatttcaccagttactagctacatgaccttgggcaaagatcttaaccactatgaaactttatttcctcatgtatttaaataatagctgttcttcactgagtactaagctatgttccagttatcgatgctaagtgttttacatgcattattccatttaattatcataataactcaaccaagtatgtagtgttatcatcccagatttagagatgaagaaactaaggttgagtaatttgcctattgttatacagtaaggggcgaagacagaattctagtaagggcaatctcactctagacaccttactcttagtcattaaatttggtgataataaccaatagtgtctacttcatggggtttggggttgtgttttggtcaggattaaattaggtaatggaggtgtaatggctaattttataggtcaacttgactgagccacagggtgctcagacatttggtcaaacattatttggtgtacttcagtgagaatgtttctggatgagattaacatttgaatcagtaactgagtaaagcagattggcctccctcatctccaaacagttggaggctggaacagaacaaaaaggctgactctctcacaggtaatagggaatttctcctgcttgacagcctttgagctggaacattcctttttttttcctgtcttcagactcaaactggaaacatcagctctctgcaggtctctggcctaaggaagttcagactaggactataccattagctttcccaggtctcaagcctttggactaatacgttggactaacgcaattggctctctggggtctctagctttctgactatagatcttgggacttgtgagcttccacagtcatgtgagtcaattccttataaaacatctcttctatacaggtatacattttattagttccaattctctggaaacatagtacatagtttctgacacccagaaatagttaatgaatgtttcttaaactgctttcccaagaaaagccaacagaaaaggaattataggatgaaaaagcccccttcagtaagagcaaagataggtccagatgaggaggataatgttctgtgggcactcggctcttaagagaggagcaggggtaggggcaaattttaaaacacgatctgcagctaggtcagatgataagcttgtttatgaaataagagatggcaggaaaaccaggttgatccagatatcaagaagaaaagccactttcatcttccactaccctaactggaagggaatcttggttccttaccatgatagcaagctgactagaaatatagatgtgatctttccctttgaaaagtaacaggttacagggaaagtgaaggaatttatagaaaaggtcaagtttgtttagtgccttactgtgtactacttcaaccaattcagctctatcacccaggttggagtgcactggcacaatctcgtctcattgcaacctccacctcccagattccagcgattctcatgactcagcctcctgagtagccagggttacagacgcaccccaccacgcccggctaacttggtattttcagtagagatgggatctcaccatgttggccaggctggtctcaaactcctggcctcaagtgatccacctgcctccacctctcaaagtgctgagattacaggagtgagccaccgcacctgccccaatccaactcttacatacatactttgtttccagctataaaccataggggcataaaaagacttctctatggaacaggttaggtccctgaagttttcaggtctaaacatgctggagatggcaattaaagctttctaatatatgcgagttacattaatatctttgaaatacccattcaattaccccagctcaacacctgttagacaccctctctgtcaaatctcttctgaataactttgtttagttagatttggggccagtatcgtaacttcacgtagtctgtacaggaagaaaataagtaagctttactctggatctcagggaacatgtgtttctcccatcatctaagctaaaaaacaaggaagctgcaacagctgggacaagaaggaaaagccaatttgatttttaaagaaaatagaaaataaaagcaatttgtccaattccaatgtgtggtatctatgctgatttttctcaaggaaaagtgcttatcattgccaaaatccccaaagtaaccacagctgacaaacttctcagcatcagagcacttggcaactgacaataagacctgctccttccccaagcggataaaaagccaggaactccccaaacaaaaccaacagcttttctgtactcttagtctgccttcatgtcttttgagcacagtatattgtcctgtgtaactggaggttcatgtagcacactgattttacccaaagcatcaaaactaatataattaatttatataatcttctagttacactgactatagaacttaccttcactacctacccaaatgtctgctgctgatatatacatatgattgcacaaattctaaagagtactctcaataaacagaaatgtaagtctgctaaaaatgcttaaatatacaaagaaatgcaaatataagctctctaccatacataggatctttgtttataccagttgcacatgatcaatggaaaaggacattcaaaacacttttgaataaacaaattattatcttgcattagcttgtatcaatagaatccttccaagtattttttgttcataataaaaatgtgtataggttggtttgattattttttactcttatcatggcaactcaatataacaatactgtgcaggtggaagagggaagaggggaaaggagagaagctgcaaataaccaatttaattaccctaacagtcatttttttttgcaggaaaaaggttccatatgataagaatgtttgttctgatcaaatatctttgctccataaagaccttatgaatcttccttcaatgtgaagctaagctatttctgaggagctactggaacctcctcattttttctagaggtatccatgttctaaaaatctcaaatgatctcaacttaggaggttactgaagctacataaatgtcaaaagaaatgatagatttacacttctccaatttctgcatttgttatgtagcataaattcatgacagaaaaaaaatgatcctcaaaactccttagaagctcgctcaaaatcttgttttaagtctactcaaaccaaaccaagttctgctaatgtaaacccttaagatttgtggtagtttttcattcccaatattaaaatagtcttttattaattctccatcacatcatattttcccttgactactaaatcaggtccacatttgttgcttctatgtttttgacatcatggaagaatctggagcagtggtacattttgctcttcagagatattttattggtttaaaatgtttgattactaaggggtttaatctagtaatactagattaagtactgtctaccataggaaaaaattcatcagacttaaggtgtttcctcttaagtggaagtagaaagccaaatttcaaagcctaccgtgttaataacaaatgcttccttttatattttcatcaaaaaacaagcctatttccttatctaagttctgtgcaagtctttctgattttctcacaataaactatatgtgtgaaatcccatcagtgttatcaccaatatttattcctgatggccacagcttttctaatctttgtgtagccatatgcttaatgttacataacccacttggaattcctttcttacaaacaaatagcaaaaatgtaagtttatgaagtatgcattccttttttaatgccaaaaataaaaacaaaggaaaatttctaaattggacatgtgataatacataaaatctatctgataaaaagtgtgtaattactgtcacaaaatcttcacacaatccttgaaatctcagcagtagggtggcaccaagttcccacacatcaattaaagcatgtacatatacgtcattggcaataggtcagtctcacagagaataatctcatgatgccaaagctatcctacctgaactttaattcctgaataacaatgttggctaatagtgttttactggatattgtcttacttgctaacatttcttatggggatcttgattaattggctacctaatccccaaagattattccagaaaataataatgtctgaaaagtagaggtcttttctttcacctatgcacaaatttgtcatagttaatatgaaattactttgttcatctgacccctatcaagtaaaaacacatgaattaagatcagcatgtaggtgaaatgcacaagaaattagggccatcttgagaggactgtcatctagtatgaatcacatactggttgaccattctccctccaatcccatatttttatggggttatacttaatacgaagaacaagtgattaatggagcattaatcacagaagtctactgactaaaaaggactgaaaattctgagccttgcttcagtggtgatggtggtgggaatgtgggaacaaagttgctgcacaggtaatccctagttttgatccaaagaaatagcagccaagcagaaacagacagacagacacacgcacacacccctcaatatatattaaaaagtcaaatttcattcagtttctcaagaaaataccaagaagaataagacagaaaatctctgttcttagtcttggccactttattctccacatggacaaccactttgcatcaaaagtctctctctacccttactttcacctctaagtcttttctccatcccttctatcccttatgggtacttttctttcctccctcctcatttttcctgtctctagccccttccttttacccaagtgaaattttgtcacttttgagttcccctcccctatgatcacttttccagttctatttttcattcccccaattccacactacccaagttttgacacctagctggcatgaagagagttcttagaagaaatggaagagaatgagaagaagaagtcttttctgtgatacaagaaaggagaaggccatgactactgacatgaaattaaccttgtcccaaccacatacacgtacacctcaaagctttgtaaaccactggcaaataccctcttattatctcccctgccccatctcccctttcttttaattttttggttagttaccaatcacaggagttaacttcctacatagagggtagacaaatcagggcaatctatgatctctttaggtccatggatagatgttcacccccaaatgcagagctctgctaaatacatctttcagtatctctgccttcttagatactctaagctataactctactttagttttagggtcctttttgcctttttctggccagaacatattgcttttatatgtcttccttttcatcttcccaaatgccctaataccagcttaggctaaatgtgctactggtataaaatgtatctttctccttaaaaaacaccaattattctcaacctctgggatccaaagcatccggaataggggccctcttcaataataatcagtgagtgagtgatcttaaaagatatgtggtttaggaagatgaagttaagtatttaaggtcacaaatcaagtgtggagtggggctgcaacccagatccagatgttctttctgacatgatctctcattgtcttttttcttgtattaatcagttgctaagtcttattatttcttcttcataaaaaagctaatgatcatcttattgcaacaccacactctctataccacaactatatatacttattttggaaagctaagattattcaagtaagactaaacaacacataggaccttcaaaatatgctcctaatcttcccttcttgtcttcgtttctgtctcctggtcccagttcctcccaactttatgtatgcatgagtcttttcatgatcttctctctgcctagagtttactttcacttcccgccaggaaaaaaagaataagtaccctttttaaataagcaaactcaaatattatttgctccataaagccttcccaatatctattccatgagcctttcccaacatctccactttcctactaacagatcatatatcctgttgctttaaaattcctactgctttcaaattctttcttcttgctagattgtgacatgcttactggcagaatccatgctagatactgggaacacaaggattaaaaccacaacccttgtactcaagaggtttccagtacactagtaagtcaaaaatataaacaactacggcacaggtctgatgtagaaaacatatttctatttaattgacttgaattatagttgcacacattttgtgttgtaaccaagattatgttacatatgataatttaagtagccaaaagttgactcaggttgagtagagaagtaaaagcacataagaaagagaacaggaagaaataaaactgtaaagatgtaatgggagagaaaatactgagttaactgaagtaatggcttaatgcagaaataagacgtttggggaaaggaagttgaattagttgaagacatttttggtaacaagagtcatgaagcctacagttgccagaaataaaaaaaaaaaaggactgactatggagtatttattaaatactcatactcactgtttgaagtacaaactaagaggaatcagaggatcaaagtggttggttatgacttgctcagctagtaactgcaagtgccaaaattcaaactgtggaatatttcaaagtccgccctttctaaattcaattttggcctaaatccaaggaggtagtgtccacagaattagctagaaattacttatttcctaaaagatcaaagtcccaaagaactctgtatgatttcaaggctgctcatatggtaataatggatacatttcacttcatagtctaatcaactaatagactttaggacagtgaatatgaatgacatgaaggtgccttgagaaccatcaagtcctacctcttattttgagactaattgaagatactgaggcccagtaattgaatcatatagattgctaaaagaagttctgagaagaaatgaaatacaaaagcttggtttctaaggctgaatatcatgagaaactatcatgttatcctgtgtgagtgagctccacgaggccaggtatcttgtctcttttatggtcaactgtatctccagtatctaggagagtttatggtactataactagcacatagtgagcacttaaaaaaaatcaggtgctcaaataacacggtttagtgaaggaattaacgggttcatatatgtgaatgtgtgtaaagtgggtgcaagcatgtaattaaatggaaaactggtcatatttagttagatgttactaaatttatttttatttgccatttggatcacatgattttctcctttaaacatcccagtgacattataaatgtcttatgtagcaaggtctttggcttcaaatgccttcaccaggaattaagagtttagtacaccatcaatgaatagaatttacaaagtaccctttgggcagaatcattaaggaattaaggaaagttttttaacatattgagaaataacacaaaaggttctgaaaataaaggataatatgaatatttcatctttgtcttagttttggggggtggggaacacagaagcaatatttcatttctaaaaccatgttcccatgaagctgagcagaaggactgcttataacataattttccagccaaattcccaaagggcccccaacaggctttctcaatttgtgggcgctgtcctctaacaatctatttctttccagactctccttggaaaccaaagatttatgtcattctcttcatattttaaaatgaaattgttccaggttaaagaaattatgaaaactgaaagcctgtctttatccaagaaccaacactgcctggacaaataacttatgaatacatcctattctggaggtatcatcaatgactttgcctctgtagcactcttaccattatttggacatttccagaaatcaagatccacttcagtttgtgaagatgagctgtgcttagacataggcttaaaaagaaaaggtaaataaatattctgtcaggttatatagagggaagcagaccctcccttttataaataacgtatacatttgcttaaactccagagtaaaggaaaaatctcatggactgaaaacattttttaaaaaaatgaatattcactaaacaatcctgaaatgctttttgctctctgaatacattcaaacaagtagatatcacagcatttcattgatagcttatcaaaccacagaatagaacaggaggacagaatacaaagggcattcttaagggagcaccatcatgattgttctgtaaaaacatatgaacatattgctataaactcatcttcacaggaagtcacacagcttaataagcacagacctgcaagttaatattaaaattcactttgatttcagcagcagcaaagctgatccaactaggagctattacataaaacccttattgtcatattcgtcatcaccactctcaatagagaccactgccagcaccaagaagccagccctcagttcacctcaggaaacaggctacacagacggccgtcccagtaacaatgcagcagtgagatggccctgtttattttatcagaatggcactcccttaatttttcagttctctttattgatgtcctttttcatgtacaggtctattagattctacttcctttactgtcctcccaggaattggtgcttgccaactacaataagttgttttgacaacttgtctagctatacaatactctgtttccttccctctacagtctttttggcttcaaatgagtgccttcaaaatatagcagagactatccaaccaaactatgctacaggggggaggagctttctatgtgtaagcaatgtcctgcccaaactacaatctttcatgtgctcatagtcctctttcttttcctatttatttttatggataaatcccccttgctatcttgtctactcctatcttaataaggaatgactgccgtgactacccccatctagctatgccattcaccgccagcacctctgctctcctcgtgtgcttcaagaagaactgattagcactttgcataattaacctgattagcactgtgcataatcaaactgattagcactttgcataattaaaaagaaataataataataacaataataagcactaagtaatatcaaaagctgttagtcccacagccctttggttacctccaagattagttcagtgcagcatattttgcaccttcacattgaaatcttttctttaactcaaaagtcaagaaaataaattaaaatgcttgcaatccacagactcgttatggttttcatatccataccagttaccaaaataatcagtttcttacccatacacatctccctcagtttgggtcttacatattttacccatgttaaaatggagaaaatggggatataaaaccaagtgaatgaaaaatatttagaataacattagaaaacaagatatatgatgcgtatagaagcatagagagagttatatagaactatataaccctcccttgtgttgcttctgggtgacaatgaggcatgtggaaagaactggacaacctatcagaaaaacctggctatgacatttcctggctaagtgatttaactttttggaacctcagttccctcatctgcaaaattaaaataataacaccagttctgctacctcaataactgtaattaaaataataatttaggaaggtgctttgtgaactgcaagacactttacgtacatgaggtattccattctaggtccctaaatctcctatcccccaaattttatttcacaccatggacaatattatacattatgaataataaattttaggctcagtgcagtggctcacacctgtaaccccagcactttgggaggccaaggcaggaagatcacttgaggccaggagttcaagaccagcctgggcaaaacagcaagatccccatctctacaaaattttttttaaaattagcggggtatggtggcatgcacctgtagtttgttttttttttttttaattttttattctcataggttattggggaacaggtggtgtttggttacatgagtaagttctttagtggtgatttgtgagattttggtgcactcatcacttgagcagtatacactgcacacaatttgtagtcttttatccctcacaccctttccccctggtccctaaagtccattgtgtcattcttatgcctttgcatcctcatactcagcaggctgaggcagaaggatcgcttgagcccaacagttcaaggctgcagtaagctaagaaggtgccactacactcctgtctgggcaacagagcaagaccccatctctaaaaaaataagataaaataaaaatttatatttataatgccttaaaattaaaaagttataaagtcctgttgcatgctttgccttatttcttattcagggctgaatgtgactaaaattttgacttggagttaaaactggactctagtaattattgtttccatcacagctctcatttgtgtttctgtggaggttaaaatcaagctgttgctggaaattcacaagagaggagaagaaaatctagtacattactattaatttgggactacaacataagagaattctgcaactctgcttttctccaccctaccatagccaaccatctgttccttaccaacttcgaggcttagttcagttccactttcctccaagaaaccacctatgatacccatagattggaaattctctctttctctctaatgcttccataatattttatctcatgcttccatagtacagtgtactatttattaaatatgtgtatatctatctgatacctttagtagattagctgctcctaaacagaactatgctgcctattcatttttgccccagaaatagctgccacaataaataatgtagtggtgaacactcaacacctttgttacagttggcttaaggaaactggatggtaaactatttttttcactaggcatttactatataattgctaaatgcaagcctgagaaattgtttcaataactatatgctagagaatacaaaggtgtttgacatacccataactacttaatcaaccattaaaaccaaccattcatttattaaaaaatagatagaagtgctagtaaatactaggcattgtgctaaacactgaatacagcattgataaagtttaaaaggaactgttggttcctctcaaggagcttatagtctaggtctctattaagaagttcatattagagaggctggagtggagtagtgtggaaaggaaaccttaaaatagcaagatacacatcatggagccactaagcctctatcaacctacgggaaaggaacccaaataagcagtcagtgttcttgggcaaatcattcattttacaattcatttaattcaagaaggaaaatgctgctgtggagattattcaagtccaaatgttcctggtgaaggtgcttccagtaattctgggaaagaagccaatcccttagttttatatgtaaatatttttaaaacacacacatatatataagcacaaaagaaaggtcaggaagacgtaagtcttttaaaaatctattttaataattttttctataactgtccacaaaagtttgggctttttttgtagccttacattttcttttacacaatacacctgcttttttttctaaactaaatatttcttccatctaatgactctctttattagacagcatctaatttgcatacatttacatacaatttaactgctagcttgtgagaacaaagaaatggctctgtattgtactgaaggacaatactcagtaaaggaaggtataaaaaccaaccagcttggtgactgtgtaagctctttgtttcagatataccaggctccctctttctcttttaacataccatttaaaaggggcaaaaattatttcatcaaacaatgaaaaaaagaaacagccctactttgtttaactgtccatttcctctccagtttggttactacaattcaggggtccaagttccctgaatctactacaatttcctctattatatttgatagatttaatccctttatctatttttgtttcgtgtctcattcctaaaacaacctgggattccactgcgataaagctctgttctgatgctaatttgtgctgccatcggccttgttcccaagcagacagggtagaatatggcatcatgctctccagtgaacaatgcatacacttacccttaacaggttaatagattttattgagactttgggtctttatcatatgaaccagctcttcaaaaagaaatggttttcagcatctactggagagatgatggaaaagaagacttgaatatagggagggaaatggtaaaatagatgttaggggtaaaagagtacttgagtcaaatgtttctccactcagcaatgctatccctttgtaagtctccaaacctgcatgactcttggagaattaaaaaaaaaaaaaaaaaaaagaactgaaaaccagggacccttgactctcctttgaaagtaaattcacatactctgtgatacggggtgagtcactatgactcttctctctgtagctctcatccttgacacatggaaaaggagattatgtaaagcaatcttgaagaggtttgttcagtgttttgtaaatattaacaattattgaaaacacacaaaataactaataaagctgcggtcacaaccaactgaaaataaacactaggctcattcaagtttctgaaatgccatgtctaaaataacacacaaaaaagaaatatggtacacaaaaatgcttcaagattataacaagctatacaaatgtaaagcaggacataagggcaaactgaaaattataaagccaggtacgaattggcaccaaagcctcgatggaattatcatccgtatctgggtgctgcaaatggtcatgggagatgcatttccttggacatatatttaacattattaatttggcctgttttctgcatctgataatgcaaatttacaattttagtgacccaaagaagtgtgaacttgtcagtgataagtgaagaaattctaccactctgtggggctgcagaatgcccacataatttggaacctttagcagccaaacagattgcacaatctcaactagcgatcttgaagcatgtctgattttccacctggtgagaagaagcctgagttatggggactgtatgagtgctggagtgctggcataaaccaactctgccaacttcttaacccataaacaattatgaataatgatccaaacagcatttaaaagaaataattagacactgcactttaaaaaaaaaccctcagtagtgactaaaatctagtcactggaatgagtagtcaggaagttgttgatcctccgaaaaccacggcttagttctaaaaacagccttaaattgcagagaacctgaccctgaccttcaaatcccttgctccatgaggaaatgagactaccgcctcctgagtgctatagtgtctgttctttcagagattgtcagtaagttttacaatacaattcctgtttctgaggctcattagatcttccttatttatacggatttgaggcagtacttgcttttgtgtgatagaattatctgttggtatccgacgtcagacctattttctacactctaacatattaaattctgccttgtttgtttctaaagcacctcttaataccaactcagccaacatcacctgtgctggaggtggttaagatccacctccccaatgcatgttaccacggtgacaaagtagtgacctaatttacacacacctgctgggttaattgggccaaaatgaaagatgatatatatgctcaaaatccaaaactgatttttttcctcaaaattaaatatttgattttttaaaaattagcagtttctaaagctaagtaacatactccaggtgtgcatttgccagttaatgtaccctgaatgtttcatgacacttgaggagcaaaatatattgagtgatgaatacaaatcttttatgtattttctgtgtgcaatgattagtatgagtaagtggtctcgatcactgaatacatggggtgtgcttgaagggtcaggccactgccttaaagcaaacagagacatctcaactgtgccaagttagcacgcagagtccgggccgcctttgaaagtgcaagtttgctttggagaaagctgttctccatagcctgaggctgcctgcaacatctcttagacaaaaacatcacttacctctgcttgacctcttcccacctctttgtattcattcttcccagaccactgagagtttttctttgaaccatattaagttttatgccaagaactgatgaggatatgaacaaatagatactttcagagactgctgggacagacacagcaatgtgtaaatggtatagctaaatgtatcaaaacccttaaaatacatatatctttgattcaattattacacttaagtatttacctgatgacataatcagggatgtttataaaaaagattgtcacaataatattcattgtaattcatgtttactggagaaaaattggaagcaacttacatgtccaaaaattagagatcagctaggtaaattataacacatccattgtatggaatactatataatcaattaaaaaaatcatgtcacaaaaaatattgacagaaacaaatattcataatatattgctagttgaaaaatcagaatcataaccttgcataatcctatgttgttgcatgcacacatacatatacacaccaaaatattaagaataactttttctttaagtggtaatagtaatatcaatggtgattttcttgtcttctttctgtctttttgtgttttccaaatagttttacactgatagcgtactacttttagaaaggaaatataaatatgatattaaaaataaaatgaagagtaggaaaaaagttaaatgacatttcctaatccctctctcctacttagatttcacatttcacctatatttacttctctccttgtcaactacagatgtaaatataatagatgttaaactggtcaatgttcttttattactgaatattcaacttttctagctgaatggatctttcacttatttacaaatcttacaaagatgtcagtcagcacaactcttagaaagagtctccaatctgctttttatgcttacaaaaaccatgtgaaataattgccttttaataacaatgattacttgaagtgaacttttcaaggtacaaataaatctatttatcaccaagctattgtgtcccgcttaaattacaactttcacattttgatttcatttgtacagatatagggtcttactgataagtaagtgcttttgttaagtaaataaaattagtattaccatatgaactggatttgctgttaaaagtatctcactaggggtttgatttattctatgatggtttcactgatttaatcattgcttaaattagcaaaatataattatatatttttataaagaagatgttttcttgggattttcctatgtcaccaagaatagacatcagggattgataagtaataagaaatgtcaattttaaaattacatttcttggtctaatatgctttctttttaccttagtgatgatcgctgccttcctaaaaagttcataaagcttcagaaaaatctaaaattcatgaaatttcaaagaattaaaaaaattggtgcttttatttcaagtgataaaattaaactttattttcattctcaaaaataagttttggttgaatcaaagatgtaaatattaagagactaaatcataaatgtgctagaagaaaatctgagtaatttttctggtgtaagaagttttctaagccataaaggaaattattgaaaaaatgaaactacataaaaaatttttctacatatacaaaactcaaaaagcaaattaataaccaagaaatatgtctaacacatactacagaaaatttattttccataatatacaaagaggctatacaaaccaataaaatatttttaaaaactcaatagaaaaatacagaaaagtattatagccaattcacaaaaaagtaaacaaaaatgtaaatggccagtgaaattttaatatgttgtttaatctaactcctgagtaaagaaatgtaaatcaaaacaatggtgaaatatcattttcacttttctgattaggaaaaatttgctaaagcccagtactgatgaggctgtgagaaagcaggaattctcatataatgttgttacatgtgtgtgtcagaaaaatgtttttgaaggaaaatttttaacaggcatcaaaattttaattatataaacatatctaagaaagtatgctatgtggatattaaaataaaaacaaggatatatttagaaagctgttttgtaatatttttaaacagcgaagaaactgtaaataaccaaatttccataaataggcagtggttaaatacattttgtgacatccataaaatggaaatattaagtagctgtttaaaaagaggaaaaggtaaaatataatataccaaaatataaacactataaaatttctagaatatataaaatctctaagacatggcattaagaaaaaagtacaaatgtatttgaacagtatgattccctttctgtttttaaattaaaggtatatagacacatttctctacgcaagtacagttgaaactttttatctctggtgaatagtgctatcagtcggtaaagacatacttttcactttatatccttgtgtaccattcaaattttttaaccctgtgagcacattttaaaaatacaaatagcagaaagattgttcagtgtaatggtaaatggtgaaaggtatatacatggaagtaaagagtactgcactgttaaatttctcattctagacttctctagtcccacagtaaatcattcaacttcactgggatttcatttcctcatttgtaaaataataattaaattagctcaaagaataatctgtaagttaccttatagttctaacagtacatattttcatgtgttaataatccaatacagaatggtggaaaaatatgtttgagacttaaatatcaattttgagcacctgtacctactacaataaacaaatctctacttggtattttgtatgtagactgtagccatgtctttatgacaaaaacaaacaataaatgtactgaaaattttggctcattgaataaactaaatattatcttaaagaccatccccatgcacaagtacctctgggtctcaatggtttagttctgccaaggtgttgaaacaagactatcaaacaaaactgatcagaaatgtattacttacatacttcactgccaacttaaagccacaaccacgaagctgacttgttgaatctaaccttgattaatgctctcatatatacaaaataatgtcaaaatatcaacattcatttataattcaggtatatattgccacaagcactcttaatatgtttttgatattggataacctgatagtgcatgctcacaagttaaaatagtaatatccatcttgtttttaatttgtggtacttgaggcttcagtataataatggccttcttccattgtgacttaatattcctatcatttggttatatatttttaaagcaaaaatctctcgatcgttattcagatgacaaattatatggtcatatctgttagatacagcaaagtctgcactgtggtatttctaagaaagcaagtagttcattccttcatttctgggttccattgtgataaggacagaaccatgggaatttccttggtaagattcaaggggtataactggtaagaatggtgtgttctttttttttttttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtgtcgatctcctgacctcgtgatccgcccgcctcggcctcccaaagtgctgggattacaggcgtgagccaccgcgcccggccggtgtgttcttaatcacacaccataggtacatttgtaaattaggatgtggctaaagcctactaaaaagtatattgatagatttttagtatctgtagtgaaaaaagttagattctcacatctaaaaacctcacaatttctgaaactgtcatctgactgtgtttttcaaatgttcacagtagacggcctacttccttgtgcattttttcacatagtatcagcctgggtcatggtaatactgttatctggtataacatcgagcaatgggaaaataatgtggtgaatgaacagttgattagacacattaaactaaggaaaattcaatcaaagatcatcagtttcaatgatttactaccatacatctttgcttagctatgaataaaacattttgaatgaagcttttggtgaaatttctgtttcaagatgaaagtagaaatgagaaaaatagacatcctgtgctcacctcaaatggagagataactatatattccgaaaaagttctatgttaaatcttgggctcctatgagactaataaaaaaaaataagtttaacccttcattttcagtttcagtcttgatatacagaaaaggaggaaaagggctgatactactacttgaagaagtgatttgcgaaagggagaaatgatggctcaaaaacccctgtagctcctctaacaaaccctggtaccagagcagacaatgaaattgctagggagagctaagagtagcaatgaattcaatccctccctttgtggccaaacttagttctgctttcagaaataacaaaatttcaggagatatggttaaaatttataggatatggcaaagtttaaggagatttggttaagcatttttaatccattcccaaatgcttactatggctatatttagtaccaggataaagaggaggataaactggttgcccctgaagaagcagacctcccaactgtacattgttaatagttgacagaacactcctcccttgccacagctactctaatacacacaaaccttggatgcacaactctgtgtaacctgtaatgatttagagattgcatttcttgtacacaagatcttcccttgaatggctccttcacgtcattcaagtcttataattcaaactttatttcctcagaaaggacacctacaccctgcctccggattaccagccattcttcatcctttttgttgtagttgtatgttaatttgtttagtgtctctctctcggtcttctagttcagagctctgtctctagtgcctgagatcaactgaattgtaattatttactcatgatagaagagtaatcaacaccagaaagaaatctgctatctaacaaaataatagtttcttcttttttttttttcggcaacagatacaagacaaactaaaacaggttaattcaattaatgtgttttgggtgcaaatcccagtttggtattatcaaaggcatattttcacatttaactatattatcatttcagggattacttaattttcattttcatttctatttcatcctttcttttctggcagggaagcctaagctcatttgtaaaatttttctgtcctctgagcatacaattatattttatccagaacagaagtgcaccaaaagagctgaaagttaaaagaaatgttcagtagatgagacctataatactggttctgattaattaatataatcactctattaattatctatgtttaaaattcaaatttatctatgttggcttattgagcattcttaaagaaaacatacttgtaatatcctacaaccatgaggtggaaagggtcagcaaatgcttccaattatatcccaattattttaggaatggtttacttcaccttctgctccctctacccactcaccctaatagtggtctgctccttacttaaaaggggaaaacacaaagatttcctgcagtttgagaatcaacttgggagaaatagaaaaacaggtgtctgagttgagcagagctgagtttagtcctgtgtcagccatttactagctatttaaagttagaaattaactttctgagccttgggcttgctcttttaatctagacctggatattcatgattccagtgttcatttaatggatgtgtatttgtacgtatggccatatccatagttctctaataaagacctggccgatgctaagcagagaaattagacggattgtgatctcaacatgcagtcatccagcacaatacttttgtccatctacgacactaaatttcaattgtatacttggcttatattatctggagatcattacgaaaaacattttctgcaactcttgatttacttaggtcacaagtaaagttatgtgaaagtaccatggactataagagtatatttggcatctcaacacacatggattgacagaaaagttggatgataccaatgtcagtttttagttctgcagtccatctgcagagttagtgactgttggttacctattctatgcctcaaccttgtcatctataatgagaagtttcagtagtttaaaaaagtatgacagaaaatgattcataattccatgaaattcataaaaaataccaaggtgctaaggctacaagtattctaaaaacagaggacaggataaactttgtcaaataccgaggggaaaaataattaacatgttagcatatgtcttagtctgtttcctgtcgcctataacggaatacttgtaactcagcaatttataagaaaggaaatttatctcttatagttggaggctgggaagtccaaggttgagggagcaaaactggtgaaagccttcttgccgtgacaacactctagaatcctgagacaacgtaggacatcacatggcaagggggcagactgtgctagcgcaggtctctctttatgtttctataaagctaccagtcccattcccatgataacccagtaattcattaacccaagaaaagactcatccattcatgggccctcatgacccacctcttaaaggccccagctctcaatactgccacactggggcttaactttcaacatgagttttggaggggacaaaaattcaaaccatagcagtgtgtaaataagtcttccatagatatttactaccaaaaaataacattactctctatagtaggttgaatgttgactagagtccccaaaatttcatgttcacctggaacctcagaatgtaacattcctgggagatacggtccttgcagatgcaactaattaagaaccatgagataaaatcatcctggatttaaggtgggccctaaatccaataactgatatgcttttaataggaggagaggacacagagggacacatacagaggggaaggtgctgtaaagatgaaggcagagtttgacgtcatagtgccaaaagccaaagaataaatgggaccatcagaagctggaagagccagggaaagattttcactgtgagccttcagagggaatgtggccctgctgcattttgatttctgatttctagcctccagaactgtgagagaataaatttctgtcgtttttaagtcacccagtttatcataatttactacagcagccataggtaactagtacactttccctgtactctctaggactaaaacagaggaagacatacagaagttttataagtgtaaatagtgatctcaaagcccccaattgataggagcacataaggacaaataaaaatcaatgagaaaacttaagaggttgcagtgatggtttctggtagtagtaagcctcaaacgaaatgtactgccctctatttggagctgttccctcttaaatcaaatgcagatgccctccaaaagtgatgcaacatcttctgatccaatcctttcaagcaagccagaaactgatcttaacgtggaattggtcattaaaaaaaaaaaaagaaagaaagaaagaaaagaaaattaataggctgggtgcagtggctcacgcctgtaaatccagcactttgggaggctgaggcaggaggactgctggagcccaggagtttgagaccagcatgggcaacatagtgagacccccatttctacaaaaaaaaaatttaaacatctgctgagcatggtggtgcacacctgtagtcccagctactgggaagctgagatgggaggactgcctgggaggttgagactgcagtgagccatgatcatgccactgcactccagcctgggtgacaaagtgaggcctttatatttttaaaaatccaagtggtatattgatgtaaataattaatatcttacaatgatatatgatcaatagcaaaagtatactggaaattacttaattggacataaatcagttctcaaataaaaaattatttatgttcctgaagaacttgattcagagagtaaatatacctatttttcatcaatggaaatttaaatataatatcagtaacaaatttacatagaggaaaatcaattttattttggtctagagtatatactatcatgagacttggcaaagaccctaataagtatacagatcacggcttgaggcatcagatcagcatgattaaagattatgtttgaattgtctcctgatatacaaaattaaccatttcttaagtaatactaaactcagctatcctatttgctacacaaatttaagccattatagaagcaacattttagttaattttcaatatctctatttactttctgtgcatatttttatgtacttacacttaaatcttaactttcagatagtcctaccttatttaatttttttacctttaaaaagtcataacctgtggtataatcttcttttgatatgcttaacaaaatataacaatgaaatgtagtgtaaaaagtttaaatacttttaaaaatatatttttaaatagcttaagaaatatattttgaaaatatattttacacaaatatgaatgtgtgaaatatctattcacacatttttaccctaatgcacagaaatcctttcgtttagaaaaatagaaattgtattcataatttcccttaaagactctcaaaaccataaggatgatacatgcagatattaactattagatattacatgtttaaagcaggaaagaatgaaaacgttaacttcctagaaaactgcaaatatcaaattctttttcttttggttttttaacttaagagttgtgcattaattactattagtaattaattagtcaccaaatattctaaaggtgggaacaaaaggttcttacaactcagagatgaatctatttatatttgactttttttctcagacactggtctcctaacactttataagttcaataagatgtgaatatagataattagggtattcctatataatcaggtagaaagtgaatacatttgtgtcagtagctacaataatttgcattaaatgaatgagtgaataaaaaataaatcataaaaaggcactgtttgggattggtataaaacatttacttttaatacataaattattaatattaagcagttatattacaaatgacagagaactgttattgaggtgcaaataactcaacagtaaatattagccatgactaggttatagggtgtttctggaattcttgcttctttttagattagtataatgctctactcaaggtgtagagtaaatctgcaataactagagcaaataataagtggtagaaaaaaaaggatctatacagaagaccatattttattacatggtttcagaatagcattatgattatgatgactaatgagaggaggaagaagaagagatgtttttaattttaaagtgctttggtatgttgtcatctctaatttacagatgaggaaactgagcgtaaaagcacacgaagagctgcctatatctcatagccaataagtgataacagagaaacttaaatccctctcttctatttctaaaccctgtactctttctactctattatattgtctctttattccctgaaaccagagatatgtattaacagtaaaattcttaaatactgcagttaaaatagaaattcctccaagccagtgttgaaagcaccacagtatttataaaaataaaaatcagcttcttaaaaaattattgttcttaaataaatttaaaaagaacaaaatcttctttgagttcccctatattcctcatacagaatcttggcagtgataatctgcaccgtaaactgtgaagtaaattgtgtatgtgaatgaaaacaataagaacctacagaaacacatgggagatctaactcggataggatggtctgagtagcgtagggacatggatgaagctagaaaccatcattctgagcaaactgtcacaaggacagaaaaccaaataccgcatgttctcactcataggtgggaattgaacaatgagaacacttggacacagggtggggaacatcacacaccgggcctgtcctggggtggggagacgggggagggattgcattaggagatgtacctaatgtaaatgacaagttaaggggtgcagcacaccaacatggcacatgtatacatatgtaacaaacctgcacattgtgcacatgtaccctagaacttaaagtataataaaaaaggaagaaaaataataataatattatcacatttcacagagtttacagtctggcggaggagaaaaacattaaactaataattatataaccacttatttatttacacctgaggtctattcgttatctttgactatgccacataattccaatctgaactcacttgtatgcattacttagcttggcgatgcttgatgttctcctttctatttccttatgtcctatgcttcatgtttttttcaaggcccagcttaagttcagcctcttcccagcagttcacagagatctctgcctccactaaatatctttagcacttaatgattctttttcaacaatggcaaatgggtttcctattacatgaaacttccaacaattggtatggctgtcaaagtactgtcttcagagggactctgaggtcaagttttggtgtagtgacagagacagccataatggattagtgttgtttcatggacagtgaaggggagacaggggatgctgaatttagaacattgacttcacaaatagactgcctaacttaaaaaaaatgtttgtagcatttattttacaccaaatccaggtctaagcatgcaatttgacactgagagtgccttgttttattttttaaaaaacctgtatcatgtctcctcaagtatcataagattcttgcatgtaatacttctctatgctcacagcatgtagtcatgccttgaaacataggcatttgctgatgacaataaattaccattttagaattcactcttattactattgtgaactccatttatgtcatagcttctctcaaaatattatcaatattgaacccattttagaaaaactttgtaacataagctataaaatgtaagtaaatatattgtctttaccatgaccagattcaaattcaacattaggatattgataacacttaacgattaaatatatacctgccaaataataaaatgaaacaaagagaagataactacttcttaaatgagtttaaacattttttaaaaatccagccaggcgtggtggctcatgcctgtaatcctagcactttgggaggcccaggcaggtggattgcctgagctcaggagtttgagaccagcccgggcaacatggtgaaaccccgtctctactaaaatacaaaaaactagacgggtgtggtggcgggcacctgtagtcccagctactcggaaggctgaggcaggagaattgtttgaacccaggaagtggaggttgcagtgagccgtgatcgcgcctctgcactccagcctgggcgacagagcgagactccatctccaaaaaaaaaaaatatccaaatctgtgtatttcaaaatatattttacatacttattatgtcctaaaatttgtatctctcttttagtatacttcattttcctgcacatagtaagtgttgaagaaatccacagtggttagtttagaccttattttagagagatagctccattttacattccgtcttgctaaggaagtgtattcatcatattccataacagctcacagtttgttatacattaactgcttattctctgtgccaataagactgtgctggaacagcaaataaatttggtgcattcatttaaatgattctgcaaaccacaggctacccagttgtctaatgataagagagccccaaagccacctgatcaccattatactcccttatttttttggatttgcatggtcagtactgtcaggatctgaatacagagaagaatgagaagtaaaagtatacctcagacctaatcatgaaaagggattttattaatttcggcaccagtgatgatgtggctaggttggaaggggaatgggatataagatctggagtgctttatctgctccaagaccaatgctggttttggcacttctctcactctagtgagttgcaaaaaaacaagcaggtgctagcaatctgagagaccacatgccagctacagctgcttcaaactgattcaattacatctgcctgaatagtcccaggacatcaaactagttgaagagatccataggttgcaaggagactttgtctatcctgatggacaactgtctctgagataatgacctgcaaatttccaggttgtgatataaagtgatcattccatcaccaggcataagagaaaagatgggggaatgcgatgttttattcactttaaaattaaaaattggttgtagaaagcacaaaggcctctttgaatttaaatctgaaagtcactgaggccttatggataccttgaaacagcccaattttgtgagaacatttcccaaatcattgggtacagcacatttacagaacatgctcttgggatccggacttcgctccaaaccttgtttgtacaaaaaggggccaagcagctgggaaattctggagtggagtgtgtcctcattagttcccatctgccaccagaactcagctcatggcaagtttggctaagtcctggtgtactcaggtccaaatgtgggtcagttttaattacactatacagaattcagtgtgcagttttaaaatccttattatacagcacagaggaatgggcagctctccagctaatcaattttttaaaagtacatatataaaaattttaaaccaggctagacagacagtgggtggaaaaaaatctttaaatgagtacaagggttacttaagagaattattagtgaaattgggtcatgaacaagttctgctttaaagcttcaaagtgagaaacaaactgttttcattggtaagttggaaaacttatgtaaggtacacaatgtgccttgctctttagtgtgaataacaataagcctgtggccagggtacacaacacacctacaagtgaactggctttcatgtaagcagaaatgttcccaattttgtgactcttcactccatccccttttgatgtttatcacttatggcaaagactggataaaagaaaaaaatcacaagctacctggtaaatagtgaaaaaaaaaagatgaggaaggggagggagtgagagaaaaggagagtagaaagcacaagtgctgagtagcagactctgggcatgacttgtctctcagtgccatccatacaaatgggggccagaatcaacgcttgcagtctatgttcagattccatcctgtccaaaagctttatcaggttcaggagcgctaaaacactaagccttcgaagacaattgtcagtaaaaaattcaggagtaaacacgtcggcagtcagtgattaggcatttatgcaccatttttgatagataaaatgtcccttgacacaagtcctaatgacaacaacaacaacaacaacaaaacacaaaaaccttaaatgttcaaagtatctttgggcttttgactgagtttttatcaggtttatccatttaaaagcagcacgggatgctaggttcaaataccagcattgaatatttacaagctatatgactttggacaaattgcttatcctctctgacattttgttttctcacctgcaaaatgggagaaataacatcttcctcacagggctgttgcaaggatcataaaacatatatgcatacatatattggatattacatatctatatatacatacatgcatatatatacatatacactcacataaatgtgcatatgtatatatatagcatctggaacatgaaagtcactcaataaatgttaactatcattaacccagttatgatgaactaaattttgttccccaacccctccaaaaaaaaacatgtgttggagttctaaccccaagtacttccaaatgtgatcttacttggacataggtctctaaagaggtaatcgagttaaaataatgcaattagggtgggcctgaattcaatatgactgatgtccttataaaagcagagaaatctggggacagagacagatacttacagagggaagacagaggaagacatatggagagacataggaaggagatggccatctatatgtcaaggagaaaggctggaacagatccttccctcacagccctgagaagaaccaacctggctaataaaccttgatttcagacttctgaactgtgagaaaacaaatgtctgtttaagccaccaagtttgtggtcctttgtaatattcccaactaaataaaaattccattaatcatcaatatttaccttgattcatcatggtcgaaactatacatttgatattaggcaggtctgtattacctctggtgagtaataatcaattctatatatattatctagtgatgttttcattattttaaaagaatccttttctgattgctgtacaagaagatactgctgcaatataaacagcctggcagaggaaaatggtttactataattaagatcatctagttattattaaagataattaagggaaaatcatacatataaattcataaatccacttttctactgttgagtttgcatagaaggaaatcagaaaatcttaccacactaatttccttctcaagaaaaaataaaaccttacacagcgatttatgcactgacaactatgctcactaaacctgaggctgcttagattaccaacaggaccacttttaagtcattttgatgcatatgaaagtaactcatcaagcatgggttcttcatcctttgcaagagactgcttttaaaggtatctgactttcagaagagggatgagagttgtctgggttgtgtcaacacgctttctattgcaagacatacctccataatcaacagacattgaagtgaatgtgagcatccccatcttaagtttttctttaaacagccctagccttctatagaaatgtggcatgtatagttagaaattatgagtctaattatgttgaactgagataagcaacagatatcacaagagccataattggaccaaagttaactttcttaatgtatgtgtcccacacttccttgaaattcctatactactgattataaaaatttttatattttgtcaagagaagagaggaaaaaataatacacagagactactatgcaataatacataggtggtagtggtgcacaaaataaagtattttgtatacctaatttactttaatccacatatccaccattaaaaaggtaggtgttgttaccaccatactatacataggaaagcttgaggcttagtaagctctgccaacctcgatgaggtcgcacagctactgaataatggagctagacttttggtaaaggtcagtgggagggaatccaaagctcctaaattcaaactcaagcatgagatttacaatccagatatcctaagtgcatcactgggttccaagatggtgatttatttaaggaattcacaggcgtgttgaaagcatttgaactcacataagcagtagatgtgttcttgctaaacctaactcaacttattctccttatgaggaaatcaatgctattcacaaacacaacctaaaaggctttattcaatttaaatgaaattaatcttattataagaacacatgaaaatggaattaccatacaatctagcaattccacttctgggtatatactcaaaagcattgaaagcaggttctcagagagatagttgtacacctatattcatagccaaattgttcataataattaaaacatggaagcaatccaagtgtccactgatgagtgaatggacaggcaaaatgtggtatatacatgcaattaattattattcagccataaaaacaaggaaatcctgacatgtactaccacatggatgaatgctgaggacattacgctaagtgaaataagccaaacacgagaagagaaatactatatgattccacttatataactacatagagaagtcaaaatgacagagacagacactaaaatggtggctgccagaggctgggggtgggagtgcagagggaaatgggaagttatattttaatgggtatagtattttagttttacaacatgaaagtgttatatagagatgtattgtggtgatggctgtgcaagcatcataaatgtatttaataccattgaactgtataccaaaaaatagttaagatagtaaacttcatgttgtgtgtatttttcccaaatacaaaaatttggggaaaataataaaaatatcacatgaaggtcttttagattcagtacattgcttcatgatttttataatatcttctaaggccagggaagcagaggtaactttgtatagaacctctgagtacaatctatgtgataatgcccaaccaggatccctgctcccaggcaattagatgttcttttttcagagtctaaactgcagtagtggtgatggcgagggaactggtagtgatagaaatgacagtagcatagctaagatttcttcagtacttgctatgtgccaaccagtggaccaagaatcttacatgtagtgtgttattaactctcagacaacagatactattattttcccagttttacaaatgagtaaacaagggaacagaaacattaggtaacttgattgagaccatactaataataagtggtgaagtcaaaaagaactctattgatatatctttgtctctcactagcctgtatcctcttgagaacaaagattttgttgtattcatctagcctagcacaatttctagcaaacagcagacatccattcaccatgcagaataaaaggaaatgaggaaaggagagagggaaagaagggggaaaaaagaaattatatctagtcatgctatgttcttaataaatgtggattttctttctttatttccttaaccctgaaatcgcaggggaacctgcaataatgctcaggaatcctagggcataggaattcctccctctttgagattccaggctaattcctgacacaggaccctcaaaaagctgctaatatctgtctagtttaatgattaatattctagcaaatatatattcttggctcatctcctaatttctaatattgagactaacagagagatagagttcaatctaccacactaagattcactggaaaaaaccgatgtctttgatattggcctcttgcacactggtgtgaactgaggtaaaagaaaaactgttcccagaggaaaggtagttccatgcctaaaagtacatgtgtcataaaccagtggtactaaaatttgagaagcctaaacaaaaggttttaatgcaatagataactggcttattatgtaaactgtgccaatcttatgtgacgggcttatgccacacaaaacggaacattagaatgatctatctaaagcaagtcttaactgttctattttgactctactcttgcttggctttacctctatttataattaaaatttagtgagtcatagagaccataattataaacatgtatacagtaaacacagggtccattacttttgcttagaaaaataattacagattttttaatattctgatcttaactgacccaaaggaattaaacacacattttatttttgtgttttagtgagatagagatagggagggagaagcataagccagtgctcaggaaagacgaggcattaaccatataacatagatttgtttatttatgggctgcaaagtatttccaaggtgacaagtaacttagccattaatgcctcagccttatgtgtataatgggaataacatacagacttcttgtaataagtaaaagttagtttaaagcacattgcaaatagtgttatttcaattattcattaaaatagtcaaaaaggatcagttcttatacattaatttctcattttaaggacagaatttatcagtattctcatatctatgtaactggcagtatgagaactaaaggccatcaagacttatctaaactgtataacaagtaataagattttaggacacaatccctctatttctaatacaactccagaaatgttttattcataaatgcattcattcaacatttactgatcaactactatgtacaaggcattgtataagaggctgtggcaatcctctacttacctttgtactgtgtttcctacttccaaagaggttaaattaataccaaagtgatttgttaaaaatacaaaaaaggattccaaatgggccaataaaaggaaaagacacaccaactctaagaccagatttatgttactaaataccgacggaaactcctcagcatttaaaagaatacattaaggagagtaatgcaagtcatttggatgttttcaatatgagaaatttgagcctactgaataaattaattaaatatctttaatattgagttgcagctttttattgcatttatagaactttacctattagtaaaatatacaatctataatagcttgtctatatcaaaaatatagatatctgtcagaaaacatacaaagccacaactaaaatacatttaatatcattaccagtaacatttgtgaaaaaataccaagcatctagcatttgttaaattaaagaataatattccataaaatctacatctggattttagcccctcttttagaattactatttaatcttcactttttttctctctcacttctaccccaacagcaacagaaacacatgcacaaattaaggaattatcttacaatatacccttaaattttctgaatatgccccatgtgtccactaatagccaaatgctttcaaatctgttcagctaaatggatcaataactacatccagcctcacatagtggggctgccaacacggtgaaattgagccaaacacaaaatgtctctaccaggacaaaaattattatcaacccagttatctgaagagatctactctcccagatattctttcgagaagttggcatacacattatctagggcagtcaacagctactaaaaaaaaaatatttgagtcataaaacagaggatttaaagaaaatattcagaagctaaaaccagtgagttttagaataaaccaatgtaacagttcaaggtctacatcaagtaagaatctttcagagtcagagtacacaaaacacgtaagagcacaagcacactgctaacaagcttctctgtgctctcactcatatgacacagctgcaagcaacaattgagcaggtgcaaccaagcttttgagaattcctgcctgttgcccaggaaccacaacactgcatggttgagattttaaacaggtgcaaacatttttttttcccattcgtctagtgcttgagacagtggagcagacagtacatctgcaaccactccatacctaaagcaaccatcacagaaaataaactcaaaagcagcaaaataaaaaaaagtttaaataaaacaataatggcaaaactgtggttttgcaatggtctgaccccacatcaccgttcactttaatagtacaattccataaaataatctcttcaccagatgaatgctttgtaattaaaattatttgccttatcaaatcttagaaatgtttacttgattcttacaatagaataaaataaaatatatgtataaaatgtactatcctttgaagctgtcattatctgtaagtaatcaagaattaacatttttacattatgaaatctataagcaattttaatacataaaaatattataacttgttagttaatatatagatttacatagttataggtaattcatatacatacctgtgcagctatggggcacaaacttgcaattcatcaattctgaaatgtaaaagaaatatataagtaaaaattaatttactaagttggaaccagtatttatgttgcaacaattcctgcagagaagtaggaaaagtttcagtgcataaagaggtaaattattttttatcaatattttccctataggatatttcatatatctgaaaatatatacacacacacacacacacacacacacacacacacacagagtcccttagcagtgtatcataagcactagcaagggactctgactcaccatggcctctgaaactcaaatgctttcactagaggacgaggcaaacactttaaaatgatttttttttttggtattcttccaagactattgccttcctaatacaaatatgactgctgctctctaaaatgaaactactcagattcatctgcactcagtttggatagaatgttgttaaggaagaaaggtgcttttgtagagcagtccacaaaaaaatgcatgaataaatgaaagtaaactttgaatgttcgttaactttgagttacaacagcaaatagaaatgaaattgattgctacaagaaggaatgctaacaccacgtcggatataatgcaaaatgcctcaactcaacacactttgacaaaactgccagcgaagtaggtattgatacagaagactatgtaagtccacattaaacaaaagtagcagtttacaattagacctgaaaaacatttggatttaggtggaaactgtattgcaacatacagcctgggaactactggtactcttaaaaatatttcctagttctagccaggagtggtggctcacgcctgtaatcccagcactatgggaggctgaggtgggctgatcacctgaggtcaggagttcgagactagcccgagattacgctattgcactccagcctgggtgacaagagagaggctccatctcaaaaaaaaaaaaaattctttttgaaagcaaacggacatgtttaatttatatagttcttctgagcacagtcgattacagcaacacattatagtcagtaagtccactttataatactgcttaaaagtatatagaggtaataattttgatgatggctcaataaaacaacatcttcgtatattctgatgggaatgtggattacaaaagactttctagaaacccactgagtactatgtatcaagaacccaaagttcaatatttttactcagtaattttagtcccaggaatcaaatgtaatagaaaaccaacagaaatttatgtaaaaaagataatttttatgacagtaaaaaactataagcaacctaaatatctaatagaaaaataattaaataaagcatagcacatctatataaaggaatatttggcaaaatttaacaaggtactttaaagaatattttaaattttacggaaaaatgcaaatttatagtattatgatgctaaaatattatataaacatgtagactaccaattacatggacagtatgaaattatgtgaataagaaaaaacaaagaacaaaacaaagaattaagagtgattatatctggataataagactttggatgattttaattttttctttttactttcatatatagttaattatctacaataagcatgacttttataataggaaaaaataatagtaggtagggtaggggtaaaaggaaaaagttataaaatgctatattgaattcataaatgtaaccttcctaagagaaataaattaattcagtcacaaataaaacccagtaactgtgcctacagtgagaaacaccctcactgcttcctcaaaggggcatagccagggtcttttttatcccagtgctttggaatctacacaagtaattcaataacacatttttaaatcatcttagtaaaacttctttacttattatgcagagtgaaatgatggcaagaataatttaggacttcaaatctcttcaacctagcacagcctaacttattcactaattcaatcacattcagtgagcatctactgcctgcatggtgctgtgtttggcactgcaacgtgctaacagataaattaggacacaccttaccctcattgagctaacaatttaaaaacactaaaaaatgtttagacacagctcacatgaagaagtaaacacaatacagttcaaagcatttgtgacagatttggtacattttaaagcaagaaaacatacactaggtttattttttatatttctgagcaaacacctatctttaggtaacaataaaaagtcatgtgtattagtatcacttattaatgcactagcaaattaagtatttaagttttttccttatgtgatctattttttgttaatggacagttacataataggagattaagtatgaaggaatagtgacccaatctggaatgcagatgtgtaagattgtctcagtttatctgaggccacataaaacacatgcacaattattaacaggctgcagttatttattggaaaccaaagcaaataagttagttactggttaatcctgctaaaagacactgttatgacaacaccaccagggaaagaaaagaagatagagcaaaccacttttgttatgcagataaaatgattcagcatagagattctctcaatagcagttcagtttcctgctggcctgtaaacataatcagcaatgcccttctgaggccagtgctgcaggattattccaatgtgaggtcaatggggtcaatctgtgtgaagtggtgacaaacactaagagaaggtaagaagctatttgtgtgatcagtgatccatagactggggctcagagttctgggaagcagtagagttatgaggtagggtggtagttaagcacttagcttttgccatcaaacaaacctggaatcaaattccagctccccatctttagttctgtgatcctaagcaatttaaattttctgtctgtaaaatggtgatcatgttactcaccctacgaggttgtctatgcaggttatatgttatagccatataaaggaactagcacagtgccagccatgaggtaagcatttgataaaagggaactgttagtactatcatagttgtatgaaaagggaaagcatgtctgtccctttaagctaaggaactaagctaggcaaggagtaaggagataaagaaggcttgttgaagacatcaccctacagtccagcagctcatccaaaagccagtcatgtgcttgatgttcacagaacatttctgaatcaggcaacactgcaacaatagtaatagccacaataacaattctaaccagcacttttaagctccattcctatgactgaaaagaaaggcagtaaagtctaaataatacgtgcagcaacactgccgaacttctctgggtgaaaaatgaaggatcactttccacatttaactgaaacaatcaggaaaaggaaaataaggacaaaatgaatataattactcaactggaattggaccaaggtgccgtgtaatggtcttagcaatcacatgtaggcacttatcacctttttatgtattctaaggagatcctgcagatgaccagagccttatatatgaggtttgcaactctaagtaaaaaaaaacgttagagtcagtttttttcttatggctgggaagacagaaatggatgcatactgatgttgttctagtccttatttgtgttttgatttaaaggacagcacagatcctgagttgttaagtggcgtgtcttcagattcccacacagttcatgtaattgctagagttgtttcactcgcattgggtgaagttactattagcaccattccagatgcagatatactatagagtgtttgtttgtttgtttgtttgtttgaagttctttttacttctaggttggcatagctgtgttctccagtgggataggtccaattctatgttacagaatacagaaatagttcatcttcccttcatactagttgggcctggctagagatgccccttaagccattaataaatctacttgctaattcacttagagtactaacaaggatctcacctgggcctgtgggtacaaccactccatagaagagctctaaacctaaatttaaacaaaaagaatttcacccatgactgaggaagcatccacaggactattttacatgctttacatttaaatttgatattttgagagaagactatgtaattcaaaataattttattttatttaatatgtatttagtccttctggacccactacagagctggatgttgtatcattattatatggttattataaaatgtacactttactcatcaataaagccaattttacttttgaaaattgaggtacctggcttctgtggtttctctcaacagaaagtcctatgaagagtaagaactataaattgtcaagtagacttgaaaaacttatgcttattttgtaaattactgagctaggtctggcccttcattttgaaaagctatctgcctataagaaagaggaagtatgaggagcacagttatctattaatcaacactgtgaactggaaacagataaagtgcaataaagaaggaaaaggaaatcatatggtaaacaccgttaacccaacggcacagttgatctgtctagaccttaggtcagataagctgtaataaagctataaaatccacgaaaaactaaagcttatttacaaaaactgcaaaatttgaattttctataattaatgccacttaaaatgaaagaatttaatatcaaatttcatgtataaacatgataaatttgaactctcaagtagaaacctcatctacaatacactaagtgttaataattctaattgtcctataatccacacttcacagcatattctagagaaaatagctgttgggtttttatgacttaacttaaacttcacaacttttaaaataaaagtttaagagctaatttaaaaatgtatttaagaacctaaaatttagaaaatattaaaaattatattttcaaaatatcctcaacttgaagttatggctattgaaatcaatgatttattctcagaaaatgtgaaaattttactggcctgcttgtatacatccctggggtcttagtttagatattatctcctccagaatctgatatcctgtgtctaatcctgtcataataatcattttattgcactggaattgtcttttacataagactgtaaacttggggaccagcatttgtatcttattcaccattacatctgtagtttttacttagcacagtacataatgtgtggtaggtaggtcttaaatattggctaaaggaatgttgcatgaattgtgttagcttgtattcttgatgattaagaaaattcacactgcataaaaaattaaggaatcacattcgtaaacaagttattcccaatctttaaaggactaatcttccaatctattttcttgtgctttttctacctatttttcctcttaatcagtacaaacttaaaatatgagaatttgagtctcaaatgttaacaccaggttagaaagcctcgttagtttggccccacattggacaagaatgagttgtccaaatcctacctgttaacagatactcggtatggaagaaactgttacacagagttcactgaaagagttctgcagttcctaaccaattatgtggttcttatactttctctaaaaaacttcttctagctatagttcctgagacagatacctccactattttattcttttgtggcatatatgacagtttaaattattggggtgattattggcttatgtgtttattatctctttctttcccactagattgtatactccatagaggccacactactttattcactactctatacccagggtctagtttagtgcctgacacacagtcaacacttaataagtatttgtcagatgtataagacaaacatgagttcaaaaatatgagcagtaaatttagagcagtagctttcaatcaagagactataaaagtaggcagttaacagctacccctaaaaagtgttttcatttgaactctgtggaagccttgatgatgtagaaaatcttttattgtaaattctgttcaatcaaaggcaaggcagaaaaacttcaaaagcaattctaggtaggatgaaggtatagtacctagaaaaagcaatggaatcacaacaacagcaaccactttcaattagaagttttgagtttgaattaaagcttactaggtatgtgtcctaggtaaacttacataaccatctctaatattcagattaatcatatttaaaatgagggggattttatataatataaaatttttatattatataaaattttatgtttttatgatgacttaatgagattatatgtatacaagtagctattagcattatctatggcatttaggagaaggggctcactattgattagttcctttaccttggccagccagcgtctgcaacaagattgagctaaaacttcatcaagtaaccaggataatacattttaggtaggaaaacatagatgaaataagggcttaaatgcagagaaaagtaagttggtgttagggttaatacataaaaaaaaatgtgtaagacagagtagcgagaatttcacagcagttagaaatggaaaaagatttcaacatgatacaaaaactgccaagaaatctattagcttttcccttaggtgacgcagtcttcccctcatataaataaaataattgctactattatagttggagaaaaatcaactgaaatgtacattaaacacgtattagagatttaacattcttcacatcatttcacatgctgaaaactcaacctttgtaaatatagccatgaaccttattatttactataataaagtaacagcatatccttttctatgtactacttgcagaagtataaaaggcaaatgtgttcttgctctttaggtgcaattacaaggcagcagaatgtagttaggctaattttttgcattttgtgctcatcagacagtggctaccaaccctgcaagaaaaaactggtaccaaaaatacttcatcggaaattctattttcatacttagttgctttcagtattcttactaatttggtcaaacttatgtcagctccctcattaaaattgttttctgtctaaatcgttatcttttctgtgtacgtatatgtgtgtatgtgtattatttggtcaatattcagacagaacaagtctgagatgcaccgcataacaaaagtaatcaccccatccccatacttctcagggaatatctacctggtaccaataagctcatcaagagttcatctgaattcatagcctttgtcaatcagaggtgataaactgtgattttagtagtctatgttccctgcaagaccatcgtcttcatgagggctagaatctggtttattttctttcttttttgtcatcaccacctagttcaggacaaagcacacaatatacaaccattggatatttcattcatttattctaaaatgtttattgagtacttactatgtgacaggcattgttccaagtggtggtgatttaggagtgaacaaaatagatggaaatttctgatctcatggagattatatatatttgttgtggatgtctgataataaatatatagaatgacagacaattatctgcgctaaggaattaaaataaagcagggaaagggaaaagtaaatgatgggattgggagttggggttgaaattttagatagggggaccagcaaagaaattatggaaagatcacattcaagtgaagacccaaaagaaatgaaggagggagttagccagaaatgccttggagaaaaggcaaaggaataggaaagagtttcctttaaaatgccaggctatattcagatagaaatgtttctattaaaatataaaggtatacgaaaggcattcaagccaaagaaataggaaagacttttctttaaaatgtcaggctatattcacacagaaatgtttctattaaaatataaaggtcctatagaaacatttctgtacgaatatataaacatcaaatacataaaagttttaaaatgtttcataagaaaggaacttagaaatcaagaagatagagctagggtatttggcattactatgattctaccacaaccctcccaggggaattatccagctcagtaataacctgagaaatttaggggtacaaataaagtttgcaataactgtaatcactgagaatggcaacctcctaatagatctggaatacctagaagaaacaaatccacttttgcaggataccttcaacaactcaggtcatgtgggagtctcacagaaaaagcaaacaccaatgaaaaagagctcatatatcaaaaatatcaaatccgaagaaaggttcatccataaatgagtcagcagatgaaaaactttaaatgaaatgtacgcattaagttcaaaatagggcacaatcttagggaactaatctgagggccaaaataaaaaaagaaagaaactatgaaaaaggcagatttgataaatatacagagatttatagaaataaaattgtcattaaaattaatatctgaagtgagaatttatcatattaaatggagctaaagggaggattactgaactgaaaaataattccaaggaatttacctaccataaaacagagatagaagatattttttaaaaagattaggagatataaatgacaaaataaaaaactctaacatatctaataagtatttaagaatgaaaaaaaataaagacaaaaatgcaatatctgaaatgatgatgaatcttttccaaaactgataaaacctcagaaaactgtaaaacagcatcaggtaggtccttcagggaatatttcagaaaaaggaatttttatcacaggagatgacagctccatgcatgttattacgccagaagaccttccagtgggacaagatgtagaggtggaggacagtgatatggatgatcccgaccctgtgtagacctggctaatgtgtgcatttttgttagtttttagcaaagtttaaaaagttaaaaaaaattaaatggaaaaaatacagaataaagatgtaaagaaaaaatattttgtacagctatacaatttatgtgagctttaaactaagtgttattacaaaaaattcaaaaagttaaaaaatatgtttataaagtaaaacacttaacagtaagctagggttaatttattattgaagaaatatgaaacttttataaatttagtgtagcctaagtgtacagtgtttataaagtctacagtagcatacagtaatgtcctaggccttcacattcattaaccactcactcactaactttctcagagcaacttccagtcttgcaagctccattcacggtattaattataacttataagcaaaagactataccatacagcatacgtgtacaataggccataccatctacgtttatctaagtacactctatgatgctcacacaatgatgaaatcacctaacaatgcatttctcagaatgtatccctgtcattacgagatgcatgactatatatcaaaactcatgcaatgcagctaaacagtcttagggagcaaagtacaactttaagttaatatgctaaaaagaaaagacaagactaaaattatcaagacattagaaaagttacaaaaaagtaaaaccaaaaaatgtaaaagctgaaacgtaacaataatactgagcataagggaaatgaaaaacaaaaatgtaaagacagtcaacaaaattaagtgttgctttttttaaatgactaataaagtagaaaaatctctgggaatttttattataaaaaagaagatagaaataaaattaaaaagaaaaaacaaatctatttggacatttaagtgattactgaatactatgaaatactttatgctaatttgacttaaatgttcaagttattttacaagtgaaataatatgaacaattttgtagaaaaatataacttgcctaagaagaactagaaactctgattcgacaattataaagatatcacatatgtggttagaaatttatataaacatacacacacacatgcacgcgtgcacacacacacacacacacacacacattaccaggcccaaatatatttaaatataaaatttaataaacctttaaaaatctgttgaggtctatgtgataaaaattggaccatagaaaacaggaaagcacctcaactcttgtataaggcccttgaacactgatatcaaacccagataaaggtattatgagaaagaaaaattatttacaatggtgaggatttagaagaggtacaagctagccaaaagacactcagaaaaagaaaagtaacaatagctattatttatttagctactactaagtgtttgataagagttttgcatatattatttaatctgtatatcagccatataagtggttttattttcattattatcacaattgtataaataaaatgatgctcaaaaaaaataaatgggctcaaagtcataaaattaataagtagcagcagttgatagagggagactctaaagaccatgtacttaaacactgccttgtactatttactcatctttcttaattatgttcacagaggacattatgctgtctccctaacacttcacccaattttaaataaagcataatttttggtttttagcagctttactatgatgttcccaagtgttgttttcttcacgtttattgtgtttagagttcactaagcttcatgtctttcacaaaatttgggaatttttaacctttcttcttaaagtctttaaatattttctctgtcctattcttgttcttcaataccctacatgagagaacaggaggtccctcagacatatacccccacagcaataaaaattttctagttatcccaaaaaaaaaagtgccctagttgaaactttggggctcaagtagggggttgtgaacactagtgacacccaagacctaagaaggccattttgagagggtagaatcaagcccacatgacagacttgccaatgatggtcccagcttcagacatggaaatagctccaacatcctgtatcaaaaacatcgacaaaggggcctggaagaagtcatgcacactaatgcctcaggtgacagtcatttgtcttggctgaggatcctaaaagggagctcccacttagctccagttcctcttggctgctctctcagagcagtcctgccagcacagggaaaaagaactcaaaataatgattttcaataagtccaatgagatgtagaaaacacaaataaaccacaaaatataattaggaaaataattcattaaaaaattagtttagtttaaatattatattccataaaaaaaggaccaaacagataccctatagctgaaaagtatgaagacagaagtgaaaaattcaatacagggcttcaacagcagactcaatcatacagaaaaagaattgatgaacatgatgacaggtaatttgaaattacccacctagaggaacaacaagaaaaagactgaaaaagcatgatgaaagtatgaggaacctatgggacaataccaagtgtacaaaaatatgaattaggaattcccagagaagacagacagagtaagaggacaaaaactaatataaagaaatactagcagaaaagttcccaaatcctgggaggcatatggacattcagattcaagcagcataaaggcttccaagagagatcccaaacaggaatgctctaagacatattataaccaaattgtcaaaagtgaaagacaaagagagatcttgaaagtagtgaaagaaaagagccttgttccatataagtgaacatccaaaagacaatcagtagatttctcaagaaaaaccttgtaaaccaggagggaatggaataatagattcaaagtgctaaaagaaaaaaaaaaaaaaacctgccaaataaaacagtatatccacaaaagctgtccttcaaaaatgaaggagggataataacataaccagacaaaggaaaactgagggaggtcatcacaagacttagaagaaatgctaaagaaagctcttggagtggaaataaaaggatactagatgataaaataaaattatatgaaagaataaaacttactggtaaaaataaacatatagtcaaaatcagaatactctaatactgaaatggtaatacgcacatcactttttaatagggttatttgtctccttattatttgttattaggtatacttttaaactttttattttaatatttttggaacacagtaagtatatatatttatggggtacatgagatattttgatataggcacataatgcctaataatcacataaaggcaaatggagtatccatcacctcaagcatttatgctttgtgttacaaagaatccaactacactcttttagttattttaaaatatacaattaaattatttttgactagtcaccctgttgggtgatcaaatactagatcttactccttctttctagctatcgttttgtactcattaaccatccccacttccccggctcctactccccagttacccttcccaacctctggtaactgtcattctactctctatctccgtgagctcaattgttttaatttttagctcccagaaatatgtgacaacatgttaagtttgtctttctgtgcctcactgacacacaaaaaagaatgacagaacctcattcttttttaaggctgaatactactccattgcatatatgggccatattttctttatccattcttttgttaatggacacttaggttgctaccaaatcttagctattttaactagtgctgcaataaacatgaaagtgcatatatatcttcaatatactgatttcctttgttttgggtatatacctagcagtcagattgctggaccatatggtagatctgtttttagttttctgaagaacctccaggctgttctccatagtacttatacttatttacatttccgccaacagtgtacaaagattctcttttctccatatcctcaccaccacccattattgcttgtcttttggatgtaagtcattttaacgggagttagatgatatctcattgtagttttgatttgcatttctctgatgatcaatgatgttgagcactttttcatataccagtttgcgatttgtatgtcttcttgtgagaaaagtctattcaaatcttttccccattttttatttggattattggattattttgtatatagttgtctgaactccttatatattctggttgttaatcactgtcagatggacattttgcaaacactttctctcattctgtgggttgtctcttcactttgttgatggtttcctttgctgtgcagaagctttttagtttgatgtgatcccatatgtccatttttgctttggttgcttgtgcttatggggtattaagaaatatttgcccagtcaaatgtcctggaaagtttcctcagtgttttttttttcagtagtgtcatagtttgaggtattagacttaagtctttaattcatgttgatttcatttttgtatataatgagagagaagggtctagtttcagtcttctgcatgtgggtattcagttttcccagcaccatttattgaagagactgccctttccccaatgtatgttcttgccacctgtgttgaaaatgagttcactgtaaacgtatgaatttgcttctgggttctctattctgttccattgctatatacactgttggtatgccagtaccatgctcttttggttactatagccctgtagtataatttgaactcaggtgatattcctagttttgttctttttgctcaggatatctttggctattgtgggtcttttgtggtttcctataaattttataattgtgttttctatttctgtgaagaatgtaattggtattttgatagagattacattgaatctgtagactgccttgggtagtatgggcattttaacaatgttgatccttccaattcatgaacatggaatatctttccatttttttgtgtgtccctttcaatatcttgcaacaatcttttatagtttttattgtagagatctttctcttcttcagttatttcctaggtatttaattttatctgtagctattataaattgaattactttttaaatttctttttcagattattcaccattgacacataaaaatgtcactgacttttgtatgttgactttgtatcctgcaaatttactgaatttattgatcagttctaatagttttctggtgaagtcttcaaatataagatcatctcatctcccaacaaggaaaatttgacttattgctttccagtttggatgagcattatttctttctcttctctaattgtactactatgacttctagttttatgttgaataacagtgatgaaagtgagcatccttgtcatgttccagatcttagggtaaaggctttcagtttttccccactcagcatgatactagctgtgggtctgttgtatgtggcttttattatgttgagatatgttacttcgatatccagttttttgagggttttttttttatcatgaggggatactgaatcttaacaaatgtttttttccagcatcaactgaaataatcatatggttcttgtccttcattctgttgatatgtggtattatattgattgatttgcatgtgttgaataatcattgaggcctgggataaattccacttggtcatgatgatcctaatgtgttgttgaatttgggttactagtatttgcttatggatttttacatcaatgttcatcagggatattggcctgtggttttctttgttttcttttctttttttttttaaatgtgtctttggttttggtattaggatgatactggcctcacagaagatggacacattccctcctcttctatttttcagaatagtttgagtagaattggcattagttctttaaatgtttggtaaaattcagcagtaaagcgatcaggtcccagggtttcctttgctgaaggactttttattacagctaccatctcattacttattactggtctgttcaggtattggaattcatggttcaatcctggtaggttgtatatgtctaggaatttactcatttcttctaggttttccaatttatttacatgtattaatagttgcttatagtagcttctaatggtcttttgaatttctgtagtatcaattgtaaggtaacctttttcaattttgattttatttatttgggtcttctatctttttttctgtcaattttgtttatcttttcaaaatgtctgtcaattttgtttatcttttcaaaaaaccaacttttcatttcactgatcttttgtattattttcttcatttcaactgcatttatttctgcactgatctttattatttatttaattctaccgattttgggtttggtttactcttgcttctctagttctctaagatgcattgttggtttttttattgaaagtttttctactttcttgatgtaggcacttgtcactacaaatttccctcttagttttgatatgttctgtttccattatcatttatttcaaaaaacttttaaaatttccttcataatttcttcattgaccaactgatcactcaggagtacactgtttaatttccatgtgtctgtatagtttccacaattcttcattattaatttctagttttattccatggtgatcagagaagatatttgatattatttcaaatttttgaatattttaaagcttgttttgtagtcttaggtatccttgagaatgatccatatgctgatgacaaaaatgcgtattttgcagccgttggatgaaatgttatgtaaatatgtattaggttcattcagtctatggtgcagattaagtccaatgtttctttgctgattttctgtatggatgatctgttcattgctgaaagtgggatgttgatgtcttcagctattactgtactggggtctatctctctgttaagctctgataatatttgctttatatatctgggtgctccagtgttgggtgtatatttatttacagttgttatatcctcttgctaaactgacccctttataattacatagtgaccttctttatctcttcttgtagtttttgtcttgaaatctgtattgtatgatatcagtatatttcaagtatacttccaaatatgattacagtattataatgttgtttttctatgtacatattacgtacataccagtagtattatgtactatgtaatagtaataatatttttactgttactgcaagttttgtaccttcagatgatttcttattgctcattaacatccctttctttctaattgaagtactccatttagcatttcctgtagaacaggtctgatattgatgaaatccctcagcttttatttgtctgggaaagtctttatttctccctcatgtttgaaggacatttcaccaggtatactattatagggtaagagtttattccttcagcactttaaatatgtcatgctactttttcctgggctgtaaggtttccactgaagagtctgatgccagatgctctgttgtatgttatttgtttcttttctctttctacttttagaatccttttccttatatttgaccttttgggaatttgactattaaatgctttgagatagtcttctttaggttaaatctgcttggtgttctttaaccttcttgtgcttgaataattatatctttctctaggcttgtgaagttctctaataccgtcctcagaacaaactttctacctctacctctctctttacctcacttttaagaccaataactgttgccctgttgagtatcttgtaggcatgcttcattcttttttattctgtccttttgtctcctaaatatgttttcaaacagtccttcttcaagctcactaattctttcttctgtttgatcaattctcccgttaagaggctgctgcattcttcagggtgtcaactgcatttttcacctccagaatttctgtttgattcttaaaaattgtgtcaatctatttgttaaatttgtctgataggattctgaattccttctctatgctatcttgaattttattgagtttcctcaataattctgtctaaaaggtcacgttatctctgtgtttctgagattgatccttggtgccttatttagattgcttgatgaggtcatgtcttcctggatggtcttgatgcttgtggatgtctgttaatgtctacacagtgaagaagtaggtatttattgtagtcttggcagtctggacttgtttgtacccacccttcttggggaagcattctaggtattcaaagggacttgtttattgtgactaaatttttggtcaatgcagctgtgtctacattgggggcactccagggtcagttacactgaggctcttacagactcatagaattaccatattggtggtcttgtacaagatctggaagaattctctggattactaggcagagacttttgttctcttccattactttctcccaaacagagtctctctgtgtgagtgtgcttagctgcctggtgctgggctgggagagacataatacaagttcccctgtggccatcaccactgagactgtgctgggtctgacctgaggccagcacagcactgggtcttgcagaaggcccactataaccactatttggctgctgcctacattcactcaaggccctggggttctacaattatcagttaccaacaccagccacatctgtgtcctttttttcatggcaccgaatgcccccggccccagatggttccagagaggccctctaagatccagggcctggagtaagaaaccttaagaatctacctggtgctccattctactgcagctgagctggcacgcaagccacaagacaagtcttttccacaagcacagaagtctcttctcttggacaccactgccacaggcccatggggagtactaacaagctactgtcaatgttcattcaagacccaaaggttcttcagtcagcttgtggtgaatgctgccaggcctgggactcatccttccatgtggtgagctcccctctagcctagggaaactccccaaatgccattcaagaaccaagtcctggattcaggaaccccaagagcccacttcctgctctacaacactatggccaagctagcatctaagctgcaagacaaagtccccttttctctcccatctgtttttctcaagcagaagtagtctctccctgtagccaccacagctgggaatgttctggatcacacctgaagccagcatgtttcagagtctcactcaatgcccatgacatgtactgcctggatattgctgctgattaggaaaggcccaaaggctctttagtcagcaggtgatgaatcctgccagggctgggtccttctcttcaaggcagcacattcccttctagcccagagtatatctagaaatgttatctggaagctagtgcctaaagtgggtgcttcaagactctacttggtgccctatcctactgtggctgagtgggatccaagttgcaagacaaagtcctgtttactcttcactcctctcctcaagtggaataaaggagtctctttcagagctaccaattgcattgcttggtgtcagaggaggggtggcagaagccctcccttggccaccctgtctggtgtctcactaggtcatatgacccctgcatccactggctccaagcctagcagagcactaggacttgcctaggagttgcagtccttgtggctcagactgccttaaagtttatttaggaccccagagaattttagcccatagtggtgaagtttgttgatacttgagttccaaccactgggatggacaatttctctcttgtaaatcccttttaagcctaatataaaagataaaagacaaaaaatatcaaaaacaactatagctagaatatttgttaatggatacacaatataaaaaggtataaaatgttatatcaataaagtgggggcctgggggaaaagcaagatacagagtttttatatgcaatggaaattaagttgttatcagtttaaatttgatggttgtcattacaaggtgtgttatatatgcctcaaggtgaccacaggaaaaaacctctagtagacacaaaaaatagagacatgaatcaaagcaaaaattgaataaaatacaaaagaagacagcaagattggaagaaagaaacaaaagaactacaaaacaggccaggcatggtggctcatgcctgtaatcccagcactttgggaggccaaggggagtgaatcatgaggtcaggagttcgagaccatcctggccaagttcgtgaaaccccgtctctactaaaaatacaaaattagccgggtgcggtggcaggtacctgcaatcccagctactcgggaggctgaggcaggagaatcacttgaacccgggaggcagagtttgcagtgagccaagattgtaccactgcactctagcctgggtgacagagcaagactccatctcaaaaaaaaaaaagaactacaaaacagtcagtaaacaattaacaaatggcaatagtaagtccttatttgtcaataattactttaaatgtaaatggattaaattctccaatcaaaatacaaagagtggctcaacagaaaacaaatatgtaaaatccaacaatatgctgcctataagaggctcactttagctgaaaggatacagagccaaaaagtgaagacatgagaaaagatattccattcaaatgataaccaaaagagaataggagtggttatagttatatcagacaaaatagactatcagtcaaaatctatcagaagacacaaagaaggtcattaaatgataataaagtggtcaattcattaagaggatataaaaaattgcacatatacatgcactcaacattagagaatctaaatatataaattaaatgttaacagaacagaagggaaaaatagacaccagtataataatagtaaaagatttcaatattccactttcaaaaatggatagatcatatagacagcaaatcaccagggaaacagtggtctttaaaagtactacagaccaaatagacctacagacatatatagaacattctatccaacagcagtagaatatacatttttctcaagtgcacatggaacagtctccaaatagatcagatgttgggccacagaacaaatcttaacaaatttagaaaaaactaaaattatctcaagtatcttttctgactacattataaaattagaaatcaatcaaaggagaaattaaaaatgaaaaaataaaagtggaaaaatcacaaacatgtggcaattaaataatacacttcttaacagccaatgtgtaaaagaagaaatcaaaaccaaaatcttgcatatctttaaacaaatgaaaatgggcacacaacaagagggaaggacataacaatgaatgcctacattaataaaagaagaaaaatctcaaacaacttaacttcacacctcaaaaaattaaaaaaagaacaaagtgcacaaagtcagcagtaataaggatatattaaaaattagaccagaaataaatgaaatagaaaatagaaaaataatagaaaagatcagtaaacctaagagttcgttttttgaagacagataaatctttagctagattacccaaggaaaaaaagaaagaagactcgaatttaaaattttgtaatggaaaatggacaattaaaatgatagaacagaaacacacaggattataaaaagactacattaaacaattacattccaacagattagataacttagtaaaaaataagttcctagaaacatataagatgcaaagactgcatcataaataataaaattcggaacagattaatagcaagtaaggagattgaatcagtaataaaaaattctcccatcaaagaaaagcccaggactagatgtcttttattttttgagacaaagtcttgctctgtcacccaggctgcagtgcaatggtgtgaccttggctcactgcaacctccatctcctgagttcaagtgattctcctgcttcagcttcccaagtagctgggattacaggcacccaccactacacccagctagtttttgtatttttagtagagatggggtttcactgtgttggccaggctggtctcaacctccagaattcaagtgatctgcatgtctcagcctcccaaattgctgggattacaggtgtgagccaccgtgcctggcaaaagaactagatgtcttgatgagcggattctaccaagctttaaaaaattaatgcccatccctctcaaacagttccaaaatgtttacaagaatgacacacttcctaactcatttcaaggccagcattgccctcataccaaagctggataagagtgctttatggatatacaccatcagcaagctatcgcaaggacaaaaaaccaaacaccgcatgtcctcactcataggtgggaattgaacaatgagaacacttggacacaggaaggggaacatcacacaccagagcctgttttggggtggggggaggggggagggatagcattaggagatatacctaatgtaaatgatgagttaatgggtgcagcacaccaacatggcacatgcatgcatatgtaacaaacctgcacgttgtgcacatgtaccctagaacttaaagtataataaatatacacatatatatatataaagagtgctacaagaaaagaaaattacagagcaatatcttagatgaatatagatacaaaagtcttcaacaaagtaccaccaaaccaaattcaacagcacattaaaaggatcatacaccatgatcaggtgggatttatctctgggatgcaaggatggttcaacatacacaaatcaataaatgtgatacatcacattaacacaatgaaggataacagtgcgggaaaagcacctgacaaaaatcaatgctttcttgataaaaagcctcaacaaatttggtacagaaggaacgtacctcaacataataaagatcaaatatggcaatcccatagaaaacatcatactcagtggtgaaaagctgaaagcatttcctctaagattaggaatgaaaaagcatactcactctcactatttctattaaacatagtattggaattcttagccagagcaattaggcaagaaaaaaattggaaaggaagaagttaaatggtctctgtttatagatgacataatcttatatgtagaaaaaccctgaagactgcagcaaaaaaagaaaaaaaaacctgttgaaacgatatatgaacccaatagtttcaggatacaatgtaacatacaaaaattagttgcagttccctacattaataaagaactctctaagaaattaagaaaaagatccatcttagtctgtgggcattgcttattacctaaggctgggtaatttataaagagaaaaagtttttttggctcatggcttttccggatgtacaagaagcatggcaccagctcctggtgagagctcaggctgcttccactcatggcagaaggtaaagtgaagccagtgtgtggagattacaaggcaagagagaaagaagagagagctgccaggctctttataacaatcggctctcatgggaaccaatagagaaagaaatcactcaatacatcaagacatcaagaaggacatcaaaccacttatgaggaaactacccccacgatcaaacacctctcattaggcctgatagctaacattgggatcaaatttcaacatgaggtttgtggggacagatatccaaattataaaacgattccacttacaatagtatcaaatacaataacatactaagaaataaatttaaccaagttgatgaagaattggtacactgaaaactcttagacactgatgaaagaaactgaagacaaaaacaagtgtaaaaatattgcacgttcgtgaattgaaagaattgctatttttaaaatgcccatgctacctaaagcattttcagattcaatgcaatctatcaatattataatgatattttttacagaaatagacaaaacaatcctgaaatttgtttggaaccacaaaagatcacagatagccatagcaatcttgaaaaggaacaaagctggaggcatcacactctgtgatttcaatttgtcttacgaagctacagtaatcaaaatagtttggtaccagcataaaaacagacacttaggtcaatggaatagaattgagagcccagaaataaatgcacacttgtatggttaactaatctttggcaagggcaccaactatacacaataaggaaaggaaattctcttcaataagtggttttggggaaactggatactcaaatgcaaaagaataagactggatccttgtcttgcactgtacacaaaaattaactcaaaatgaattaaagatttaaatttttaatttaaaaatgtaagatccaaaactgtaaaacaaagctccttgacattggtcttggcaaagagtttttggatattgacacgaaaagcacaggtaacaaaagcaaaaataaaaaaaagtagaactacaccaaactaaaaacctttttcacagcaaaggaaacaaaaactgagaaggcaacctactgaatgggagaaaacatttgcaactatatatctgatgaagggttgatattcagaatgtatgtagaactcacacaactcaatggcaaaaaaaaataataacaataactcaatttaaaaataggaaaaaggcctgaatagacatttttccaaagaaggcatacaaatgggcaagaagtatattaaaaagtgctcaacatcaataatcatcagggaaatgcacatcaaaactacagtgagatatcacctcatgcctgtcagaagggctaagagataaatatctgcaagaatgtggagaaacgaaaacacttgtccactgtaggtgggaatgtaaattggtatagccattatggaaaacagtatggagtttcctaaaaaaatttaaaatagaataattatatgatccagcaagcccacttctgggtttatatccaaaggaaatgaaatcagtatctttaagagatatctgtaccctcataattattgcagcattattcataatacccaaaagatggaaactacctaagtatccatcaatgggtaaagcggataaatgaataaagaaaatgtggtacatatacacaatgaaatattattttgccataaaaataatcaaacctgtcattttcaacaacatgaatgaatctgtaagacattatactaagtaaaataagcaagatatagaaagacaaatagtctgtgatctcacttacatgaaatcttataaaaaggtgaatctcattgcaacagaaagactgatgattgccaggggatggtggtggagaaaataaggagatgttgattaaagggtacaacatttcagttataagttgaacaagttccagggatctaatgtacagaatgggtggtgaagaatgtgtgaattaacttgattgtgataatcactgagaaatgtatgcataaaacaatcacaatgcacactttcactatatacaatctttgtcaattaaatatttttaaataaaaaataaataaaattgtacttccggtttttgagatactgcttattttttatccactcttttttctcactcctttttagattagataatttctattgatctatctttaagttcaatgacttttccttcaacccctcctccattatactgttaatcctactaatttatttatttaatataatacatttctctgttttaaaattcccatttggttcttctttttttttttttttttttttttagatgaagtcttgctctgtcgccaggatggagtgcagtggcgcaatctcggctcactgcaacctctgcctcctgggttcaagcaattctcctgcctcagcctccctagtagctggaattacaggcacatgccaccacacccagctaatttttgtatttttagtagagatggggtttcaccacgttagccaggatggtctcgatctcttgaccctgtgatccgccccctcagcctcccaaagtgctgagattacaggtgtgagccaccgcacctggccaatttggttcttttaataatttcttatttctctgctgagatttcctatctttttgttcatttcaaccatattccctttcatctcttaaagcgcagttttaatacctgctttaatttttttgcctagtaattccaacatgtgggtgattttaagattgtcatctgttgattttctttatccttaagaaagggtaacattttactgggttgaagtaattatggggtttttatttgtttggttgtttgtttttgttttgttttgtcttgagacggagtcttgctctgttgccaggctggagtgcagtggcacgatcttggttcactgcaacctctgcctcctgggttcacacaattctcctgcctcagcctcccgagcagctgggactacaggcgcccgccaccacacctggctaaatttttgtatttttagtagagacggggtttcaccatgttagccaggatgatctcaatctcccgacctcgtgatctgcccaccttggcctcccaaagtgctgggattacaggtgtgagccactgtgcctggccaattatgggttttaacttagacatcgtcaatgttaattgtggatactccagacttggagtccttaacttggacaatgtgttacattgagccaaagagtgctaatatctttgttctcatgggacattaatttggctaatctcatattgaaaaatttgtgctttttggatctcagtgtggactgatttcagtctgccctgtgcatgtgcagttcaggggtcagacaaagacttaagacagaatttatacacacaatatcccatctctgtctctttactttcctatgtttttcctcattctctgacatccccgttccttcccagagttcctacagcctacagagaaagcaagggctttctcttggagttaaattgtcccatgttgccactgcaattggagatgccctcagaaaaagcctcagaaatgtgaaactcacttcatctcatgacatttgcttaatacaaagtttgaacctcctctaatatttctctagtcttatccattctccaaaacctttacagagttgtattgtgttttgttatgctttgcttttatttttggtttttgtccagagtttatagctactatctgcaggctggttgtttttttggaagtttatttctccacacaagaagcaaaactcttgtattattactaatcctgagaacagaaggttacagagaaacagaaaacagaaggctttaaaaaagtaccaagagatacaaataaaaattgaataaaaaacaaacaaacaaaaaactagaaaaatgtctcctgcttctaggagagggctgaacaaaggcagatgaagaggcaataaagtaggtaataagtacatttacagaaatatatgccatcaaataggtaagaatgcaagtaaaatttatatataacaaatacccaaaagttttggaagcagaaaaaatgttagtcaatagttcatattgtctaacaatcaatctgtcacccaggctttgtcacccaggctggaatgcagtgacgtgatcatagctcactgaaatttcaaacactatcctcctgagtagctgggactacaggcatacaccaccacatctggctaattttctattttattttttgtagacatacggtctcactatgttgcccagactggtcttgaacttctgggggctcaatcaatcctccctgcttggcctcccaaagtgctgggattatagtgtgaaaggaaaataaatcttggggcccaaaatcactaagctaaagggaaaagtcaagctggggactgcttagggcaaacctgcttcccattctattcaaagtcatccctctgctcactaagataaatgcatatctcattgcctctttgtcaaggctaatcagaaactcaagaatgcaaccatttgtttctaatctaccaatggcctggaagccccctcccactttgagttgtcctgcttttgcttcaagttgtcctgcccttacgaaccgaaccaatgttcatcttacatatgttgattgatgtctcatgcctccctaaaatgtataaaaccaagttatgctccgactgtcttgggcacatgttatcaaaacctcctgagactgtgtcatgggcatgtgtccttaacgttgacaaaataaacttcctaaattgactgagacctgtctcagattttttagtttcacaacaggcatgagccaccatacctggcctcaaaagtttcaaaaccaacactcttcatcagatcccagaaccaaagaaggaaaaaacaattgaagaatttatgtccacagttatgccaagatttacactaatgcataccacatctcaaagattgaagaactctctcaagaactggcaataattaagtttccaaccaaattatattttctaaattaaaaataagcacacatccaagtgtaaaatttaaaaaaacctgaagctaaagcacattcaccttatagataaaaatatagtccatacctctctattttataaatgcattttcagacttgatgcattataggacatggtaacttcaaacagcaaggaaaaaactcttatttaaaactcagtaagaatataatctctgtaagaaaattatcattttaaataatttcattaaactgttttctcctttgatatacccctggatgtaacactattaggttatagtgaaaaacaccctcaattaactctcaaaaagtatggttccaccattaagctactatgagactttggacaggtcccttcacctatctaggcttcagtttactcatgtgaaatgtgaggctagaacatatggtttctgctttccaggtgtaaaattctataactacataactttatcccttcgtttcatgcagttttatctccgtcttccacttctgtgtcttcctggctggagtagctttatctgtcgtctgaggcatccggggcacaccccatcatttcaggcttagccgtttctaagtcgaaggctgcagtcactgagggcagcctcaaggttcttcaatgatggagaacctcaaggttcttcaatgatggagaacctcaaggttcttcaatgatggagaacctcaaggttcttcaatgatggagaacctcaaggttcttcaatgatggagaacctcaaggttcttcaatgatggagaacctcaaggttcttcaatgatggaaagattcttgtttaatttctaaaaaataaatttggcaaattcctcagatctcaggcccaaagaaaatatttcaggagagatacattatgcctttcacgcaagtgcaaaaaaattaaaaatgtagactcccacacacaatctcaagcaaatcatcaactgacatctgatgttgtcttacctacagagttaagaagcttgtttacatctgtacttcaggtgagtgagataattttgtgaatggtaggttaaaagtaatttcaaatttgagaattaagcaatgagaaatgtgctgtaaatttcaagaaaaagatgctgcaatactgtttaggattctgagaactttagatctatcttcttataaaaacttccacttagaaacaaagaaataaacaaaaaccaggataaacaatacaatgctctttccaacttgctggaattacattcactcagataaacatttattaagcacttagttggtacaaggtgtactgtcctctgtgagacacacactcatagaaaagaattttgtatctgctttagtgagtttataatatgccagaataaatacatactaaaaggcatatatacataaataatataatgcattgcaggaagaggtaagtactatgatagagggacacagaaagtcctgtgcctcaggccttgctccctgcagggcactaagctatttcgaatcacactgcaggaggtggccaactacacagtatgcagtgcatcagtgctatccagggaagaaaagactactacatggttaagagagcctgaaaaaacagaagcagagaggtggacctagaaaactagcagtcggttgaaggtcaatatgttcctacctggaaaatagggtccaactactgggcagaaggccaggacccaagggtgattctgtgcaactgggggaggtgagaaaggagagaaaggaagtgagtattctgctgtgggaagaagggaattccaagatgacaacacagcaagagcttaactatagatgaaggaattctgaatttcttctagtttcccatctcatgatcatgtcaatataaaaggaaattactataaaatgtaataatttctaccagtctacagattctggcaggctaaattaaacctgaagataaggacaaaattacattccagttcctacttacaacttctatcacataaagaggtacttacatagttcatatgtgcaaactgagttgcatgctttctaaatcgttttatttaattgtgaaatgtttggaattgggtgtcactggtcttcattttgttttgaaaaggcaatataagtgaattaatctatcatcaggctaataacaagaataagtattttaactccttcctttgaaatgaaaagacaaattctttagccaagagcttccaagtttaatttacgattcacaaaattctacaaacataaattatatagtagaagtttcccttattcttacttgaatataactctaatcatttgaatatcagttttaacaaaatgaataagagtacaacagagttcagatgaagctcgtttcttgccaaaatccatatgaatgccaaataccttccaagcacaaataaatcctgccttccatttaaacaaacaaacaaacaaacaacaaacaaaacaccacattgcctaagattgggcaatcactactaagtgactactaagtagtgagtaagagctaagggaaacggagcgaactttaggtcaccagggcacggtacactgaaaaacatgtgctgcgcttcttcagaaacaagctacaacagcagaaagacgaggtaccttatatcttgtttataaatcttactttataaaggagaaaaaaatgaaaaaagggaaataatattcccttatatcctattttgtgctaggcacttagacaatgttttattatttaattgaaacttgagttcaatcggtagcaggagcggcgagcggaacccagagagccctgagcagccccaccaccgcccccggcctagttacagtcaccccagaaggagccacaaccctgcagccagcaggtcaccatcacagcaaccacaaccctgagcaaagacgccaaggcagccaaccccaagccggcaccacctgcagcggcgcagggagcagtggcaagggcgacctcacaggcggcgcctgctgatggggataagatcaccgcaaggaagattttgggaacagtaaaatggttcaatgtaagaaataaatggtttcatctatgcgaatggcaccaaggaagatgcagttgtacagcagaataccatacagaagagtaaccccaggaagtaccttagcagtgtaggacacggagagactgtggagtttgatgatgttgcagcagaaaagggtggggaggcagtaaatgttacaggcccctgtagagtccagttgatagcagtaagtatgcagctgaccttaaccatcattgacgctatccatgtggtcctcaggcaattaccagtagaattaccagaatagtgagagtggagaaaagaacgaaggacgggagagtgctcccttaggctcggcccaacaatgccggccctgctgcaggcgaaggttcctgccttactacaggcagagaccctacggaaattgaccaccatattctaaccctccttgcagggagcagcgacggagggtgctaacaactggggtgcaggagcacaaggtaggccagtgaggcaggatatttgtatggtttatagaccacgattcctcagggaacctcatcgccaaagccagcctagagaggacggcagtgaagagagtaaagaaaatcaagatgagacccaatatcagcagcgacctcaacatcggtgctgctaaaaccccaattatctatgtagactcccagaaaaccctaaaccacaacatggcaaagagacaacagcagccagtccaccagtcaagaattctgcacccgaggcagaagaaggttgagtaaatgccggtttaccatctccaccatcatccagtttaatcatccaacaagaagaaatgaatatgaaattacagcaatgagaaatgcaggaaagaaatgctgaagaccttaagtgcttgctttttgcccattgatcagaaaccagaactacctgcattatctacgaagcatggggtttttaaaattatttttacctacagacatgtctttttggtaataacaaaggtttttattgttgttgtttttgtgtgttttttttttagtttggtttttctcaacatgcctttaaaagcttttaaattggttcatatgtcaagttgagatttttaagcacttcacttttaatttgtaataaaagtttacaacttgattttttcaaaaatgtcaaccaactgcaagcacccattgaaagtcttaaataatacaaaaactttaaattaaatcaaatgggtattaacaccatataatacaaaaaagaagtgaggttcgaaaatccttatgcttttgtgatgccacacgtcacctaactggtagcacaacttgattgcaatctgactctgaagcttttcttcattcctagacatcctatttttgttgaagtcctagattttaaaagtataatttttttaggaataaagatctggtaggcaggaaattctgctgaagctgtttctgggcaacttgactttgccagggcctttgcactgattgtgttaatggccacctcctcttcagatgtagggttatggatcacctgtaaccacctgtaacctgtacagcaagctgaaggagtgtttgcctaatatccaatccacagaatttatttcaaaaatggtgagcctcactaaggtgatagcagtagcctgtccacaggctgatcaacaaaatcttgtctttgatccatggtttctgcttcttggagtctcccaaggtacattctgccactgctggacctagaatcatagtctcctttcctaccagccttctcaccctgccaaacttatcatatacaattgtttgacatcacagatattatcaatccctaggcctctctagctttctgctcttgcaatttcttttacattgtctttgtcacccagcacagagcccatacataagtcatcactctattttcttagaaatactttcagttcacttcttggttttcctatctcacttaccaagctgtcttagtacagatctaagatgagaattttagtacaaataatttattttggaaacaaccccatgaaacactggtaagggagaaaggatggaaggcagaaaagggaaataagatagaatgtttgcaaagataaccatcaatagttcctcaaagccttgctctagcatgctgctcttcccatcaagaggcagagtttgtttcccccactcttgaatctgcactgaccttgcaccctttttttgaacaatagattgcagcagaagtgatgctatgctagttctaagccaaggctgcaagagtcctggcagcctcttcttttgctttccttagatgcagataccatgtaaagacgctcagactagattagtgaatgatgagaagcaatggggagagacaggcccagacagaccccagccattctatacattgcactgaggcctaaaacccataagtaaagccatcatagtcattcctgacccagacaggcttccagtcaagtgcaactacatgagtgacccaagctattactaatctaagcctgggcaccccaaagatttgtaaaaaataacaaatctttgttgttttaagtccctgtatttgggggtagtttgttacacagccataaatgaaacagggacaaagccaaaaaagggtacaattattaaacaagttactgctatgggaaatgagtttagtccttctgggatactctggaaaacagtaaagaacatgcctcacagttatcccatgtgaagggtaaggatgatagtgtaatccacccacttgctaacagttatttgcttaagtctttttctagtgacagtaactatttggtactttaagcctgcccaacactgtgagccaaatctgctcagcagccacacacaaaaaatgccttcaggcagacagtcacagtatcaggaataagcagtcttctgtgacaagaggtgagtggtggaaggaaacaggaagagcgtcaacataggtgaaaacccaggcctagagcagtccagctatctgctttctccactcctagaactgcaacagctaaagtgggtcacatacactcacagattataaccactacacatctacagctcccaaacttagctgggtcccaaatgttacttaataatccttccaagtttccctaatcatctgtttactttagtatattttacatctatttcaaaacttcccacttttattaaatcttctattccacctacccctcccccttcggtatcagcaaagcaatatgctctctatcccaatgagaaaataaaggtcatcagatcaattttttgctacctccattgcactgcattcagaatcatccttccttccttccctactaataccacaggaaagggtcaaggtaaatgcagcattaatccagcacctctccatctctggaataccccaccttagaatacaagaacccattatgtacttgcccttttctgtctctcttaggtccctaatgcatgaatctcatcgagttatagatctgttgaaaccctacacctatggatctttgcaccaagcattgttcctactgcctaaaatgtaccttccccaactttccccatttctagactctgccctggcagagtcctcttcatcttttagacctccacttacctgcgacctcttcaggaaagccttctttactttgctgcccacgattcctcaaatctatgcttacctctgccacagcactttgctcttttctgaaatcgctcattcctttttctgatatccttttcctcctcctttacctcccactgaaaataagctcctccaaatcaggtatttgccttatatatttttgaaccatagtatctgtgcctagaacatagctgtggattaacaaatagcaccaaatttaaataaattaattaatcatctcttttccttaagttactttccagagtaactttagtggaagctgcaggcaagatttatgtgtactgtggcccttcctctttctatctttttttttctttttaacattctaagaggtatcatacaggtcatgataaactgagtctcttctaaatttgcatatagtgaaaaataacacgtcaaaatgcatttgcttagaagctcaggaatccattgttcagttaaaacttgttgccttgttataatgttatgacaaaataggcttccatactggcttttaacatataattgttaattatcatcacaaaagtttcaaaatttcttcagttttaaaaagattttcataagtaaaaatgcatacagtacttgtatactcacagtgagcttatttaataatatgtttgtagaatgtaaaatagctttctgttttatggtcagatttgataggcctatcaaaattggtttttatagatatgattgctactttcatcaaaaaatgaaccatcaactttaagagaaatgaaaaaatcaatttgggtcatggtaacttctaagccctactacctagtcctagaatttgttcttaatagaccagactgtctgcaaaatactttgaaacaaagaatgtgtactttgcctcctccctaccatgttcttggcaactagggaatatgggacattttaagtctttaagataaaattaatcacactgatttagaacaactaaaatcttgtcagagtaattcctaccttctcccttccccaccatgttacctttaggaagaggagacacacttgaggaagctcttcaaggctggtcttcagggaaataaagacattgaaattccactccaattattttttattacctgccaccttgaatccagaatatatgttacattatgaagtgtcgtattcttgactcaaaacatccttccaattaagattttcttttttaaaaaaaattaggttaaagcaaaaatgcagaaaagaagggtaaataagattagtaaaccatctgaaaattactgcattttgtaaactttggtaaaatgtatgaagaagcatgttttccagtctgctttctcggcctgtggatacctgggacataattcagtttgccatcccctgttcccagatcagctcagtctttgttcagctccatcttcaatctggcatataattacttcttcagctcctgtgctatttggttttaagcacctcttacccccaaggcctcatggctctaagggcttgttgaatttaaacaagcacatttaaatctttgtctttaaatgagtaaaataaaagtcttaacacctaacacagagtactcttctacactctaaatgtgcatgttataattgcctaccagatcataatgagcatctatccatcctcaaaatcagagaaaggggggctcattctagaggtaaatttacaataaatggctttattcttgattagctatgtgtgtttggggacacagagactggcacctgcataatttaaatacctgataggaatcagatgatcaggacaccttggaaataaaggtggaaaaacaatagtggaggaaacacaataatggaggaaatacagaagaaaaaaaacaagattgttaaaagaaattaataaaatacaacttaaggaattttaagcttcacctctcattggaaaaacactgcaaactcatacacacactgatgcatgcacacatgcatgcacgcacacatgcatgcgcacacacacgtatgcaatataattacagaaatgttaaaactgtctgtctttcctgagagtcaggagatgtggattctgccactactgctgctggcaaatcataaataccatccagggttttagtttagcctgagtaaatgagtaatcattacatttgttccacatacatactttactccaaacactggtagataagtattgaatgagaccctcattcaaatacacggtcaaaaatgccacaaaaagaagtattataattataactattaattataagtaaagttttttaatgaatggataaattagtaaaacaaattttaatagatataaatggaaaacaaagcatgtgcaatctcactagtgatgaaggtaatagaaattttaaaagtgagatactagtctttcacctatcagatcagttaaagtcaataaaagaaaaattcagtgttggaagaggcactgcagtgggagtgtacattagtaccattaagcactatgtatcaagggcctgaatcatgattatgtactgtgccagtttgggtcctcttgtgccaaggtgaattgggtatgtgagataattatttggggtagaatctatacatgataaaggggaagaggtgtaggtaaggagagcactcagactatgatgcaattctgacatctctgaaaggagaaaggcaaggaagcatttggtaggaagagatctgcatgcaggaaagtcctgagaaagtctcagccagggttggttccaagtctttgttattgtgaatagcgctgcaataaacgtatgtgtgcatgtgtctttatagcagaaggatttataatcctttgggtatatagccagtaatgggattgctgggtcaaatggtagttctggttctagatccttgaggaatcgccacactgtcttctacaatggttgaactaatttacactcccactaacagtgtaaaagcgttcttatttctccacatcctctccagcatctgttgttttctgactttttaatggtcgccattctaactggcttgagatggtttctcactgtggttttggtttgcatttctctaataaccagtgatgacgagctttttttcatatgtttgttggtgacataaatgtcttcttcttcttcttcttttttttttttagatggagtctcgctctgttgcccatgctggagtgccggggcgcaatctcggctcactgcaacctccggctcccgcgttcaagtgattctcctccctcagcttcccaagtagctgggactacaggcgcatcctaccacatcctgttaattttttgtatttttattagagacagagtttcaccatgttagccaggatggtctggacctcctgacctcgtgatcagcctgcgttggcctcccaaagtgctggaattacaggagtgagccactgcggccagccgtaaatgtcttcctttgagcagtgtctgttcatatccttcagccacgttttgatagggttgtttgttttcttcttgtaaatttgtttaagttcctggccgggcacggtggctcacgcctgtaatcccagaactttgggaggctgaggcgggtggatcacaaggtcaggagatcaagaccagcctggctaacacggtgaagccccatgtctactaaaaacacaaaaaaattggccggccgtggtggtgggcgcctgtagtctgggactacttgggaggctgaggcaggagaatggcgtggaggcaggagaatggcgtgaacccaggaggcggagcttgcagtgagccgagaacgtgccactacactccagcctgggcaacagagtgagactccatctcaaaaaaaataaaaataaaataaaatatttaagttccttatagattctggatattagccctttgtcagatggatagatggcaaaaattttctcccattctgtaagtcgcctgttcactctgatgataatttcttttgctgtgcagaaactctttagtttaattagatcccatttgtcattttggcttttgttgccattgcttttggtgttttagtcatgaagtctttgcccatgcctatgtcctgaatggtatcacctaggttttcttctagggtttttatggttttaggtcttacgtctaagtctttaatgcccatcaatgatagactggataaagaaaatgtgccacatatacaccatggaatactatgcagccataaaaaggatgagttcatctcctttgcagggacatggatgaagctggaaaccatcattctcagtgaactaacacaggaacagaaaaccaaacaccgcatgttcgcactcataagtgggagctgaacaatgagaacacatggacacagggaggggaacatcacacattggggcctgtcgggtggtggggaagtaggggagggatagcattaggagaaatacctaatgtagatgacaggttgatgggtgcagcaaaccaccatggcacatgtatacctatgtaacaaacctgcaaattctgcacacatatcccagaacttaaaagtataataaaaaaaaaattctagaaaaagaagttgcatctgtactgaacatgtacagagttttttccttctcattattccttaaaccatacaaaaaagaaagtctcagccatgttggtagggagtccctgaaccagagttacccattagaagaatctagtattgggcagaaatgtccccgttctggtattcctgacatgttcagtcactcggtggaagcagccccaaagaaggatggtttcagggtgaatgttgtggtggatccacaggtatagcagctggaggctgtcaattatctatgctctctacaaaagctcctcttgaaaacagagctgagaaagacacttgtatacatatgattttattcccgttctaggaatctatctcaaggaagcaatctaaataccaaaataataatgataaagagctttatgaacaaagatgctcatcgcagtcttttaaaaaataattgaaaggatagaaacaatttaaatgtccaagcataaggattgattaagcagctatagtatgtctactttaccaaaaatgctgtggctattacaatggaaaacttatattttaagtaaaattgaaaatagagataaaatatggtataacttttaaaattaaaagctttgaaaagatacatattttaagactggcagaaaataaaccaatatggtagtaataggaagtttttttgcatttttgaattttccaaattttctttattaaaatttatgacctttagctgagggaaggaagcattcaaaataaaaaggcaaaaaagcaaaatagttaaaatgatttagagtcgaagtaagcaggggaaatatgaagctatagaagagaaaacaaagaagacaataaaaatatctgaagaatactgtcttaataattctgggactaggtgtggtggctcactcctacaataccagcactttgggaggcccagccaggaggattactcgatgagcccagagttcaaggctgtagtgagtgattattgtgccgctgcactccaggctgggtgacacaccaagacccagtctctaaaaacaaattctggaaaacagcttcatggctccaacataacattgaacaaagccaaagatgggaaaggaaaagggaatgtttttattttcattgtagcattgggtttttaaatgaaaactgatgtttcatatgctcttctatgactattcagtataggtgtttcaccatcattgtaaggagtatcttctgtgtatgtaagtatgtgttcactagtgcattcattttttcaacatgtgattaaacagtttgagagtcaccatatgccaggtactgtgcaagcaaatcaaaggtcacagtgtaaaatgagaaagggtatgttttggccctctattctagaattgtttatagaaagtgcataatttaagcccatatgtcccatgtcctaaagatacctgtccattaaatacagtgcatttcattgccttttcagactctcttcactatgcacataagtgacaatgtaattgcaatttgattaattcatataaactaagaaaggaggaattattcattcatttctgatttttttttttttggaaagtatcccattcctactatagtttgccaaaccctctcagggtagacctctatttacttaaaagaactagtttcatagattgctgtcatgcaccctaattagacaaacgtgttttccaggtctatttgaaggacattctgatataatgcatacctatcttcttaatcttcttattcagcttatgcatatttcttttcctttaaaatccatcaataaatgatctgtgatctgtaagtaattaatttaatgattacatgaattaaaataatgcacattgctttaaaggagttagtattttcggtttatgttacaatattggccttgggtaaatatcatccattgcctgaatttcataatggttcaaggataaaccatttcctctttataattcagtaagtttgttccaaaggagcctattgctcctctactcaacaatgaaagaaatgcattcagggaccttaggttgcctattcttaataagatggaatcctttcccggtttgttaaattcactgaatttataactcattgttactgatgaaggaattaatccaagcccgttaccagattgatctcctaaaatccacagagcgaatttggtgtcatttttaaaaagaaataaaataacaaaaataaaaatacaaaggatgtcagtaagttacagacaggagggcatacctcatatttatcacctggaaaactagagaaaagtttcatcaaaactgtttcatgcatctgtgcagggctaaagtcatctgctaatcagcactaataatgatggggataacaataataatctgctacctttacataacagtttttaccttgggaaaagattttcacatactactcttcatttagttcttataatgactttgagaaactaacataaatgttttacaagtcccattttgtgaaagagaaaattagagtacaaagaagagactgacccaacaataacatttaactggagctagactcctacttcaggtttttaaaatgctttcaaatcaatagaattcatgatttgcaatgttttcctaaattctgttaaaacacacttaggaccgtaaattttcaccaaccataacagacacctggtaagcgggcatgtaataaacaattgagatgttagaaaaaaagatatgtctctgatgagcagggcaaaagtgaatgtaagtcaaaagatatctaaagactctatagcttctggaataataaattggtagttttctttatttttcatttgttgtttcagaaagtgtttaacttttgatactaccaccaatgtaaaatataatagattgttagtaacaataaatcaatctctacgttgtccaaataggtgtgtttacccaggtccacactgttcaagttttattaaaactgtttcgttttatccaggtttccagtattgcatctcctaagacaaacactgatatttatctgctgatgcttgttttactaaccaaatattacattacacatggtttatcacattacccagggaggtgacaatatttcaggaaaaaaattaacaaatcaaaataactttgaaaactgtttataccccatgtacaaaagtactgtctatgcctagttattcactactatcacaagatatacataaatcagagtttttaaataatactgacttccccttataaattcctttaccccttgtgaaaggaacctagcaccattatgacacagttaagcattagtcacagtttaataaataatttcgttatagcctcctagtctatcagtattatttggattctcagaatgcatgtaatcatgtaaattacaaaatttcctttgtatcagggataaccaactgtcttttataaataatgttatttttggtgatttttcaatatcagaacagtatagttttggctagagaaattactataagcattcaaataaagattaatcaatttatacaaggcaaataaactttttgtactcttaaatacttaaagaataatatatacattcaaatatttgtaagaaattcatatagaggggagtataaaacacatatggaaaaggaggtatgtctgcagaagttactttgtaaagaaacatagtgctcaactaccaccctccctcaaatatcatgtcaatcaaattagcatcataagaagaactccagttctactgtgatagagtagcttatatcaaatcaccccctcgttgagaaaaactattaaagatgaataaaatgaaattattttaaaaactgtttgaaggcaccaggcaccaaccaaagtaatttcaatttaaaactcaatagtctataaaggaagtaaacacgttaaagtaagccctatgttgtttattacttttcaaattcaaggcatttgctgtttcctaagtagaacagaatgcgagactgagcacaaagctccagattagaacattaagaagtcttgtaaagagaggagggcacaaataacactttggagctgtcagcacagccaagacatgaagaatcaagatcctggataaactgtaaatgcaatgaggtgaggcctgtattctttttccacttttaacccctaaaacatttccagttcctctttcttggagtgagaaaatcaaaagagaaacaagcagaaaacagcaacctaaatactaggacattaaaaagaatattcagtagtcttataccaacgaagcaaaaactggagtttagtgactacttgaaaagcactccaaaattttatttgaacctctaaatgactatttataaaactaagggaaaaccataactagagtagccatcacaaagatggaaacccaacttcaaattgtcttaatccctgataagattaagtaaattacctttattctaataatctgtgaggagaaaattaaatccccatggaaaaatataataccatacaaaacactctaaatttttaatatgaaaaaatcatcaagcatgctaggaagtagaatcaaagaaccaaaacaaagagaaaaaataatagacaaaaacataaattcaaaaatgatacagattaaagaattatcagatatagtcttttaaaaacagtgataaatatggtttcagaggtaaaggaaaagagtgagaataatcagagaactgggatttatattaaaaacccaaagattattctagaactaaaaataaaacaaaattaataactcaatcgcagccagttagacacaacagaagatccaagttgtgaacttgaaaataggttaatagaaaatatccagaataaaacaaagagagaaataaggatgataataaaagaagaagcattagagatatatagaacatggttaaaaaatgttttaacatacaaatatctctagtcccagaaggaaagggtaaggagaataggcagaagcaaaattcaaagcaataatggccaagaattttccaaaattggcaaaagcatcaagccacaaattcaagaatgtctaagaaccccaagcaggataaacacaaagaaaccaactacaaaaaaaaaaaaaaagcctgtttgtaaaactatttaaaaataaacaataatcaaaaaggcaatctcaaaatagccagaaaaataaaaatgcattactttgtaaggattagtaagtctgataactgattgctcatgaaaaacaattgaagccagagaacaaagccatgatatctttaaaatgcttttaaaaagtaactaccaacctaagaaacccaaacaacagcaaaaaactaaataacctgattaaaaaatgagtaaaagatctgaacacacatttctcagaagaagacataaaaatggtcaacagatatatgaaaaaatgctcaacgttactaatcattaaggaaaagcaaattagaaccacaatgagatcacctcacacctgttagaaaggctaccttcaaaaagttaaaagacagtaagggttggcaagaatttggagaaaatgaaactctcatacactgttggtaggaatgcaaattgggtacagccattatgaaaaacaatatgaagattcttcaaaaactacaaatataactaccatatgatccagtaatttgacttcaggatatatatcctgaggaactgacgttagtatgttgaagagatatctgctctcccacattcatcgtagcattattcacgatagctaagatacggaagcaacctaagtggcatcagcataaaaacagataaagaaaatgtgttaaatacacacaacagaataatattcagccttagaaaataaagaaatcctgtcatttacaacaacatacgtggacctggaagatactatgttatgtgaaataaggcagacacagaaagacaaatactgcatgatctcacttaagtgtgaaatccaaaaaggccatagatacagggagtaaaatggtggttactagaggctgagtgttggatggtgatgaagaaaggggagatgttattcaaaaagcacaaagtttcagctagacaagaggaataagttttagagatatactgcacagcatgatcactataatttataagagtgtattatatattttgaaactgctgaaagtatactttaaatgttcttaccataaaaacacgataattatttgaggtgatggatgctaattagcttgatttattaattctacaatgtaaacatatactgaacatcacactgtatctcataaatatatataattgtcaatcaaaagtaaaataaaaataaagcaaaacatatatatacacaaaaaagtaaataccaacgtagaattctctaaccaatgaaagtattcttttaaaaagtcaaaataagaatattttcagaaaaacaaaactgcggaaatatttcaccgaaagattcatactataaagaatactaataggtatctttcaagtaaaaggaaaagcatctcagacaatgatagagaaatgcaaaaaataaagtacacagacaagattagtatgcgtataagtatagaaaaataataaaaataatgttttaggaattagagcacttgaagaattataattcaggacaatgataagacaaaaaatgagagagggacaaatataattattcattgaaaagagataaaaggtgtaagttacagtagagctcattagggtaaccactaagaaaaattaaaaatacgtaattagcaagttaaaagaggggcaaatgaaataacaaggttgattaataaaaaaagttaagacagaagaaatgggaaacataaaattggtagaaaaaatagaaaagtacagtaagatgatagaattaaatcaacaaatattagcaagtgcagttaatgtaaatttaaaaagttgcattgaaatacaatgtcagactttgaattaaaaatcaccattaataatatgctatttgcaggacacataccttaaaagtaagtatacagaaaatgtgaaaggaaaagtgctaaaaaaaatttaccaaacaccaacgaaaagaaggctaatatcactatacattataatatcagtctaagtagaatgaaaagaaatagtacaagaagagcattaaataatactagttaatctactaggaagatatcacagttccaaatttgtacaaaccaataacataagcttaaaatgtacaaattgaccaaactaaaaggtgaaataaacaaatacacaatcaagttagaaaattttgacatatttctctcagtaaatgatagaacttggtaaaaagttggtagataaataaaagttttgaacaccaagatttagcaaatttgatctaatttatatgtacagaatcctgcacccaatagcaacaaagtacacatatttgcaggtgcacatagagcatgcaccaaaagtatccttaaactgagtcatatagcaagcctcaataaattttcaaagtatttatatcatatagaatatcttctctgaccgtaattgaattaagctcaaaattaataacaaataagtattataaaatacatcaaatactttcaaataaagcaatagataaacttgataaaagtcaaaaattggggtcttttggtaaagaaagacaaatataagcagtagtcttctagaaacacaaatttcaaagatgaaaaaggacaaataaccttaacaggaatgaaaaaatggagtattgttacagatgctacagacatagtacaaagataataagatctggtgaacaagtttacatcaataaacttgaaaaaattgatgaaacatataaatcccctgaaaaacacatattaccaaaatggacacaagaagaaatggaaatccttcatagtactacgtcttttaaaagacatgaatatttgatttggaaaactcttctggacactggtctagagaaagaattcattaataagacaccaaaagcacaagaaaccaaaacaaaaacagacaaatggtacttaattaaactaaaaagcttctgcccagaaatagaaataatcaagagtgatcagatgacctgcagaatgggagaaaatatgtacaaactatcaatcagacagaggactaacatctagaacttacaaggaactcaaactaaataacaacgacaaaacaaataatcctatcaaaacgtgggcaaaagacatgaatagccatttttcaaaagaagacatacaaatggccaagaaacatataaaaaaaaaagctcaacatcactaatcaaagaaatgtaaattaaaatcacgatgagagatcatctcagactactcagaacagctattacttaaaaagaccaaaaacagcagatcttggcaagcaattgcagaaaaggaaacgcttatacactgttggtgggaatgtaaattactacaatcactatagaaaacaatatggagatttctcaaagaaccaaaaatagatctactatttaacccaacaatcccaccattgggtatatacccccaaaaagaaattattataccaaaaatatacttacactcatatgtttatcacagctctagtcacaatagcaaagatatggagccaacttaaatgtccatcaatggatgattggattaaaaatgtgaaatatatatgtaataggatactatccagctataaaaaagaatggaatcacatcttttgcagcaataagaatggaagtggaggccactattgtaagtgaaataactcagaaacagagacaaatgtcctatgttctcacttataagtgggagctacctaatgtgtacacattgacatagagggtggaatgataaacaatggagactgggaagggtgaggaggaagggggtggatatgagaaattatttaatgggtactatgtgtgttattcaggttatgaatacactgaaagctctgaattcaccactatgcaatatatctatgtaacaaaattacaattgtacaccataattttacacaaataaaagataaaataaaaaagtctttccacaaaactttctgactcaaatagtttcacaggtaaattatttcaaaaatttaatgaaaaaaaaatagcaccaatcatatacaactcttccaagggtagaaatagagggaatacatccgaactcattttatgagaataatataactatgcaaagaaaacctgacaagaacattaagagaaggtaaaattacaagctaatctctcttttgaatgcaaatagaaatatcttaaagaaaatattaagaaaatcaaattctctatgaaaaggataatataacatcaagtagggtttattctaagaatgcaagggtggattaacattcaaaaataaattaattaaataacaaaaatcctatgatctcaatagatccagaaatgtatgtgaatattccttatgatttaaaaaaaaaacaaaacagacaacacagaaacacacataaaacaacaacaccaactcagcaaactcacgaattgaagagaaattctctagtggatacaggaaatttacaattttcaaaaaagcaaaaaccaaacctagaacaaatgttatactagtggtcctagctagtgcacacaagtggtcctagctagtgcaacaagtcaaaaacacttataaattaaagttatatggaatgaaaaggtagaaataaaactgtagttattcacagaaaacatgactgtgttataaaaaattcaaaagaacccacaaagtctaatagaattaataagtaaatttagcaagattcctggccaaggtgaatctctctctctcctctctctttctgactctctctctctctctgtgtcatagatagatagatagatagatatgaattgttttcttatatagtaacaatacacatttagaaaataaaacttaaaatgataccaattacaagagcattaaaaaatctaattgtagaaatgaatctaacaaaaagtatgcaagtccactgtgcagaaaactataaaatattactgattaaagaagaataaaataagtatgaattataatgcatttatagattagatatcagtattcccaaaataccatctcaatcaaaatcccagcaaattacatattgtagagattaacaagcagattctaacatttttatggaaataaaaaggaacaagactaactaaaagaatctaaaagatgagcacagctaaaagatttacactaccagatattaagatttcttctaaatgttcactacttagtcatgcatcattgatgcaagggtaaataaatagattcctggaataagagtccagaaatatgtccatgaatatgtaggcagtacatttataataaagttattgctaacatactcagggaaagtatttttgacaaatggcacttgatcaattttttaaaaagaaaaaatgaatcctgtccatccttgcccccatctcacacctaacacaaaaaaatgaatttcaggtaaaatgcagacctacattttaatggcaaacaataaagattctagaagataacaaaggaaatgtctttatgacattaaggtaggcaaaagcttttccatttttttgtttttgttttaaacaggatagaaaatactaacactaaaagaagaaattgatcattgaagtgcattaaaataaaaaacttttgtaaccaaaagacaactataaggtcaggcgcggcggctcatgcctgtaatcccagcactttgggaggccaaggtggccagatcacctgaggtcgggagtttgagaccagcctggctaacatggtgaaaccccatctctactaaaaatacaaaaattaactgggcatggtggcataagcctgtaatcccagctacttgggaagctgaggcaggagaatcgcttgaactcaggaggcaaattttcagtgagccaagatcgcaccactgcactccagcctgggcgacagagtaagactctgtctcaaaaaagaaaaaaaagacaattataagagagtaaaaacataagcttcagaataaaagtagatatctgtaataagtatatctgacaaagaagtatatatcagaatataaaatgaaatcccagtaacttaataataaaaacagaaacaaacccaactggaaaatggacaatacctttcaacatgcacatcacaaaagaggatacccaagtggaaaataaacatatgaaaagacgcttaatttcactaatcattagagaaatgcaaaccaaagccatcatatcatgggctaccatgtcacacatgcctgaaaaactaaaatgaaaaaagaccaagtgttttcgacgagtagaacaataggatctctcttatacagtagtccccctttatccatggggaatacactccacctcccttagtgaatacctgaaactgcaaatagtacccaatcctacaaatactatgtttttttcctatacataaatacctatttaagatttaacgtatttatacctatttaagatttaatttatttaacattaatgtataaattaggaacagtatgagattaacaacatacttaatcataaaatagaacaattctagcactatactggttatatgaatgtggtctccctccctcctcttctctctctatttccctctcaaaacatctttttgtacttaagggtgagcccttcttgtgatgatatgagatgataaaatttgggctgcagctgactacggataactgaaactgtggaaaactgaaatcatgaatcaagtgggaggggcattactgtgctgctactgatcatgtaaattggtataataacattgaaaattatttggcactatctactaaagctgaacataagcacaccagcaatatcactcctcagcatatatccaataagaatgcttaaatatgtaaaacaagacatgtagtagaatatgcatgtggccaccacaattcataatggcttcaaactggaaataagccaaatgtccatctatagtagaagagctgaaaataataataatagaattgtgattatattaatacatggaaatattataaagcaataaaatagttttaaaatctgcaagcacatgtaaatgcaacataatataaatgaatctcagaaacataatgtgagcacaagaagccacatacagaagaatatataatcacatgattctatttctatatttttcaaaaataaactaatattagaagtcatgatagtggttatcctgaggaagtagagactggaaagatagataaagggatctttgtggtctgctaatgtttttttattggtctggtgctgcttacatgaatatgttcactttgtgaaaattcacttacctatatttttataatttctgaatttgtaactgttttcctgcactaaaatatttcatttaaaaattatctttaaaaacaattgcgaccataagaatttccattgcttttgtttttttttctctgttttcctgctacttagccttaaatatgggcatagtcacagaaatgtgcatatgaggtaaataaagccccagcttgctggctggaggacataaaggggagctccaggaaaactaaaaaatactaatgagagcacagagaaaaaggggctgcagaaagtgatcttatagggttacaaaattctgggctcatctttagctgtacatgcatggatctgatgttaatcagcatatgaatacaattaagaatgaaattaacagatagaccaatgtctacatccaagattgttcactggtatacacacaggacagacctgaaaagcaccgtaagcaaaactgatattgaaaccacagaaggaatcttgtatcttacaacctgaacctaaccaggtcaattgccttttaaaacaaaaatgtcaacattctccatagaatttcaatatgactcagaatctcataacatgatattaagaatatctaagaaataatcctaaatcaccaggcacaagaagaactaggaacatgtgaactcatatgagaaaacataatcaatggagataaaacctaaaatgacacagatgttggaattgtttgacaaaaactttaaatttactattctaaaaatgctgaaacaagcaatgagaaacaggcttaaaactcaaaaataaaattttaaaaaaatacaacaaaatatcactggatggtttccaacaaaataaagataatacagaaaacagtcaataaactttaagatagatcaactgaaattatgcaatatgagcaataaagaaaaaaagtggctcagaaacctgtgggacaataacaagaagtctagcattcatgtcattatattaacagaagcagagaagaaagagtgtgctatgtgttgaatgccccctccaaatctcatgtggaaatttaattgccattgtaacagtgttgagtatcaggacctttaagaggtaagtaagatagactaatgtcattaatgtgggagtttattagttatcacaggagtgagttgttgataaaaagaatagtttggcccagtgtcctctctgtcatgtgctttcttgccacatgatgccttccatcatgagatcacccttgttagatgctagcatcatgatcttagacttctcagcttttagaactgtgagccaaataaatatgtctgttctgtattaattatccaatttctggtattcttttatagcagcagaaaattgactaagattataattctgaaaaggtatttgacaaaatagtggctagaaaattctcaaattctgtgaaatacataaacccacagagtcaagaagtacagcaaaccccaaacagaaaaaaaaaaaatcaatctctggatacattaaaatagaactgctggaaattgaagacagggaaaactgtcttgaaagcatccagagaaaatcacacattatctgtagggaaacaccattcaaatgactgtggaattctcatcagaaaccatgaaaacctgaaggaaatggcaccccttttttaaaggtctgagagagcacagagaattctatatcctgtataaaagagacctgctctaaaacatttgctgaaaggaagctctccagacagaagacaaatgatacaacattgccactgatataaacactgaacattaggaatgaaggaagaggaaaaaaagtgataaacctatgagtaaatataagaaacgattattcttttgggttctttaaaacatgtttgacaatttaatgcaaaattacaacattatctgacggggcttccaatgtatgtagatataatatatgacaaaacaataatgcaaaactgggagagtaaaaggacttatatggttgtaagatttctacattctatttaaatgtctaaaatattgattctaagaagagtataaaaagatatgtatattgaacaactttagaacaacctctaaaaacaactatacaaagaaatatcgtcagaagaacaatagataaatttaaattgaatgctaaaaaatgttcaaataacccaaaacaaaacagaaaatgaaaaacaaaggaaaacagaagaaacaaacagaaaacaaaatataaaatgaaagacattaattcaaatgtaacaataattacattaaatgtaaatggcataaatataccaattaaagacagagattatcagaacggattttttttaatgacccaattatacactgttttcaacaaatttacttcaaatataatgaaaaaggtaggtttgaagaaaagtgtacgtgctgcaaactccaattataataaagctggaatggctatattaatattggacacagtagatctcaaagtgaagaaacctgccagtgatacaaaggacatcatataatgttgaagagttaattagccagtaatatataataagtctaaatctgtatgccctaacaacagagcttcaaaatacatgaagacataaaaactgacagaactgaaaggtgaaatggaaaaatctacaattatatttggagatatcaacacccttctctcagtaatagactaatatataattagtaaaaacagaactgaaaaaattagcttcataagagagagcatatgatcattcagaaacttaacagcatttaagagattatattccttaccaaatttttaggttaacatgagtaaggttttttgatatagccaactacagttttcgtaagagtaatggttacttcttcagagataagtcatatcagcagaggcagaaagctgagaatgggggaggtcaaatctttgtaagatgtaaactgaaaagaaagttttatagaaatgaatttctgctgatctcactgtgaaagtgcagttttcatacttttatgaaacaggcttgttactttgtttaaatatttgtgtaatccaaatagttttgacttcagttaagctgaatatttgctttaaatatttgtttttaaaccccatttatcaattctttagaatcttatataaaaggtacgtggtacttgcttaggaaaataatcaaaaatcagaaagtggcccttttaataatgtgaaatgattcaacaaacagaaaaccaatattttcttataaaatcagtaaggtggtaggtaggtagctataaaaatatttagatttttactacatattaatccttaaaagaaatcaggtaatgagtctgaaataagtttaatgtgtccttcttatttctattttagttacacacacacacatatacacacacactcttacagatagcaaaatatgctaaataggaagtaaacatggtactatggtatggattagtaagaaagtcctaccttagatagcattatctgagaaagtgttttttactttaagaaggattcgactaagcagtgtgagtttaagtgtcagggccagtgccagcatgcttcaatgagaacactgagaataagtgaaagttgaattgtcactggtttcttctaagctaagataaggtttggggcacctaaagtgcactcaactgcaaatactgttagaggccactcatcttccaagggaagtatcaggggaacataaaacttcattgagttctggctagaacaacatcttatgaagctaggtagattccatgtttctcttgctgataccaaggaacaaaggtaaacaaaggtgtcttcacttgcagctgccattgctgctgacaaagcttatctgcccacagagtggtgaatagtaattctaaaggaaacttcttgtctgccaagtagaactttgaagttctgtgtcatcccatgcaactaccccacaaagagcaggtgaatcctgaggtgaagggcactactgcccctatggtgccctgaaagttggagatcaagctttgagcccttcaccaactcaggataaaccagcacaattagacctcctataaatatgaaagaattctgataactccagctccagagattcttggacaagttactaaatggcagtagacagagacagcatagctgcaccttctgctgtatacctgaacactctagctaaaagtcagatatatctatccatgcactaagtggttgaggatcaatataaacaaaacacagttgcctgagttctgtttacagagcacatacgaaattgtctttttctctccacattgtttgcatcattcctaacccctgaattgaattcacttgttagctgcactgttgtgcaggtcttctgatcttgctttactgacttaatgacaaccactctctaaagactgacaaaaatcacactgtttcttttcacactgcccaactgaagtgggccaagttctcatcatcttagctctagtactcaaccttgaaatcatccacagagatgtcttccatgcaagatatttctcactgtaagggaagatgatggtaagtcatcatcttcaaatagaaatgatagctccaaagaggaaaaggaaaaacaactgccactccatcacctctctgactttggctttctagggaatcagttcttctgggtaaggttaaaccaacaaacaaacaaacaaaaaaatggaggtggggggtgtactttattctgttttgtttttaaagaaatggccacttttcatagatagagcaatataagtggaaaataaccaggaggttttagtgaaaatggaaaaggaaaaggcaaattttgtgacatactaggtctaacaattgtttaaatctaaagtttggtgccaaatagtgatggttttaattaatagatggatctgaaacacccatatatcatgctaaagatttagtattaaatatgttctactactgaaaataataccaaggtctctaacgacaagataaacacatgctatattgacaaaagtatgcaaaaaaatgctaatcaaactcagctcataggagcaggagctgaattgaatgatcttgttcccccaaaataaacttccaattcactactcaggttattttccaattgtcactgggacaacacaacaaaagcaggggacaaagttaaaacctggccttttcagtcaagcaagtggacaaatactcaagacaataacccacaaacaaggaagatgacagcggaaaatcccccacattcagttcacccctttgtgaccaaaccctgttctgcaggtcttctgatgacttagactttaagacagcaaggtagacatcctggaaataggccaataataatcttcaactaggaagacatactgaaatcactagggaagcttttttcaacataacctttccctccctcagctgggaatcatagattagatttaatttgtataatcacttcagtttgaagtaggtggatgacctgaagaaaattaaggtataatggcaggcttgccatcagcaagtacgcatttacaaacattttgacaagctatatctggaaatatcctgaggatccaagaatcttggttaactttatacaactacgataaattgggcactacaccaaaacatgcaggctatttgactctgcattttcctcaatcaacaacatgtaacggagaggcctaatataccaaatcattatcgaacagcttagggatgactcactttgacaggaagagcaaagtgtttcactctcatctcagtgaacctgttcatactgacataatgccacatggttcctaatacgcaacaatgtacactgttccagcaacatagaggcagctttgagcctttggatccaaattctgtgagtgagctgggctagagttttctgtttcccttccctcattatcatggcaacagagggcaaaggtggcagttaggctttatgcctggactgctggcatacaggtccacacctcttccaaaacaaaatttggacaatagttacacatgaaaatgttgtgttctgcttaggttataaggaaactaaatcatactgcaggcaactctttagttattttctcttttatcctatcttcaccagaaaatttaaagagctctaaaacagtgtttctcaaactgtaggtcacactgtcagtgctcttgaaattaagatagtgggctgtagactttaaaggaaagttaggataagataaaataggataagataaagtaggataggatgggatgggatgagatactagaggatagaatggaaaatgcaacacataggaagggtaaatactgtcttatgaaattttgttttaattatatgactgcatgtagactgtgtcatgatttaaatgcatttatctctgtggattattaggaaaatgtatgaaaaccactgccgtaaagaacatctatcttatggccctaacagcatttctctacagaaacactattggctttgtgactgggcaaatctcttttctaagtaatttcagctattcatggcaggatttaacatcatatctttcccctatccactgaattccagtagtgcttccttttcatcgtgacaaccacacattttaaatgctacctaggaggagttatcaccatctagagataaatatgaatccatagacaaaaggttgctagctcaactcatatctgatgagaagcaagtgtttctaagtatccttttgtatctagagtttgtcctccaggatgaatggaggtcagctttgatagctcttatctgggacgtgtacactgttccagctacttattctgcaaattaagtcttcctttcctagcacccatcaatctaatactaaattcattagcaaaatgaaatgaaaagaacacaacatacattgctattaatggaattccatgcatgtcactccccacacattgtactaaaaatgaactcatctccatttgagtgtctctacacaaatatctgtgtttattaatacacagcatttcagaagtgagattttccttaaagctgtaaagccatttgctttgtcaagctcccttttcagggaaaaacttcaggaattttcactatcaatttatgttgattatttactcttttgtggatctgctattctccaggcaaaatccaataaggagaaatcatgattactgtctaaagaatttattttgtaatattttttcttacttcctgtaacttactttgtgtgacagtaataaacagttcataatgctccatctactatcctcatccataaaatctagtaacagttcaacatttaaaaattttttaatgaagacaaaaatcagctggtgacttcctactggagcacaaaattaacacttgcactggagtgggtgagattttcttattcagagcagaatacagtctttttcttacggatttaaaaatcttagttacctttccctagcttgaaataataggcattttgggctgggcgcagtggctgatgtctgtaatcccagcactttgggaggccaaggcgagcagatcacttgaggtccggagtttgagaccagcctggccaacatggtgaaaccccatttctactaaaaatacaaaaaattagccagggtggtggcacacacctgtaatcctagttactcaggaggctgaggcaggagaatcacttgaaactaggaagcggaagaagttgccatgagccgagattgcaccactgcactccagcctggccaatagagtgagagtctgtctcagaaaaaaaaaaaaagaaagaaaaagaaagtaataataggcattttgaagacttcaggagaaatagctagaattcataaattacccagaagtgataacactgtacttagattttcacacataaattttcctattcctggatagtgtgggaccaaactatatataaccaagttttaaggtgaccaaaaattaaaattcacaaatactctgaatgtctcaactactttccttccagaaacccaagaaaaactgaagtgatttctcacttcccctaatgagcactaatgacaattagagatgaacagctaacctcaaacacactaaagagtgtttttaaaacagaataccacacaggttgtataaggcttatcttcaaacattttcctcaataaaatgttaataaacaaaaaaaattgacatgagggaaaagagaattggaatgaagaatatcctcctttacttttaaatgacaaaattaacaaacatgagagaaaacaccatttttaaaatgaaaagatcactcatatgagagaaggcagatcacatagtggaatgtctaaggggaaatccaggtggattgcccactggagtatacagttaaaaaatatccaaaggaagaaagaaaagacattagatatttggaaaggtaagtaactaagtaaataaataaataagaaaaatgatgacaaatttgcaagggacaccaacaccaaatgcggtttttgttttttgttgttttgtttgtatgccaaagagaatcagtcagctagtaacaagtaaggaaattcaaacagtagttgttctaggtcaaaaacaaaagatatatatgtacacacacaccacacacacacacatctatatttatatacatacacacacacacacacacacacacacacacacttggagactctcatgcctcaaatatattttgaagcatacaaatttagagagtctagatttaaaacagtggcaaatacaaaagtctttcttaattaaaaagctagctgcagataagtcactagcatcaaataggtaccaatcaaaagtaaaactgtgctcagaaaaactaacttgttcttaaaatggccattttcacaaagtactgaaagattggcaatgtggccaaattcccccaaaaaaggggtttagaagcagcctttgtaaccaaaggcaaacagtgggaatatgtataaaacaggaagatacacgaaaagcttttgcccacttggtgaattgagcctctctatctaggcttcttgtggcattaaagaagcatctgcaaatgcagtaactagaatatataatctattcagattttcaaaaggcttttgagaaagtttcatagcaataactgtgcaaataaattttgggtaaacatggaattagaaatacatattttcacaagcacaaaactatgttagatataggaagaaaatgtgaagtggaaatgatgagagaatgcttttataaattttgactgtggaattcaaagtgtcaactgcacatatttatatttcactatccttttcaaatagtaaaatatcaaaccacagcatcacggaatcctaaagagctgggatgactccctacgtactacagattaagaaactgagctacagaggattaataattgcccaaggttaaaacatatagacatcaggaagatttcataacgtttacaaacttgaacaaaaagtaccacatgagctcccctatggggatgtgttgagtattatatttcactagtgataaagaatacaaaactgttcacataaatgtggcctttaaaatatggtccctaaacaagaaccttaaaagaattataatacattccctgaaaacatttcaatgtgttctggttacaaagatattcaaaattctagacatcatcagaagtgctttggatccagtcttagggagatccaacatttaatagctatcagaaaaaaatgcctgcaaaggacatagtgaggatatcagaaaaaaatgcctgcaaaggacatagtgaggaaatgacaaggagcataggaagaaaatcaagaaagcatgacgccatgaaaaataagggaagaaagcattgcaataaggaaggagtggtcagcaagatcaaatgctcagtgaggtcccagtgagagttaatttggagaagtgatggaggtccctgcagcagacaaggtgaattgctgaatggattggtgaagaaatggaaatagagagtagaaacatttctttgaagaaatgtgagtgtccttctacaggtaaaaaaaaaaaaaatacatgataactggtcaatctctgaaagtgtgggtccagcggttttaagaggagattcagtattacccaccatactcgttttttttttttaaccataattcctagtcaaatatgtcataagcccaggaaaaggatctcaaaagaacttagaactatcctccttcaatacaaaaaataaaaggcatctggtttgcagtagggttgtagaccttgcaagacttctgcattttggtttaatcagagattttccagaagtctaaaaataattattcatctttgaaaaataagggtaccatacagctatctagctctgtaatccaaggaaaaatcaattatcttaaaagatgccttatgaggtcattgtttcacatgataaaacaagaacattaggaggacaagtctcggttggaagtctcagatcactctaattgttctaattgatgaatcttcttcaaggaaaaaagtgggctccatttctgtttttaaaaatccagagtatctgtagtagtgcaactaatgacaaccttcccgttgttcttgcctaagaggaaaccctataataagagcttcccaaaatgtcaaataatacttgtctcataacagggcttctttgttcattcaccatgtctcttttgatatgcacagataataaaagttcatataaaactaaaggtaatatagagcagaagccaacactaattctgtataaatatgtctgattaataagaatgctattgttatggttatttcataatgtcacgattgttacaagaacagaggatagaagtactcttactcttactgttttcgttcatcctctgtcatccaaccagtttgcaaatttctgttcaacgggaaaaatgaaggatagatttttgtccattaattactgctgttgcataagttagtctcataaattgtgaaatgagcattaaattcagggaaaaattaggggttttattttaaaattgaactccacttccactacaaaaatgaatacatgctccaggcttactttctaagctcccttttccacatgcacagttgctatattcttctggtgctcatgaacacatgaaagatagaatttagcatgatagcactaaaatctaggtaagagcctagtatattaaacctaaactgtggtttaatacaacaaccatacacaaaattgtatatgggatttggttccaaaaattagaaccccaccctggtgaagtaataagtaaccccacccagatgtgagtatctggtcccttactggaaaggaaataaaaacaagtaataagataacagtctacactcactgcagacagacagcccgatagattttgaaggaaattctaaggctggtagataagtttgtattgtcattattttgcttttctctttaaattcttatctcctagatcctggtattcccccttggggcagcagtataatataaaagcttaacagtcgatcttaaatttagctgacatttttatatccttcaaaacataccttttagattgcacccaagaaggagattattaaatagtagcaggagaccagttagtggaccattttgactgaacaaaaaacagcactgtgccttcttgttgacaaaccaaaaaacatttatatagtcattataatcaatttcataaataaaaggctattaatgactgagaaaaaaagggaaaaactgtatttctcccaagtcccttcatcctctcttaaactccatattagtttaagaaagtggaggaagctatgcatgaaaaatagtgtacttagttgagctggagtctcttgtgaaacaggttctgtcagtcagaaggcaagggtacatttctataattatttaagcctagtttttttgtagtaattagccagagctccattttgctgaagctggcatcactcacagctcacttttttttttcaatttagacttttcattcctttttataaaataaatttacatattttcagtctctcaatccctcctatgttttatttatgaatatagcccttcttgatggtaactctaatgtgaaagaggtagtaattaatgtcccaatctgctaggttaatccctttccacactctctatagagaagtttaaggtaagtaacagtttacagtcaatattaggtttaattatgcttaatgagagttggtgtctctgtttactaactgcatttaggtgtgtggatcctagatgaattttcccttggcctcattctgatttgttaatagtgccactgtgtactgtatactcagtgcttaaatctataaagctgcttctggagaacaaagcaagtaaggcacctgtttcagttgaaacattattaaacaaatgagtgaagttttaccgcaaccacatctttctttgggaaggtgctgttattttataatgctttccaaacaggtccatgtaaaaggctaattgctgcctaaattcaagatcctaggttaagtctatacatattaaaaaatgtttcaaactaagtacaataatcaatggtgagtattttaaaactatggagtattaaacacttctaagactttctgtattaatctttcaatgttttcattccaagtactataattgaaaactactttgacaagtagtttttttgccttgaaaatgtcttttgtcttaaaattatattcaactttgttgctgtgtataagacaaaacttttgtttccttactgaaactataaaaataagcatcaaaacaaacaccttggcctcaaggaaatcagatagtaagccgagggaaatttagtaaacaaatttttaaagaacccctttttcctatatttttgttatggataaattatgtatacaactgaccatgtagtttctttaagtccattcatagtctaatcaatttagtaaacatttattgagtaaatactttgagctaagcacaaaaatgaacatgacatactcccttctctcaagaagcttaccatctagaaaggagccaggcatgagttaaaaactttaataggctgggtgcagaggcttacacctgtaatctcagcactttgggaggccaaggtgggtggatcacctgaggtcgggagttcaaaaccagcctggtcaacatggtgaaaccccgtctctaccaaaaatacaaaaattagccaggtgtggtggagcacgcctgtaattccagctacttgggaacctgaggcatgagaaatgcttgaatccgggaggcagaagttgcaatgagccaagattgggccactgcactccagcctgggcaacagagtgcgagtctgtctcaaaaagcaaacaaacaaacaaaacccaaaaaacactatgctacaatatggtaaatcatactcatgcattaagaagacacagaaaagatcagttgatctgtagaggataaataaggcctctgctggtgaaatagcaagttttttctgggtcatgtgcagactatagcaggctaaatgaacagtaagagcaaaggcagaaagcatggcatccacagtgtatttaaaagacagcaaacagtgaagtgtgtgttgaaagaactatgtgcctgggtggaggaggcggggggtgatgggaagagatatgggagtttggaagttaggggctcaaagagtggactgagaccgaattaagaattttcaatgtcatcttgtgttagcttttatgtaatatgagggataggaaaaggtaaagagataacactactaaacaaggataaggtctgaataaattccttcaaattaaactgaattcttctaagcctactgatctttgaaaaacattttcaaatttcaaacctcccataatgttatttggaagcccttgcatttagatcaaagaatttgtgccatgtggaaaaaaattcctaaaatatgtctatctgaaagatgggatgataacatattaatggaagccagtagaaagagaagctgttaggtttataccccagggaatcctgagaaatctgcaaataattaaatgtactttgtgatataaaaatctgtttataattaatttcagaaattttctgccttttgaaaattctcccttagttaatatatcatgatgttgtttttgttttttaaattttaattggcaactaaaagttgtatatacttatgatatacaacatgctatttttaacgcatgccttactccacatatttttgtagtgagaagacttaaggtatactctcatagcaatttttaagtatagagtatatttttatttacacaatgtacaacatatctcttcaacttattcctcctgtctaagtgaaattttgtaccccttgaccagcagctccccagtctctcatcccagcctctggtaaccaacattatactctccgtttctatgagcttgacttttttagattccacatataagtgagatcatgcagcatttgtctttctgtacctggcttatttcacttaaaaatcctccaggtctatccatgttgtcacaaataacagcattttcttttttaaagatgacttacattgcatcatgtttatgtatattattatctattcctccattgatggtcacatgataacatccattctgacaggtgtgaggtggtactcactgtggttttaatttgcatttctccgatgattagtgatgttgagcattttttcatatacccattaaccatttgtatgtcttcttttgagatacgtctattcaggtcctttgcctatttttcagttgggttatttgttttcttactattgagttgtttgagttccttatatattttggatattaaccccttatcaggtgtacattttgaaaacatattcttccattccttaggttgtgtctttactgttaagtgtttgcttttagaaaaataaaaaaagaggcaaacatttccttaaaatccataaactaatgagttttaaaagaaaagaatgccatccaaactacctaatcagaaaaagactttctacagcttagatcctgtttttatagtattttagaaatgtctaaacacatggcctatgacaaatacttgcctctttttggaacatcaattacttctttgtaacggtatactgatttccttttaaggaataatctctttcccttccagtatagtattggtgagacggtaactccaggttcaaagataaacttggggaaattaggtagataaaaacagagaacatgcaaaaaaataaagaagcacacgaggtgaatgaagaaaaatgtagcaaatttatcagaaagatggaaattgtttaaaaaagttttaatattttctaaatatggtgaacatttctccaatttaaataatcatcagttatttaacactttctatgtgctaggtattcaattcatcaatttattaataatatctccaatcctaattataaccccaagagatagatgttattttttccattttattttatcggtgtgtaggcttaaacccagagaactaaagtaatttgcccaactgttagtgaatagttcagtcaagactgaatctcaaatccagtggaaaataaaatggtatgtccagtataggaagtacaaaacatacaggttaaataaacaaacgttcacatatacctatcaataaagaactccaaaattacatcagtctgttaaaaacaagccactcaaagctctagagttaactaaggtagtaacataattctgaaattaaaatgaaaatatttacataaagttaaatatttttttaaaaaatctttaaaaagtacactcaaacatactgggaaaacatttttcatgggaaacattttaggataatactatctattctataagaaaagagtcaccttcctgaagagttctttgctttcagtgctgttgcctaaattaactttctgttatgaaacacatcacgctagttttaacctagagaataatttgaacaaaaccaagttaaccatttctaaaatacttaaaatacaaagaggtggttgtgtaaccttgaagataattattcagatgtttttaagtattcatctctccatagtattttagatttaattttgtgaatttagcaacaaagaacacagtttagcacaaaatgagaaaacctgttcagaagtgaagaaatcatctaaatattaatagattttattaaatagcagcagaaaacgttatacttggtgttattttcagctatataaatatcttatttttatccaataaaaaacatactaaattcctccatttcaaatactgatgatatcagcaaagtgttcacacatctggatatctttctgtgtttacctaaactgacctttctggtatgtactgtactttctatctcagtatcttcagtgtacatttgcaaaaactacttgaacagtttacattctcccacaccatgctacttcaaatggtcttcaagactttcaaattactgtcagacactgggcattttgtaggcatatacttttgcattcctcctcaagggaaaaaaaaggggggaaagcctagattcaaatggtaataaagtctctttcaccctgataaatacatttaaaaagttgatctcggctggtcgcagtggctcacgcctgtaatctcaacactttgggaggccgaagcgggtggatcacccgaggtcaggagttcaagaccagcctggccaatgtggtgaaaccccatctctactaaaaatacaaaaattagccaggcgtggtggcgggcacctataatcccagctactcaggaggctgaggcacgagaattgcttgaacccaggaggcggaggttgcagtgagccaagatcaccccattgcactccaacctaggtgacacagcgagactctgtctcaaaaaaaaaaaaaagagttgatctcatcctgatgctagagttgtataaaagaagatcttagtgttaactcacaagctattatataaaaatatttgtatatatgtataccaatgtactatgcataaacacatttgaatatagcatgcgtatatatgcaatctatttagtatatttgaatgtatatattatatatagatacatatgcatttacatttccacatttattccaaaaacttagagagaaaatacttaaactgttttcaaaatacaaattctaaatgaaataaaatgttctttaaaaactgtaattaatggctgttatgtcaaactgtgaaccaaaaaggtcaaaccttataatttacagtttgagaggtcatacctcaaattataaccttaaaaaactgattatttgtgagtaatttgacaaatgcatctaatataaactgaatgcatatgaaatatttttgcgagtaaaaagaatgtatgtccaagtggacagctgatggaggaaatagccttttactgaacaaggctgaagtccaacataatgacttggaatgcctttgaataagcatgcaggttggaaggccaaacagtacacacatccaaaagggagcataatgaactatctgatcagaagacaaaaatactccacatatacacccaatgagaaaaaagaaaacacacttcggtcacctcctcttttttcatcattactataccccaattcacgaatgaactctgggctattgataaataatcatcaaaagaaatgatttttataatttaaaaatactagaaattcctataatattccaatctgagattttcaaatgtctatggagatcttctatatcatataaagtaagccaggtttacaaaactgtttacgactcatcttggatgcaaatattaccacacctagcttcatctcaaagccacctgctccttaaaacataatctgaaatactttggcctctccacaatttttaatctacaagtcatccaccattaagaaggcagatcattgaagataattttctccaccgtagactcaattccctaacccaagctagaattgagaaggttagcaaaatagtcatttattaatatatctatgtctctaatatttatttatgtgcttattatatctccctgttagactataagctcaacaaggataaagactaagtctcttttgttcaacagttatctataacatctacaaagtttctggcacagagctagcattccataaatattcgctagaaaatggaaagaaggggttgacagaagaaaggagggaggattgagttagctagtctcctctagtattatttgtgcaattgtggagagaaaaatccctaaaaatgtacactgtatttaatcaatttacccatccaacaattcactgatacatcgatccttgaaaccaaaaagatttaaaatggcttccaaaagtacacaattatacaataaaataaattaaaacagatgaaaaatgaaagggatacaaaatatagttgggaacaggatatttctatacgtatactggtaaagtcagttaaatcacaggaaagagaaggaatttgctttttaatttctccaatttaaccttattgtaactactattataatagtgttataaacactaagcaaatatttactcgttccttatctaaccattactatggcaaatactctataaccaggtaccttatattatgagccaggcaatctattggatgagacaaatattcagttataagaaagtataatatgtatgttataacagtaaaattatagatttttgtaggagagaaaagtaggattctctgaaccaacaaaaatgcttacatggtaactgctgaactatgaacccaatacttcatgtaccaagagatttttctgatacatgtaaatatgcatagttcttgatacacagggaaatatgtggtctcaaatgttaccagtacaaatgagacttgcacatgtaaatcacaatatgataagaaaacacatttgaaaagcattatctttcttgtaagtgaaagcttaaatctgattccacttagcctggtaagtgtttttgtcattccgttgggccagcccacacatactgggctcttgataggtcctgggctcaaccagctggccctttgtgtacttaattctttttttaatactgacgagtgtattagtaacacttccttgatcactggtaaatatacagctaccacacaactaagattttccttaattctgaaattcactaattagttgtgggtacgggttagtattacaaaggtatgttgagtggtactacaatgagtaatgtaattcccaaaaagaactgtgttaatttacttcccacttcattagaggaataaaaaacatcttattatcactaaaggatacagaaagagacctgggtattttagggaatggtagacagggagaaagcatgaatgcagcattgaggcaagaaacacaaatcacctatacatcttggacaatgttcgtgcttcttcttaatactttctgcttgcttcatttattagtgtgtttcatgaaaacattttattcaattaataaacaggtttccaaagaaagcaaataaggtaaatgattcctattttcaaaaacttatcattctactggtacgtaagttatgcattagtcaactctggaagctgcattaatcttttcaagccaataaggtcacaatcaattacttgagatagcagaataaaatacaggcttaaaagaaataatgcagccgggggcggtggctcacgcctgtaatcccagcactttgggaggccgaggcgggcagatcacgaggtcagcagatcgagaccatcctggctaacgcggtgaaacctcgtgtctactaaaaatacaaaaaattagccaggcatggtagtgggcgcctgtagtcccagctacttgggaggctaaggcaggagaatagcaagaacccgggaggtggagcttgcagtgagcccagatcatgccactgcactccagcctgggcaacagagcgagactccgtcaaaaaaaaaaaaaagataatgcaatttccaaaggtgctaccaagtcatttagagagaacatatggtacaattatgagtatcaaaactgggaatttatatattttaagcctaccataaaacatatttactttttttcttttgttggatgagagatattctaacgctgtttattttttcggaagattcagattattcaaagtgtatcagctgattgttatgtgtgttaattcaagcactgagtttaaataatcataactcaactccctaaaactgaagattctgtgtaaggttgggccagtgccctcattcctaggatcaaaccatgtaagaccagacaaaggtctcagagattttggggggttccagtctttctcctttgtccatagacgtgttagggaaaggatgacattttcttatagtacttaccccaaataactaaaatctcaacaaaaaatagataaaagtgcggattgtaaaataggtgttaataattccttaatcaaatcttgtaactaatgaaaaaacactagtttatatgcagaagtaaactgacgaaaggatgaacagaataaacaaggaggaaaagacacatttttaaatatgtaatttagaaactgtcaaaaaaagtgggacatgtcttatttaactggtgtatgagaagaatggatggttttacaggcacataaatgcaggtacagaaaggtaataggagctttgtattacaatggaacttaaactcctctgggcagtgatcagctaagatggaacagagacagttacaatgcaatgattaactagtggacaaagctattatttatggcaggtatgtaagcaattggggcagcaatgttggaggcccctcctcatcaagcagctttgccagtacagactggatgcctggaaccaggaaagacacaaaaacaataaaacctagagccagctaagggagattcaatgcaatccatctccaaattttaaatattactggaaatctacactgaagaatgttttcccttgggattggcatacactgtggttatagaatgttgaccaacacttacctttatttatctcactatgcagagcaatatgcctaaaatacctacttagaaattctcattatattacagaaaaaggagattctaacattagttggcaaaaatttttgttgataggcatgaacatcatgtcattacatgaacagatcattaaagtgagtccatttcattgacagtatatattgtgggtctttttattctgaacaaccaaacaaaacaaacacacaagaggtcattgtgccttccctcatttggttggcagctttatctgtaaaatatgaaaataaaaaactaacatggactacaatcctgcatgtaccattggtacctgcatagtaccatttctgcataagatttaatcaaatattttattcatgttctgaaatcctgatatttgtgaagatggaaaaatacacgggatatttttaactttcaacttcatgatctccagtaaaagtagaaaaataatcatatttcatattatttggttttttgagctagccaaaaaattattagtatacaagaaaaaaggaagttaccactcttcacttgtcttcaggtcttttaatgtaatctcaggaaaaaaacatatttaacaaaaatggaaattatcatgttaaaatctattccactttgaaaagcgatattctttctccctctcagataattttaaatataaacctgaaatgttcataaccaaataaatcgtctagcagataaccaatcaccaaacattaattttacacaatgaggtttctttaatttctctctgtctctctcacagacacacacacacacacacattcacacagacaggttgctaacttgattcttagtatggtaacttaaactcataaccactccaaaatatactttaccttgattttgtgaataaaaataaataatcttatggggcaaggcagggataaaaattagaagtatatttctaactttaatagctaataataaaaagaacagcagaaattactgaaaattatattgctaaaatgtatctgtacatgtggctgtgaaaacttacgtgcaaagagaattctcgttaactaccttcagaaagaggtaatgaaatatgaggtttaagagtacatctttagtacttctgtaccttaaaatattgccgagtattaatttttcatcaagttgtcattttctctgacatttggttttattaatcaaggcatttatcattaatttgtagaaaatatcgtaattaagccaaataaaataaaatccttaaaaggttaaaattagaaagcaggtgaattagaactttgacattaccctgttgacatacaggagctttctggaagtatgagaatgaagtttttttcagtgagtttggtgcctcgatcttggggctggctggtttttaaaaaatgttataaagatttgatttaaacctctctgacagttttgacattcaggtgaaagtactgctgctgcatttggaacaatttgcatatcccactgctaaacggaatgtttgaggtgtgcactggtgtaaagaaattaaaaacaagctatcacacatgcttaagtgtatgtattcacaaaactgatggttggatcgcaccaccccatccccctccaatgtaatctgtgatttactcttctataataaattaccctaccatgttagtctcactggaaaatctaaccatgcatgtaagaagaaaagtaattacagccccctcttgtctaagaagcctccttcaatccctgtgagctctttatacacaatgcagccacacgagtctattgtaaacttcttgcctgaaattctggacttctgactatcagtagccactaaatctcatctgaagagtttcaatgtccccaacaaatacaattttatttcttatagttaattgtaaagctcttcctcaggagaaattgttactgacattctgactttaagccaatatgtctgtttaacaaaagaacacagtttaaaatcatgagttccaaaccagttaaaaaaaaaaaaaaaaaggaggacagagggacataatacataatgaaatagaaggaacaagagttagagcaacacctaattaagctgaaatattcagaaagagtataaaatttctactttttaacttacaatttcatattatttttaggtatacatagaaaaagatatttaatgtgtttaaggacaataaaagaaaaataataaaataaaagaaaagttgaggtagcaaatccaagaccttaaatattataagacaattcaagaagataaagcccattcaggaaaataccactggacattaccttcagccttcagagtcccaaaggcaattcttaacacttctttttatttgtctgtaaaaaaaggaatacttaaaattagaaatctgccaaggaaaacatttgcatttctataatatctttatgacccaggtagctgagtttgtgtatgccaactaatatctatagttttaaaaagaaaactgaaagctaacacattcatatgtgtacaagtactcagtaaaacgtggcccaaatatacaatctaaaccactgcatatacatttttgaggaggcatagcacggtgtttgctatagtatcataagaagttatcttaactcataaggatatttgcatttttatttcatgttttcttttaagaaaagcaaatcccaaattgcttttaacctatttacttgctcattcttattaacagagagttcgcaaagttctatgatgtataatgtactggtcatcactggtgagtttaaaagtatgcaaagataaaacacaagccctattctcaaaatagtaggtaaggttagagatatttgcataaactcagataaaccaaagaaaataaaaagaaaatgggtggaaagaaataaagatgcaaagggtaacatgttcagtacagcttagtacctaaggcattgacattaaaacatggcttaatatttcctgttttagcagaaaggctaatagtagggtcctacccatatttagatgcaaggatgccaaacaaatggatgggttgcttttaaatttctttagtaaagaattgaagctggatgggaacaggcaggatgttgagtttactttaaagccaatttggtgattttgactatagaaagatttaactaaaaacagctctcctattaaaaattgaatttgatgttgtgttcccattagaaaatgatctctctaaatttgctatgaaatctcaatgatgaccttgatgccacatttactaataatctccacagagatttaggcattcaaagtttcaaaagcagttttaataatggaaatgcaatacctaaacatatgcttgattatataatctagtacatctacagtaaaatgcccattaaaattttaaaaatctgaggattttaattgactatatcattaatatgcatgcacagtatttttgcaaacaacaaaccacactagtaaaccaaaacaaacctaaggattggttgcactaatagacaaatagggtccagaaaaggaatctgacactcctgttatatttggggtgcatcagcattattacagttattctgcatcagcaaactaggagggatgctaaaagttagtaactgctaggaggagtgagaccagaacaattaatgatgaagaaataggatgattaggaacagaaaagaaaaaatgttctgatcatagagataaagtggaggacacctttgagaaaattaatttggtaactacatgatatattacaaaagttacttttattaatttattacctgtctcttcctctagaatggaagtaacataagggcaggcactttctctttttcactgtaaccccattttcttgaatagtgcctgccatatactaggatatcaatgaatatgtactcagtgaatgaatgaacagcctaaccaataaaacaggcactaaatctgtatctatttacagatgagaaatttaggcttaaagaaattaaatcatgtacaccaaattaaattgtcattctgcaactacaaacttctacaatgcattctttattcttccattcaatattcattctagcaacaggagaaacagacaataaacaaataaactgttagacttataatgtcatataattagtactatgaagtcagataaaacaagataatgacactgagagttacctggcctgatattttagatagatttggacagggaaacttctcaaaggacgtaagaataataagaaacctgaatcaagtaaagaagacagtcaaaacaaaaaaatctgaaggactggctgggtgaggtggctcacacctgtaatcccagcagttcgggaggccgaggcaggcggatcacctgaggtcagaagttcaagaccagcctgctcaacatggcgaaaccccatctctactaaaatacaaaaaattagccgggcgtggtggcgggcacctgtaatcccagctactcaggaggctgaagcaggagaattgcttgatcctaagaggtggaggttgcagtgagccaagatcgcgccactgcccttcagcctgggtgataagagcaaaactccgcctcaaaaaaaaaaaaaaatctgaaggaccgtttgaattgttttaggattaaataatacatatttccttgcctagtataatggccagcatataccaaacagtgtactcaatactttttattatattgctaatatttttataaattatgtttccccactagattacattgtcaaaggcatttactgttattttccttaaggttccttaaatagtgcctagcaagagctcaataaacacttagagaacaaaaatagaaagacacaattttcagttcattaattagaaaataaacagactacatgaatatgaaaaagtcaccatctttcgtatacctgaatcaatcaaactctgttaaatcaatttcacataatatttcacctttcctaaattaaaaaaaaaagaaaaaggggaaaatatattaaatggctagggccaagaagtcatagataacaaaagaataagaaagaatcagaagaaaattaagttattaacatgaggccactctctttactatttacatgctgtctgactccatcagattaacacatttttccagtgaagggacattgctacacagatatctgattcatttatgtattcctaatgcaagcacaagccttgctatgtaacaaataatcaaaaaaatctttgttgtcctgaaatgaactaaaatgatgtttagtagttttgatgctttaaagctagctcaaaacaataacaacaaaccaggggactgacaaacttaaaaaacaaatttaaatgagaaaacatcaagcattaggtttgagtcctatagcaaagaagcagagaacaaggtaggttctttccaaagagttaaatataagtgacagtgtgatattggcattggaagagatagatcagtagaagaggccaggggaacttaggtatggggtaaatgttacaagtaacatttccatgaacaatgttgagatagctgactgattacctgtggcaaaataaattctgttctctaattcttatcagtactaaaatataaatcaggtcaataaaactcaatataatatataaaacaatcaaggacctctaagaaaatacatatgtataattttctgaactccaatgtgggaaggacttttaaagtacatacacagtggtatataatataagcataaagatttatgatgtttactacttaaaattaaaaattttagcctgggcaacatggtgaaaccctgtctccacaaaaaatacaaaaattagttggacatggtggtgcacaactgtagtcccagctactcaggaggctgaggtgggaggatcacctgagcctggagaggtcaaggctacagtgaaccatgatcctgccactgtactccagtatgggcaagagaacaagacccagtctcaaaaaaaaaaaaaaaaaaagtgtaaggcagaaaacatctttaacaaaattcaaacttaagaggccaataaaaaataaatatttttaaagtgtataatgttcattgggttaagagtctttataaataaataaacatattattctactttttaaaatgagcaaaatacatgaataggcaattcacaatagaattgtgagttctcttctaaaatatggaatgcatttataaatatatttaaacatatataaaatatattttaaactatatataaaatagtaatacttattactatttattattaaataatattattaattctaatacctataagtaataaggtgaaataagaagctaaaatacatatgaaataatattaatctgcaatagcaatgaaagaaatgcaaattaaataaactaaaatattttagaatagtgaactggttagataaattatatgtaataggatattaagtgttcattagacatggcaagtgaaaatatataatacatcattaagcttagaaaacaggttataaaatggtaataatgataacataccataccaatatttaataatttttctctatataatataaatacagactatgcacaacttttggttatgtgcatatgtaagtatagatctgtatgtaccaggtgtgtgtgtgtgtgtgtgcttgtgtgtgcattagaaaaagtatgtatgtgactgtaaaaaacttaaactacattattctttgaatttatcttaagattatgacagtttttttcttcttagaatttgtttccaaattttctgtaataaaaacaaattactttttataaacataaaaagcactaaagaaggcacctagtttatgtttcaggaaagaaaaatttaatttatattattagaattcctgaatgttaagaaagacatttgaaaatgtctatctgtcatttttggtgaaacctttttaactgcatagatttttttagagaaaaaaaaatgtaaggaaggaaaggagaaagggcaggtatcgtgaggaagggaagagaacaacaaagaaagaaaaataggatttataaagataacagcaactactcagaatggtatctattaggttcctagcaaccaaattttaactggtaacatctccaattaaactttcaaagaaaagcacagcctggaatgtagaaaacttaagttggaggttacatttatactgtgaacatacttttacaagagaaaatagatgaaatgttcatcgatttcaatgataggactactgtataaagagagacaaaatacaccatgagaacataagatgctccaaatcagttttggaaataggagtagtataaatttcaattaagtaaaagtttaaagtaagcaaattttaagtagctataaaatcatgctgttcattcccatataagaaattttcaatccatagtccttaacatgtcattcaaaacatatgaccctacaacatatgaactatgacttctggttaattgtttcaatggacattattttgtataaggccttcccaatgagtacaaaatgaatagaaactgttaaagaccattatctattaataattatagcaaacaagtcttcattaaataaaaatttaaacataaggtttaattgtattttattttaaaaggcaaatgaaagccaattgatcatcctgaaagatcataaagaacctgtacagttccatcgtcaagaagacaaggatacattccttcaaagactggaaaagctttaatttcagttcatccataatcatgcatcctaaggtggaggtattcattttggatttggatatattattagagtttttaaaacaccagggaaatctggtaagttctatggtatattctcaaagaacatttcataagattggtctggctaaaccccatactaaagccatctgaaataaagtcaaattccatggagctggagctcgagagcaacaacaaaagaccattcactgactcagttatacttgctcttaggtatttcaggttcgcttctaaatagggggaaaaagtacagaaagattaggtactaaatactgtttttaactctaaaatacaatcaatttttttctttacttgtctgtttaaaagtaacccgagcccttccttttattatgtgaagcttcattctgtttatttttatttcccaagagcagaatgccttaaataaattcttaaaaaccaacacatcaacaaataaataaattaaaactcagtgactataaaaagtacacaatctaacctgcttaattattaacaggtaaacacaatgaacttctaaattatttacttaatccccttcaactaaaaactttaaagtttttgggcttgaaatgtatatcctttctaagggtccataaaacaattatttaaaaatctatttagccattttagtaaaagcaattttaaaataccaaggtaaatatgcacttaaacatttacataagttcataaaaaatagaagactttttttaaatttcacaggtcagtaaaattatttttcttccagctttccctagtcttctgtcagatatttcactccaccatgagcagaaatattcagtactaaattatattagattgatataatagttttgaagtaagcatttatagaatactcttattcctgagtataccataagaaatgtataattatgaaactataaaaatattaataattttgaaacttcaagaaaaaaagaatgaataaattaaaaaatcaccattttctccagataagactggactattttcaccagcgtagctaatcactgaagaaagattgctgcttgatgcaagtaaccattgattacctgaaatgttggttagttaaatgttctggttagctaagggttctagggggaaaggtgtttttgtttttagatcattttaactaaaaatataagatgttctactagatttctctgctttagtaaatagggaattataattttatctttcacttaaaatgaaaaaattatgttgccttagaggatggctcttgaacttttgggaagtcagaagggcctctgggacgatgaaaaaaaaccaagaatcttttttctctagaaaagtgcatatgatcacgaaattttgtatgaaatttccagggatccagagacccaataaaaaccccttgctttctaattttacagaattctaaataactagacataggagattgcactcatacagtaacccccaggacaaaaggagaatgtttgaagttccttcagaagacaggcctaataatgagctattttgttatgatttgtaacctttcttctaaaaggggtgtgtaaaaacaattcttgttaatttagtcttggttaaaggttaaatatgtttcctttaaggacaattgcattacaaggtatttgagctttgaaacaaaatagtgctgctttaaaatcattccacattttagaagtgacagcaattttcttcctatatttttgtaacaatagaaggcagagtcaaagagaaatctatttaattttcatctttacttctaaagattaacagataatagcaaatacatgagcagtccccatattcaggttctgttcaaagcgcttttatttgtatttacttatttaaacctaacaaaaactctaggaggtaggtaatatcatcatacccactttatcaatgtgtaaactaaggaacagagggagtaagtaatttgccaaaggacacccttttactgagcggcagaaccaggatttatgcccccgtcaatctggttgcagagttcggattcctacagaccatgttccatttccagctttaatctttcatgagttcttcaatctttcatgagttgatggtttttcttgtgtgttattatatttaacacaagtctacttcttcactaccatgcaaggaactttcatactggttttcccagaaaaattcatttggtgaattgttcataagatgctgacaaaactggccccacctttgtgcagctggcagttttataccatagtaaatttcccagagtcaatgccaaaaattaaaaaactaaggtaccaccagctagtaagtgtggaattatacaatcaaagctgacctctcatttcctttttggaaatagttttcatgggataaatatgtgaatgattatattccaaaggcaaccaagacaacagtataaatgggcaatattatcataataacttctcaaaggcaggattgtctgctattcctaattcatctgatgagaggtacaccagtcgatacaacttttaatttctagtcctaaatcatttctatgaaataacatgtcaaagtaaaatgcatacttaatgagggccagcaaggggccaaatttgcagtatgactattttcttgaaatatcctcttggcagattgctaccaaagacagcaaccaatttgtaatgcaggatttgcttttagtgtaccaatctttacacattgagtaattccatgaagagaaaaggctgacttaaaaaataaataaaataaataaatcccatccttatggtttgcacagaacaggttttagttataaattcattccatttaatttttattgaattactccctaaaataaatgcaaacaggcaggtaccagtgagacacaagtataaaagggcacaataaagcagaatgttcaaagtcctgtgggtacatgtgcacaacacgcagtttagttacatatgtatacatgtgccttgttagtgtgctgcacccagtaactcgtcattttttaaaaatctttgtccttttctcaaatcctccctccaaagtccaaagtttttttttacattagacctatagacttttatgaagaaattcatttcaatgcagccaagctaggctgggaatgagaacctggtttaatataaaagtatgcctggaataaaatatcatcctttgcctctatctatctctatatcatcctacacaccataataaaacaaatatttggaaataatctagttatttcctataataattcctaatgatttacagtatcaagtcctatatacttggttttcaaattcctccataatctagttccattatatatcctaattccaaataatgcagaaattatactgtctcacccaatgaaataagattttaaataaatatacattgtttcagcaaacaattattgggtttacaatgtgtcatgcaatgttcatgtagctgaaatattttcacatatatatcaggcttttcctatgccctcaacatgtccttcacgatgtccttcctatatagttcagcatgaggtattcgtctctactctgtcaatttctgttaaattcatagtgaactcaaattaattttaactcgagaaatgccagttagagaaattaaagcatgatatataattacaccgaggaaccagatttagaaccggagaagcattgtttctcaaggccgttcttgtcttcatatttcatggtcaaaggtcaatgttgaaaaagctgatgaaagctaatagtaaaactctcaagtctgtacccaagcaaagcacctgatcagtatctgatccaagcaagtcaaaaaaggaaagaagtttgtgtgtaacttttggcttcagactgatatgaaaggcttcatcctttcaattaaggcatagacttttgcctatctgtgatataaaatatattaacagctatagactaggaatttttacatttaagccaaaatacagccaacagagtttaaattttaagtaatttgttaaactaaattaactgaattttcaattataggttttaaatgcttagaaattttccatacgtttgttatagacctcttgttattttctagtttcaaaaatgtgtctttgcataaactcacggttttcaggtttttcacaactgcttcaataagcattacagtaatgctttttaaaacgaaacgatttcctttgctatattattgcccagttgacgttcttatccaaagccagttttgctctctgaatttacttttttctttcttctccccaaaggtgtattgatatgatacacactccttccatttcctggtttaatttgaacatgtcatcctcccacatcataatccagtccatctaccaacaacttatttttcttctgtgagactggcattgatgatggagatcacagggtttaggatgtctcttttcagttattgagcctggcccattcccagtcctaatctttttcttgttaaaaatcaattatacatatatatatttttattatactttaagttttagggtacatgtgcacaatgcgcagtttagttacatatgtatacatgtgccttgttggtgtgctggacccagtaactagtcattttttaaaaatctttgtccttttctcaaatcctccctccaacaacaggagacagctttctttaaatgtccctgctccgtcaccattttctgtgaacaagtctctgctccatcaggatgcacaacaactacccagacccatgtagtgacattccaaataagcttctctttggtcttggagccaaagaaccaagtcctaattcccaatttctcccaaactttcactatctcagtgtattctctcttctcactcttatttctatcaagacacctatgaatggccttctctttcattgaacaacagttgattcagatacaatcaattcaataactctcattttagatcagaaacatacatttatgtttagaaaagactaatcaattgagtacctaagaaaacaaacaaggagctaatttaatgtcctgttcccaagagcactctcacacagacacagaaacaaacatacactcacacatccctacacaccaactgttttactaaaatccagccacactaccttttttgtcttccttcatcaggccatgcttgtttggggcttttgaacacgcttttctacaaggctcttctcccagatcatttcatgatggcttccccttctcatcattcagtcctcaactcaaatggcacgtggttactctttatcccactatccaccctatctgacccaagtcacttttgatcccactgcccagatttcttttcttcacaggatatcactatctgcaactattttacttatttataaactgactcattgtcgattttcctacattaaggaggctatctgtcttattctctgccaaatcacttgcccctaggtgtcatgcctggcacatagtaagcactgatagatctgagtaacgaataaatgaatttacagaaatcgttagccataaatagttttcaagtgcttacaatgtgcaaggtagttcttttttcagttgaatcctaggatgaaaaatgctctgtctctcagcattaatggggcacagtaagtccatttaagagataggtccaagatcaagtggatgaagcttattttgaaaaagttctaaacaaaatatattcctaccacattagacctaaaatgtattaatacataagattaacaacattgttcttctcagctattgtttccttcacacttccccattaaacttttgatatgtcattatgtccttttatgatgtcaaaaacaattgaatggaactgaatgaaagtagttacaacgacacatacccaatttgggacctttactgccaaaatagatgggtcaaaatgatgaaacatggtaagattcggggtgagaccaaaccctgaatctttacatgttcactccctcccacattcatacaatgtacaaatatcctgactatacctagccttgacaagcgttctaatgcctctacaggtgaaaacatccattcatttaaaccaggacctttatctataaagtgccaaataataaatattttagcctttgcaggtcataaagtttctgtttcaactactcaattctgctactatagtctgaaagcagccataagcaataaacatataaacaaatgaccatggctgtactccaataaaactttgtttacagaagggggtgggatgcatttggcaaaccctgatctaacccatcagtgaagcctccaaagtttatatatggggagatttagaaagaaaatttgatcagaaagtgtgttaggaggacttgtgttagaatctgcttttctgtgatacacattttgcttttatatgaaatatatgtgtatgggggggttggaaaagattacgggaaaactgaacccctcaggtcactcttatcactgccgcctaatcctgcaatccatttgagggtgttcttggcattacattttggccttctatagattcatcagctttctctgcatattttatccatcagattatttatatcgtaattctacaattatttttgaaaagctacaacaaacactcggttgaagttcaaaatatacattccccttaaccatgctaattctgcattctatttcaaacattattaattttgtcaggcaagatttgtttataataaactcatttttttcatcgctcatgattcctttgtcttcaagatgtttactgatttctcttacaatgttttatgagaatgttgtcagataccctgtaagccattcaacattacatttacatctattataacaattctttctccctcaaaatcttttaggtcttccaaatttcccaattggaatatacctttatccaaagtataataaatacacctttacctgtttctggttgatagctactttcaaaaggtattttaaacgcattatatgtttttcaaaattgtgttttaacaccaaaacagccacacaattaaactaaaatttagtaaagattctaaatgataacacactgtcataagatacattacatattaattagcaatgttatcattttctattctccatcttatagtttctgtaataaatcctactgccaatcagctttcattatcagcccgtctaatcatgataaccaataaattgtactctatgcttctgacatccaattctgctttatctattctagctatagtgtcaaaatatttttgtagcttcaactagggtttgacaaaaatgctaaaactataaaatctaaatgtaaagtttaccattaaattatatcagcatgtcatacaaccatgatttttaaaataaaatgagaaaatacataaagtaagattttagataacatgataaagtctgcttcagtttgattcagtattcaataaataaaaccacttgagaatcccagtaaaagtaaaccttgagatggttgaaatatccattttaaataacgggaacttttaggtaattgtctctatgaaacaagaatcaggcttttgaggtcataaaatgcttgaccttcccaggtacaatgaatgcagaaagcttactactaagttacacaataggggtaagactgttgaatctatctgaaaaattacattttcaaaagctccacaaagtaactgattcattaaagaaataattggaaagattctttctctttcctcatatgaaggagaaatcacaaaacgttgcaatattttcaaaagaggatgaagtgctcacatttcacttgtgaggtttcaatagctttattacctatgctcttgctgtttgttcagcatgctgaagaaaagtatttccaaaataacataggtttgctaatccttggttcctgataatatcacatgataggataggagctttcaaacacagtcaagctgacagtcacttgctctgtactcagagggaccaatttctccctgtagacatgaatacagcacaaataataaagtgccaaaagttgagtgtaagtgcaaacccttcaacatcactcaggtatcagcaaaaagtacctgtttagctacatgtagaagtcaggtacaacatgttgaaagggagggaagattagaattgaaataatttatctgcctctgctagtttatctgcatcactgaaaagaattaaaccaaccttgccaaaggtaagtcttgtctaggtacaaactgtcttatcaatgccatctcatctattccctatcgtcttctttttttttctttttttgaaagaaactttttatttattgtttttttcacattgcaagtgatggtatccagtttctttttttttttttttttaattatgctttaagttctagggtacatgtgcacaatgtgcaggtttgctacatatgtatacatgtaccatgttggtgtgctgcacccattaactcgtcatttacattaggtatatctcctaatgctacccctccctcccccctcccccaaccccatgacaggccccggggtgtgatgttccccttccggtgtccacgtgttctcattgttcaattccccacctaagagtgagaacatgcggtgtttggttttttgtccttgtgatagtttgctgagaatgatggtttccagcttcatccatgtccctacaaaggacatgaactcatcttttttatggctgcatagtattccatggtgtatatgtgccacattttcttaatccagtctatcattgatggacatttgggttgattccaagtctttgctattgtgaatagtgccgcaataagcatacgtgtgcatgtgtctttacagcagcatgatttataatcctttgggtatatactcagtaatgagatggctgggtcaaatggtatttctagttctagatccttgaggaattgccagactgtcttccacaatggttgaactagtttacagtcccaccaacagtgtaaaagtgttcctatttctccacatcctctccagcacctgttgtttcctgactttttaatgatcgccattctaactggtgtgagatggtgtctcattgtggttttgatttgcatttctctgatggccagtgatgatgagcattttttcatgtctctgttggctgcataaatgtcttcttttgagaagtgtctgttcacatccttcgcccagtttttgatggagttgtttgttttcttcttgtaaatttgtttgagttctttgtagattctggatattagccctttgtcagaagagtagattgtaaaaattttctcccattctgtaggttgcctgttcactctgatggtagtttcttttgctgtgcagaagctctttagtttaattagatcccatttgttaattttggcttttgttgccattgcttttggtgttttagacatgaagtccttgcccatgcctatgtcctgaatggtattgcctaggttttcttctaggatttttatggttttaggtctaacatttaagtctttaatccatcttgaattaatttttgtataaggcgtaaggaagggatccagtttcagctttctacagatggctagccagttttcccagcaccatttattaaatagggaatcctttccctatttcttgtttttgtcaggtttgtcaaatatcagatggttgtagatgtgtggtattatttctgagggctctgttctgttccattgctctatctctctgttttggtagcagcaccatgctgtttggttactgtagccttgtagtatagtttgaagtcagttagtgtgatgcctccagctttgttcttttggcttaagattgtcttggcaatgtgggctcttttttggttccatatgaattttaaactagttttttcccaattctgtgaagaaagtcattggtaacttgagggggatggcattgaatatataaattacgcaggacagtatggccattttcatgatattgattcttcctatccatgagcatggaatgttcttccatttgtttgtgtcctcttttatttcgttgagcagtggtttgtagttgtccttgaagaggtccttcacatcccttgtaagttggattcctaggtattttactctctttgaagcaattgtgaatgggagttcactcatgatctggctttctgtttgtctgttattggtgtataagaatgttcgtgatttttgcacattgattttgtatcctgagactttgctgaagttgcttatcagcttaaggagattttgggctgagatgatggggttttctaaatatacaatcatgtcatctgcaaacagggacaatttgacttcctcttttcctaattgaataccctgtatttatttctcctgcctgattgccctggccagaacttccaacactatgttgaataggagtggtgagagagggcatccctgtcttgtgcccgttttcaaagggaatgcttccagtttttgcccattcagtatgatattggctgtgggtttatcataaatagctctcattattttgagatacatcccatcaatacctaatttattgagagtttttagcatgaagggttgttgaattttgtcaaaggccttttctgcatctattgagataatcatgtggtttttgtctttggttctgtttatatgctggattacgtttattgatttgtgtatgttgaaccagccttgcatctcagggatgaagcccacttgatcatggtggataagctttttgatgtgctgctggattcggtttgccagtattttattgaggatttttgcatcgatgttttcatcagggatattggtctaaaattctctttttttgtggtgtctctgccaggctttggtatcaggatgatgctggcctcataaaatgagttagggaggattccctctttttctattgattggaatagtttcaggaggaatggtaccagctcctccttgtacctctggtagaattcggctgtggatccgtctggtcctggactttttttggttggtaggctattaattattgcctcaatttcagagcgtgttattggtctattcacggatttaacttcttcctagtttagtcttgggagagtgtgtgtgttcaggaatttatccatttctgctagattttctagtttatttgcatagaggtgtttatagtattctctgatggtagtttgtatttctgtggaatcgatggtgatatcccctttatcattttttattgcgtctatttgattcttttctcttttcttctttattactcttgctagcagtctaccaattttgttgatcttttcaaaaaaccagctcctggattcattgattttttgaagggttttttgtgtctctatctccttcagttctgctctgatcttagtgatttcttgccttctgctagcttttgaacgcttttgctcttgcttctctagttcttttaattgtgatgttcgggtgtcaattttggatctttcctgctttctcttgtgggcatttggtgctataaatttccctctacacacttctttgaatgtgtcccagagattctagtatgctgtgtctttgttctcattggtttcaaagaacatctttatttctgccttcatttcgttaggtacccagtagtcactcaggagcaggttattcagtttccgtagttgagtggttttgagtgagtttcttaatcccgagttctagtttgattgcactgtggtctgagagaaagtttgttataatttctgttcttttacatttgctgaggagtgctttacttccaactatgtggtcaattttggaataagtgcgatgtggtgctgagaagaatgtatattctgttgatttggggtggagagttctgtagatgtctattaggtctgcttggtgcagagctgagttcaaatcctggatatcctttttaactttctgtctcgttgatctgtctaatgttaacagtggggtgttaaagtctcccattattattatgtgggagtctaagtctctttgtaggtctctaaggacttgctttatgaatctgggtgctcctgtattgggtgcatatatatttaggatagttagctcttctttttgaattgatccctttaccatcatgtaatggccttctttgtctcttttgatctttgttggtttaaagtctgttttatcagagactaggattgcaaccactgcctttttttgttttccatttgctccgtagatcttcctccatccctttattttgagcctatgtgtctatgcacgttcttatctctctttctctcctaaactttttttttgtaataatctctctctccacctaaacttttcaacttctctctctttctgtcttttttactccctccactagacatacccactctctctcacaaataaatactcactgtatgatgctaactgctaacttaaaggagatgtaattttatcactcacatatgattattgatgtgaaagtgcaagagtaaatatgtcagcaactgaaaaattagggcaacatgatccaaatcaagtgctaaatatattaatcatatacatactatgcacttctatagaaaaattattaggctataagcaatcataaagattagcataaataacctaaaaaaactattaaaagtcaagacagggagattcagctgacagagttgtatctctctttcttttcatataaagagatattcagtatgatgttgctaattaagaagtgaaacaagttagaatgaaagctataaagggaaatctctgggtgtcagacaaaaagaaagaactcaaagccagagcagaaggtggggctgaactcttggtgtccccctagagcaccatagccacatatatccatatatttgtccgcagtgtggggaaacagacaaagcctgaagccaatgagaggagtggaacagaagctgagactcccacttattaatggatgtcccctcacgcatctgtaagatttagactagaaaagtctataggtctatagactagcccagagacagagtaataaaactagaaatcttcttagggttctgggggaaaaaaaaacatagaaaatgaaacccagatacgtgccatgagtgccttaggaatcagcattgcattatttgggacagaaaactcaaagctaaaaattaacacaaaaccaattaggttttctgtagaccagtacaggcacagatcatgggtcacagaatagaaggaaatactaaattactttggaaggacccaaggcactcacagagaaaacaactttcttcacctgagaatgagctaaccataggatcaaaaactgatactcttttgttcaattcaacatctacctattaaatgcttttttaggcagataatattttagaccctgaagatatattagtgaataaaacataattcctgtttatactctcatgaggaagacaatgaatacagaaatataaaatataatgttcagtactaacaaatgccacaagagaaaagcagtacaaaagaaaatagaagaagagatggagaaacagatatgtagaaaaaatatttatagaaagactctaagaaggtgatatttgagcagaaccctgaacaaagtaaaggagtgagtcatgaggcagaagatacatcaacaggaaagaatacaattagtaaagatatagaagatttaaattacatcattttgaactaactgatgtgtaaaaacttcaccttttgaaaattgcacattctttccaactaatgtgtaatatttataaaattcaaccattatgatctaaaaagaggtgttaacaaataccaaagaattggtattacaaaataaggtatctgaccacaatggaataaaataagaaattaagatgaaaagatagattaaaaagccctatatatttagaaactaaaaaaacattcataaatattccatgagtcaaagaagaaatcataattgaaatattaattatttaaaatgaacacaataaaggcactacatatcaaaacctgtgggatgcagctaaagtggttcttagtggaaaatttatggctttaaatgcatatattagattttttaaatacgtaaaattaattagtttaggatctcacttagcaagttaaaaaataatagcagaataatccatgtaaaagagaaggaaagaataatgattagaacaaaaattaataacatgaaacaaatgtacaatagagagtatcagcaaaaccaaaatttgttctttaagaagaggtgtaatatattaggctaaaccatattattttttcagtattcaacccatagtaaaacttatgctgatcaaaaaatattaatcattaaatatttaagaaagaaaatagaggcactgattagaaactttaggaataaagagaatgtatctcaaacaatataggaaagatttaaaataacctgagaatatactaaacaactaaatggcaatcaatttacaaactcaaatgaaataagcagtttcctagaaacatgaaatgtaagaaaaatatgtaattagaaatagaaaacctgaataaatttatgatcaataattgagagaaaaaataatctcctgacaagttacatctcacatggtttaacagttgaatcctgccaagcctttaaggaatggataatcgtagcctgatataaactattacagaaagaaaaataaatatccaaacttcactgtcttcttacttttttctcagagcacttagtgtcttagtaatattttcacaacaaacttagcttaaaagtatgtaacagatccattaatttagtacttaggtctaaacaattaaataagtatttttgtcccagcaatacagccatatagaaataataaacacaaatttttaaaaattatttttacttcattcttatatagccatctttaagtttattattattgggatgtgtgtgcctgtcaggcactgcacaacttttcaaaccttgaaatctgattggacactgccacacttatttcctgttctatattgattttcatgcagtacctgctttctatgacagcaaccacaaaaaccaagcttcacgaagacatgacaccatcaggatgaatttactgaaatcccacgctaaaactgaactattcagggtagtgtctgacctggtgtctgacagatgttgaatattgctacgtttctcttaaaaattttaaatagctcatggcccacctgtgagttcactgtggccctacaggagtgccttggaacatagattgcaaaccatggcattatggtgagaaatgacttatgtaaatttttaagtaaacaaaactgcaccgaatgttcatggataagtgtgtgcgcatgtgctgcatgaaatgaaatgaaaatataaaaatagtaaaaatatgaactgaaagcatatgcattaacttcagaagagtggttacctctagggacaaaaggtggaactgtaaacacaagggaacttcaactatttctgcaatgactaatttctgtaaaaacaaaattcaagcaaatatggcaaatgctaatgtttttaaaatatgggtgatgggtatttggtatttattacattaatttcgtgccttattatacttttgaaatagttcataaaagaaaataagaaatgacaagcattgtgagttttcaaaagcttcatataggttgctacttttagcatgccattctaaatcccaggacatctggttactgttagacctgcttttctagtttccatttagaatcattaaactatccattcagagtagtcttaacatttaaagacaaaaaatcatataaagacccctatttcataagcttcaccctaagtcacaaatgctgcttttatttagtaactttgaaaaaatctcagcagaaatcagatataagtgctttctattcacttcttcaaaatatacttattttctcatttcagttattgaaaataataccatagtatgatagaacataacatgtattcatttagtgctatcccaaaccccacaaatctctggtctattgcaagaaatatactcattttcaaacttagtattaatatatttattttgtaggatactaaccaagtcaaaaatgaaactacattgaattaactgatgattatgccagatgtacattaagtttgtgttagtcacgtatgccagttcctcacatccatctcccctttaccttctcccaaccccaacttttcaaaataaaattaatattattcattagaagcaggaaactatagagggaatgtcagcaaatgtcagaagttccatgtatcagtcaaggatcaaagaagttccacaataataacatgagctacaataataaagtaaataagatagcaattatcccaccttactctgaactggccagatcatggcacatgtcttttattatgaggacactgccttatcaaaaagcctaaagagaaaaacatgtagaatggtgagaaatcttatttttttcttttcttttttttattattatgctttaagctccggggtacatgtgtagaacatgcaggtttgttacataggtatacatatgccatggtggcttgctgcacccatcaacctgtcatctacatgaggtatttctcctaatgctatccctcccctagcctcccaccccccaaaaggccctggtgtgtgatgttcccctccctgtgtccatgtgttctcattgttcaaatcccacttatgagtgagaacacgtggtgtctggttttctgttcttgtgttagtttgctgagaatgatggtttccagcttcatccatgtccctgcaaagaacatgaactcatccatttttatggctgcatagtattccatggtgtatatgtgccacattttctttatccagtctatcattgatgggcatttgggttggttccaagtctttgttattgtgaacagtgccacaataaacatacgtgtattttttataacatacacatatgtctttatagtagaatgatttataatcctttgggtatatacccagtaatgggattcctagatcatgtggtatttctagttctagatacaagataaaaacaaacaaccccatcagagagtgggtgaaggatatgaacagacatttctcaaaagaagacatttatgcagccaataaacatggaaaaaaaagctcatcatcactggtcattagagaaatgcaaatcaaaaccacagtaagataccatctcatgccagttagaatggtgatcattaaaaagtcaggaaacaacagatgctgaagaggatgtggagaaataggaacgcttttaccctgttggtgggagtgtaaattagttcaaccattgtggaagacagtgtggcaattcctcaagaatggtgagaaatcttaaacagtaggggcagttgaggcaactagagaggtttaacttggaaaacagaagacaaagagagaaatctccagtatcaccatgtttttggtagagtattatgtggagagataatcaggtagttacaaatcactggaagacaagagcatggatctccaggaatgactgctagatccacagtgtagaacctttggggtgattaaaacgttctggaattagatagtggtgatgtttgtacaaccttgcgaatatgctaaactctattcttgaaatgtgtgaaattttatggtatgtgtaaaacaaatttttaagtgtccattagattcagtaacatgattagtataatccaaataatacatgaaaagtcaaaaagcaaacaataaaaacaatggtttccaaagaaataaagtaatttttcaagacagattgaaatgttaggaaagagttttctttttcttttctttaaaaaaaaaatagtgaagggcttgaacaagttcgaatgttgataacaaaggagtttacaaagagacaaagcatgaagacatagaaaagataaaattaatcaatactgcaaaatttctaaaaaagtagaattagtgttcaaaacataggtaaacagattagtctttttaagtggtaggttaatttctttttacaaaacttcatgaaaagaggataccactagctagtcccacccagctgacccaggatatttacagattttatcttgggatgttaagcatgtacttagatggatgtgtctacttttttttgactagatgataatgtagtctgctggggagaagaaggagcaaaggtagaaagggtaaataatttgttcaacattagccagctagaaatggatagatttcatttttgaaatcatttatttttttaggatatatttaaggtgctcagcatgttttgatataactataaatagtgaaatgattactacagtcaagcaaattaacttctttttattttgaagtgattatatacacacatgaagttgcaaattagtatagataggtcaaatttacccgttacccagctttccacattggtaccatcttacataaccatgtacattatgaaaatgaggaagttgacctagtacaataaaataaacaacaaattttatttggatttcatcaatttgtgcatgcactcattttttgtacgtctttgtatcacatgtattgatataaccaccaaaaaaatcaagatacaaagctgttgtgccatcacaaaagaatttgtgacctctttatatgcctgaccttctgaaacctctgaaaataactagacttaatcataagagtaatgggaaactactgaagagtattaagtgataaagtcacatggcagactgtttcatgtttccctttatctcaaataaaaacaggggtgcataactgaagaaagaagaggcattagaatattatttcaataactaaggtaaagcatgatgatgtagaatagaatagtgactctagatatgcagcagagtggataatttcaaagatgtagattcaaaagaatatggtagttaactgaatgtggtagtcaggaagggatcaagctgagcttacctgacttggatatctgggttggtggtaatatcattcacagagatgtgaatcatgagagaagtggcttggatgtgctaagtttatttctttatatgtcaagttacttatgggttattcaaatgaagatgtctagaaggtaatttggtattggagtctgaggttcaggaagaggatcttgtttaagataaagatgtggctgtaattgatccatatatagtaactgaagccagaaaattgggtaagatcaatcagaatatggtatcatcgaagtcaagagaaaagaatgaggatagtggagggaaaaggaggggaaaggaggggaggttggggaggggaggggagggaaaaggaggggaaaggagaggagaggagagcagaggagaggagaggagcagggaaatgaaaggaggaaggaaagggaagggaaggggaagaggaagggggaaagggagagggagagagaaagggaaagggagagggaaaggaaaggaggaaggaaaggaaaggaggagggaaatgaaaggaaaggaaagggggagggaaatgaaagcaggaaggaaaggaaaggaggagggaaatgaaaggaaaggaaagggggagggaaatgaaagggggagggaaattttcagggcaaaacagaaagaatggaaggacagaaagatggaagagaggaaggaaggaacttgcacaaattgagggcacatgtaaaaacttcaaatatcatgtactcattacatataatttgtgctatataaaacttaatgcaaacttatcagcttttctttctttaaacctactttttttttacttactgtttttccctcgaaaagttctttattcttagaaggaatttcctcaaatatttatattcgataccaatattttttctaaaatgaaacatctctattttcttggcccaagaactgtggtaactagcttgaaaacagtgctatatatttgttatgtcaggaaaaatatagttgaatgaagtgttctctttcccataaagaaaaaagagtttcaagctacatttaagttttctttatactaccacctctccaagcgtttcagctatcattgttttttaactgcctctataatatacaatatgcagccaaatatttggagatattttggtcaaaaggtatgttagcaacaacaatagaaataataaaacaattctcaatgataactgaagctattgcataatttaaataaaatggaaaaagtcagcatcaactttgaattcattggcctttgtcaatttatgttgcaatgttatatttgtttaaggcataactctgaattcatttaatgacctagactatttagtgttggactttcatttaaaaaaaaaatagcaaaataaaatgccatctcgtagagtgctatttaccatatgagatccatctggcaataccatctaatatttaactttgaaggcactgttatcaaatagttgctctaaagtgcttataagaggcaaattcttctggtttttcttctaaggcatattatattactgataattttaggataacagatctgaatgtagatgattttaaatgttgattacagcacattatttaatattttaaatattgactaattcatttttaaattatttgtaaattagcagactatttcttttataaaattaaatattttgtattctcccaccccaccgctagaagtctttaaggggaatattataattttaaaataaaggatttaaagtaacagtttcctgttagttttgtggactgttttcttttccagtaatattttgagtccagttcaccataacttaccaataccctttcacattgcccaacccctagaaacacttaacagatttttctctccataggttggctatattcaaaagaaacattggcctatcaggacctctcagtatccatgttgtggacaagaccaaagagaacttaacactttgaaaacagctactttaccttatgtgcgactcataaacatttaactcagtgttactcagtgatgtgctgccaaaagtaatttaccaggttccaaatgctatatatctggataaactggtctccaaaagcaaacaaacaaaaaacctcattatatatttttaaagaaaaatgtggcccccactactaggtcagcagagaattctgagaatatataacaagtcctatgacttcagtcccaaaagctctggcacaggaaaacactataaacttcttgcaacaagagaataccatcaatactagcagggacatgcttatgtctacatttaggtgaactagcaaaatctttcatctgatatgtactaaattcttgaccattacgaggaaaaaaattatatctgaagtggcatattctaaacctgatgaatttcccacaaatcaaaaaaaaaaaaaaacaaatttctcacaagttaaaaaaaggagcctatatttcaaactattacttgtattgtaggcttctgaacaattttattatactcttcagtgttttccaggtttgttaaaataagcactttaaaaacaggaaaaaataagtttgaaaagataaattctagcactctattcctacaagataaagaagtcagattactcttttatatccaatggaatacatgaattagacttataagatggttggaaacacaccacaccacatttaatacacattccagaataaacttcaaataaaaatatgagctgttgaccaatagcagtattataaatttaaaatggggagctttttttaaatcacatattaaaaaagaagaattgggaaccatgtggaagcaaagagcaatttaatatacatacacaagtttagggattttttttttaaagagaaattgagagtcaggcattaaaggtatacaaaatttgtgtctcaatatattaccaattaaatattgaaatgtaaaattgaaagcacaacacctacactaaaaccaaaaaattaaataaattcttcatataaaatctaacaaaatatgtataagatctattatgaagaaaactacaaaactctgatcaaaggtatcaaaaaagaactaaataaactgagagatattccatgttcatggatagtaagactcaatactatcaaaatattacttcttcccaatttaatttttagattcaacataatcccaatcaaaatcccacaaagttattttgtggatattcacaaactgattctaaagtttatatggagaggcaaaagatctagaataggaaacacaatattgaagaaagagtcagaatgctgacactacccaaccccaaggcttactatatagctacatgagtcaaggtactgtggtatttgcaaacatacaacttagatcaatggaacagaagagagaggccagaaattgacccacataagtacagtcaactgttctttgacaaagaagtaaaggcaatacaatagagcaaaagtcttttcaacaaatagtccaataactgaacatccacatgaaaaaaaatctagacactgacattaaattcacaaaatttaactcaaaataaatcatagacctaaatgtacaatgcaaaactgtaaaacttttagaagataaataggagaacatctagttgatcttgggtttggcaataaggtcttagatataacaccacaagccagatttatgaaagaaataattgacgttagagtttattaaaattaaaacttccatatttgtgaaagacaaatcacagactagaagaaaatatttgctaaacacatttctgatattcgaccgtcatccaaaatacaccaaaaactattaaaactcaagaagaaaaacaacttgattaaaatgtgagcaaaagatctgaacagacatctcaccaaagaaatgcagatgaaaaacctgcatagaaaatgatcaacataatatgccattagagaattgcaaattaaaacaatgagatatcactaaacatctattggaacggctaaaactcaaaatactggcaacaacaattgccgtcaaggatgtggagaaatacaaactctcactcattgctggtgggaatgcaaaatgctatttggcactttcttaaaaaattaaacatacacttaccatatgatctagcaatcatactcattggtatttcattgaaaattatgttccacaaaatcctacacataaatgtttatagcagcccaatttataattgcaaaaaaattggaggcaacgacgatgtctttaagtaggtgaatgcatgaacaaatttctacatccatacaatggaagattattcagcactaaagagaagtgagctattaatcatgaaactatacagggaaaccttaagtgcatactgctaaatgaaataaaccagtctaaacagctatatcccgtatgattccaactatatgacattctggaaatggcaaaactatagataccgtaaaaaagatgccagggtttggaaatggggagggataaacaggtagagtacagaggatttctatggcagtgaaagtaatttgtatgatattatgatggtgggcacataacatcatgcatttgtcaaaatccattaaatgtacacccagtgaaccctaatgtactatagttataataatgcatcaatattggttcattagttgtaacaaatgtaccaccatagttaataatggggaaaagtggggaggagaagggtgaatgggcatacaggaactctactttctccccaggttttttttttgtttgttttttgtttgtttgttttttgtaaacttaaaactgctacaataattaaaggctattgttttagttaaatccatttatttctaaaatttaaaacaggaaacataaaacaactaagtttaagaagctgagtgtggtgatatgagcctataatcccagcaacttgggaggctgaggtgggaaaattgcttgagctcagaagtttaaggttagcctgggaaacatagtgagcacgcccctactaaaaaacaaaacaaaacaaaacaacaacaaaaacactaagtttaacaaatattatgtttgcaagtgtcaggtgacaggcatgtttcatttttttcaatattacctgtctagtgaaatcaaagataaatatgtagctgaattttacttactgtgaacaatcaggtggtttgaatttctcttttcagcagtagaaacaaacgttttggaaatcaatatggatttttaaaaactccaaaaaacattaatttgtatttattaatattatgtcttcattattatattgtcagaacaaaaggattcaggttatttataaaatttttaaaatgtgtgtttttatctaggaatatagtcattttaaaattaatgctactgtcaggatgaaggcagggagctctgatacttttcaaaccacctattctagcacttgagatctctgcagaatttgggcctatactgtcatgagaacttgggatttcaatagatctgctcgtggtttcaatctctagttggtctgcaaagaaattaactctgtgctactgcccaaaactatcccccaactttcaaggtttcctgccttgaaaacatgcacattttgtcctcaaaagagtacagaaaggtacctataaaacctgcactgctatggtctaaaatgaccaaaaagatgccttgcctataatctccgtatatgcaagactgaacattacattacatggaagtattctgtaaccaagagtctttgcctttaaaacaaaatatttttttttccttagaggatagctatttggggacttagcaaaactggacaactctcagaaacaagtttttcttcagtagaacacacactagggtttgtgcctcttttctttgttcagttttatacatgtataaaggaaagacaaaaaacaagagggtctttcatttttccacagttccctttcttgggtgccattcctctcattgttcatagatgaatattcagcgtattcttctcacacagaacacttggccagttttttcttttgctctatattaaagggcataatatttctttaactgaggaagacatatttataatataattttggattaagatttttatttacaaatcatttcatagaaagtttctctaaatttttagcaagagatatttggctataattggtcagatttatctgtcttcatttcaaggatctctatggtactgaaatttctgtttaaagaattttaagtaagttcatttatatacagttcatgcaacttatttacttatcccccttcaacatgccagccatttctttccaaatgttaaacagagttactaaaagttatgtgtgtgtatgagtgtgtgtatgtgtgtgtgtgggcctgtttatgaaggagaagcagagacagagggaaagtgggtagtcattgtattcaagccaacaaccccatttcaaaggagagggattcttaccctgaaaatttgttttcaattcttcacttttaaattaatacatttagaaaaggtttaatagaatgtggctgaacctcaattaaataaaaatttccacctcttgattttatttttttgttgtaattaattggtcattgggtttatctgtatacattttatctgtatttgtatttattgtatgtgtatttgtatttatttgtataaatttatctgtataaatttttaatgaccccaaatatatcatgaaaacatttaaatgttttcctttatctaggaaattatacacatgtttgaaaaccaaacagtttatatctgactagatgtttagttgctattactattttgaacttggaatggacattattttaaaataagttatttgtaaagaactgagatttactgcatcctaccttatgtcaggtactcatgtcttgtctcaaatcatgttctgaacatctctttgcattaatataattaatcccagtttacagaagacaaaattaagaaccaaagagagagagtaggtaacaatcaaggtgattcaggacttaactgacaaatctatcaacttctctctacctctactgctgccttcttagttgaggtcactgtgatttccatcctggaccactgaaccactgtattcaccttctaactggattcctcactaactgccttgataattccaatccattctgcaccagaagcaggtttattatgggactgtgtcatacttccctggcttcccatttcatttagggcaaaattctatgaggtctgtctctccatttctctttaacttcatttcaatctactctctttttagctcacagcattctacccacgttaatgtcctttttgttcctagacattgccaaatgttttttttttcttttttcttttttgttattgctttctgatctactataaaatgcttttcttctatggaggcttcaaacatcctattccttgccctggatttctgcatcactggatccttcttatcatttgagtctcaacagaaacaccacctcttaaaatggtcaccctctgattcttgcccagacctttgttagttactgtcagaaaaaaataacttctttatgtacaatgaactagtttgcttgtttgtttgtttgtttatcatctattcctccactccctctccattccccctccatagtaggacaggaatattctattttatttactaccctcatatagtttctagcacttcgggtactgaataaatatttgctggatgaatgaagtctttgttttctccactctaaaatgtgctcatattaattaaatatagtcataaaatttatccagttggatatatatatatatatatataaccatttgtccttagtaaagcttgaaatatgtgaaatcatggcacttcttttttttcccctgaatattatttcttggtcagaacattatcttcctccttggcaaaaatatattgtgcctttatgttttagcaaagtatctcaaagaatcatataaccgtagcaaaatggagctgaagggcaccttagagcccacctacccctatcatgcacctggcacctgagcctcttctacagcatcaagtggccactgagacataccaggctggaggaactaagtaccttttaaggcaacacatctaattcttagtgttttaatagcctaatatttgtttagcgttttggtactaatacattccaagtttctgctgtctactgacttttcactatttgttcccttagatattcatttgaaatctttttagtttaacctgatttagctgtttctttttattaaaaaaaactcgaggtaacttcttttctgatttaatgtagcaataccagaaaatcccttttgagtttagtctttcagattgttagtaaacttaatgatgagaataggagtatttgttatttttctgcaaaatagttctatctatatttctttctacttctcattgtgcaaagtctgttctttcattaagacactgtaattacattatagtcagtatgttttaagtaaaattctgagattcctttactttttcttgagtcgtctaaaaaaatatgttttgataaaatcaagtgaaatatcctttatgacttcaacttcttctggaaatacttgtcctctatatattttatcacttaatttgccaattatgtctactccttttgaataaggaggaaataccattttctgaaataaaaaaaagagaaagagaaaaaacagaaattagagaatattttaaacaatgtgttttatgtgttttttaaatgtcatcaaactcattcttcaggactttactcataataagctgttcaatgaatacttatttaacaatcgctctgtgttctattacttatccctttttctcacttatatgctcaactttttattctttataagttctttcttcttagcatataaacatgcatgattatctcccatcaaatatacataaaaataagcatacaatagaaaagaaagaaaatccttttttgaagatttgctctgttaccactttcttctctattatttctagtcaaatctttgaagagagtttttacttctttacccctcatcctgtttacagtccactgaaaactgacttctgcccttataacataatttaattattcccaccaagatcgcaaatcacaagacggtcaaatccaattgaatatattttgacttgaccttactttatatctcagatgttttgacattcttgacaactcctttctttcaaaaacactgtcctctcactggcttcatactttttggctcttctcctgcccttttctcttcctttgcaggctcttctgcttcttcttgaccctatatatgggttcttcttctgctttccaacagtctcttgctctcacatcatccttttccttgagtgattatattcacatcttcaacttcaaacatcacctttattttgatgactctcaagtctgtagctcctgcccttatcacagctcttctatatctctccagttgtatacatactgctgactatggaatatctttagctgaatgccccatagatacttcaacttatgacatatcaaactgcagtttttaaatcttcactccaaaatgatatttttctgttattcccgtctcttttaatggcactgtcatccaccaaggggatttggaagaaccttgagttcaagccctttcctttgtttccctacagttgccctgtaatctgtatgctgagggttaaaggcagggctaggagaaaatatgtttctattagatgagatgtatcatcaatattcaactggtattagaaaaataaccataaaaatgctcctgataataagcagctaaaacataaagaacatctttttgtaagtaatcgtgaacaatgtttgagagatagaaggatcattcaataatctaaaaattctaaacataattttacatatgaaaaaacagtcctagagaggaaagataaatgtctaatataaaagtaacttaatgaaaaagtgtggactaaaatctagatccacttctgtaagttttgtatttccttggtattagaagtaacttactcctccctgtccctgatctatgtaatggcaaacattttttcttggtaggagataaatcaggtcattacaagcatagaaagcaagatttaaacaaagtatatctgtaatacaaatttctgctagtagaatgtacctacattttaaaaagtgagagttctttctcagctgctttctaagtaatttacactatttatgctcccaccaatcctgtatatttcctatatgctcacaaaccatgaatattatctaatttgtaaaaccttgtcaatctgataaggaaacttagtatgtgtgtatgtaagattgaatatttttatacgttattggacacatatttttatgaattatgtttttagatcctttgaacattatctactgggttatttatatttcttgttcttgaattttcttctgtttcttggataatgttttcttctggaatgtattcttcaaatttttttaatgctatatatttttgttctgtattatttttacagttatgtcatctcatttgaatgtacaatcactatatagcccttaatctatatggttaaaaattgtgtgagtaaaaactctttgccactctccccaccccatctgaattcagattgacttatcctgtaagcttttattccaggactaaaattttgctttaacaaagccaataagcccaggtgcttagtttctcctacatacctattctcccaacaatgctttctcatcccctttcaggcagtgagaataaatccagtaaaataattacgttctatcacattattagtccagagctggcaagtagaggttacatatgtgcatgttcatgtgcctctacaccagcttcctcttcctgagatgactaggtatttactgtgatttgaatgtatccctcaaagttcatgtgttggaaactcaatctccaatgcaacagtgttgaaaggtgggacttttgagagatgattaggtcatgagggctccacactcttgaatggattaatgttatcacagcagtagctttgttataaaagcaagtttggctctttcttgctccccatttgatgagctctttcaccatgtgatgccttctaccacgttgggatacagaaaaaaggccctcactagatgcccaacacccttttatagggcttcacagcctcgagaacagtgagcaataaatttttctttatacattacccagtctgtggtattctgttatggcaacacaaaataaactaagacagtattatgtattttttcttttgttttacattttactaagtgccgacttattcgaaaaggtaattagctttggttaattatcaaagttttgtctttcctttcctacttttgtcccactaagcaaaaaacaaaacaatgagcattgacctttacctttctctggtaagggagtatggaaggttttctactactttgtaaaaatactgctacagatggtacttctggacccatgtggaacctgggggtccttgctgtcctgaagagaagtacacaggcctggctggcttttccacttactgattgtagaatctcaggcattgagcaaatataggcagtagccagggagcagttacatcaggccttaggtgaaacccactgctgtgctggcttcaggtctgacccaacacagtcatagtggtgatggccacaagggagcttgggttactccaccctgcaaaggagcttgggtcactctgagctttgcatagcttagagcagagaaagaaggactctgtattcttgggagaaaacaaggaaagagaacaagagtctctgcctggtaatcaagagaattctcccagatcttagccaagaccataaagcttatacctctataaatcagcaagaaccacagtgttattaggcttgggatgcccctaaagtagatatttcttagatcacaacattcaggtcttttcaaatatctggaacatctttccaagaagggcggctacaaataaacccagaaggtgaagactacaataaacacataactcttcaatgcctggacaaacatctataagcatcaacaccatccagggaaatgacatgacatccccgtatgaactaaataaggcaccagggaccaatgctggagaagcagagatatgtgtgacctttcagacagagaattcaaaatacctgtgttgaggaaactcaattaatttcaagataacacagagaaggaattcagaattttatcagataaatttaacaaagagaataaagtaattaaaaagaggcaggcagaaattctggagctttaacatacaattggcctactaaagaatgtctcagagtcctttaacagcagaatggatcaagcggaagaaagaatcagtgagcttgaagacaggctatttgaaaatatacaatcagatgagacaaaagaaaaaagaataaaaaacaatgaagcacacctacaggatctaaaaaatagcttcaaacaggaaacctgattattggccttaaagaggaggaagagaaagagacaggggtagaaagtttatccgaaggaataataacagagaacttcccaaccctagagaaatatatcaatattccaagtacgagaaggttatagaatgccaagcagatttaacccaaagaagactacctcagggcatttaataatcaaactcccaaagatcaaggataaaaaaggatcctaaaagcaccaaaagaaatgtaacaaataacatacaatggatctccaacacatctggcagcagacttttcactggaaactttataggccagcagagagtggcaggtaatatttaaagtactgaaggaaaaaatcttttaccctagaatagcatatctggtgaaaatatccttcaaacatgaaggagaaatgaagactttcccagacaaacaaaagctgagggatttcatcaacaccagacctgttctacaagaaatgctaaagggagtacttcaatcaaataaaaaaggatgttaatgagcaataaaaaaatcatctaacagtacaaaactcactggtaatagtaaatacacagaacaacacagaacattttaatactgtaactgcagtgtataaactgctatctcttaagtacaaagagtaaatgatgaaccgataaaaaaaataaatacaactttttgagacatagtacagtaagatacaagtacaaataataaaaagtttaaaagctagtggacaaggttaatgtgtagagtttttcttagttttctatttgcctgtttgtttgttcatgcaaacagtgttaagttgttgtcaccttaaaataattgcttataagatagtagatgcaagctttgtggtaacttaaactttaaaaaaatacaatggatacacaaaaagtaaaaagcaagaaattaatcatatcaccagagaaaatcatcttcacgaaaagaaaagaggaagaaaggaaagaaggaagagaagaccacaaaacaaccaggaaacaaaaaacaaaatggcgggagtaagttcttacttatcaagaatacattgaatgtaaatgaactaaactctccaatcaaaagacacaaagtggatgaatgaacaaacaaacaaaaaagatccaatgatctgttgcctataagaacacacaatacctataaagacacatacagactgaaaataaaaggatgggaaaagatattccatgccaatggaaactaaaaaagagcaggagttgctacacttagaccaggcaaaatagattccaaggatgaaaactataagaagagacaaagaaggtcaccacataatgataaaggggttgattgagcacaaggatataacaattgtaatataggtacccaacactagagtatccagatttacaaagcaaacatttttatagctaaagatagagatagaccccaatactataatagttggagactttaacaccccactttcagcattggacagatcttccagacagaaaatccataaagaaacttcagatttaatctgtgctatagaccaaatggatctaatagatatttacagaacatttcatccaacagctgcagaataaacattcttttcctcagcacatagttcatactcaaggatagaccatacgtcgggtcacaaaacaagtcttaagacattcaaaaaattgaaatattatcaagcaccttttctgaccacaatggaataaagccagaaatgaataccaagaggaattctggaaactatacaaacacatggaaattaaacaatatgttccagaatgacaagtggtaaatgagtaaattaagaaggaaacttaaagatttattggaacaaatgatagtaaaaacacaacatgccaaaatctatgggatacagcaaaagcagtactaagagggaagtttatagctttaagtacttacatgaaaaaatagaaaaacttcaaataaacaacccagtgatgcatattaaagaacttcaaaagcaagagcaaatcaaacacaaaattagtggaagaaaataaataataaagattagagataaatgagtagaaaatgaagaaaataatacaaaagatcgctaaacaaaaagttgttttttaaaaaaaggtaaacaaaattgacaaacttttagacccaaataagtaaaatcagagatgtaaaaggagacatcacaactgataccgcagaatttaaaggatcgttagtggctgctataaatagctatatagaaagaaatagaaaaatttggaagaaatggataaattgctagacacatgcaagctactaaaattgaaccaggaacatatccaaaacctgagcagaccaataacaagtaatgagatcaaaaccataataggaagtctcttagcaaataaaagcccactacctgatggcttccctgctgaattttaccaaacctttaaagaacacccaatcctactcaaatactctgaaaaacagaggaggaggaaatacattctaactcattctatatttgacagtattaccctaatgttcaaatcagaaaaaggcacaacaaagacacatttcggatcaaatggctttgatccaaaagacagtaacaaatgctggcaaggacatggagaaaagggaacccttgtacactattggtggaaatgtatattagtacaaccactatggagaacagtttggaagttcctcaaaaaactaaaaacatctaccataagatccagcaatccctatatgtgtgtgtgtgtgtgtgtgtgtgtacactaaaaagaaaggaaatgagtatattgaagatatatctgcactcctatgtttattgcagtgatatttataatagcaacctaagtatccatcaacagatggataaagaaaatgcagtatttaaacagaatgcagtactattcagccataaacagaatgagatcctgtcatttaaaacaacattgataaactggaaattattaggttaagtgaaataagctaggcacagaaagacaaacttgatatgtttgaacttatttgtggaagctaaaattaaaataattgaaccatagagataaagagaaggatggctatcagaggttgggaaagatagttgtttggggtagggggagaagtggggatggttaatgggttaaaaatagttagaaagattaaataatacctagtatttgctagcacaatggaatggctatagtcaaaaataatttaattgtacattttaaaaaaactaaaagtgtacaattggattgtttgtactacaaaggataaatgcttgaagtggtggatactcgatactccatttactcttatgtgattattactcattgcatgcctctatcaaaatacctcatgtaccccataaatatatatacctactaagtatccacaaaaattaaaaataaaaataataaataaatatttttattgagtttttttctgtgaattatacaatctcctaggctcttagtctgctaggagatgtagcgatgaaccaaaaagtgctcttatggatcttagggtatactagttaacgtagaagggttgctctaaatttcaaagtgtctgtttatcaaagcatctatgattatcggtgtcttttttgttttttgtttccttattgtttgtttttcatttgagtacttttctcattaaaacactagcttaagcaacatgtcaaggagaaagacaagacaatacaaaagacaacaaaacaagctcttcactgcattgcctcacccataaacttataaagtggctgtcactttataaaaggctaagaaaagctatttcgctgaaaaccttattgactgttttaatgacatcacatttgtagttctgttatgaggaaataaatcatggaaggagtgaggagaagtttagcaatagttgtggtcttacttgctgtgtggtgggtctcagatgccctatatgctatgcaagtagaaatcattgcttatcattttaatgtaagtttgattggaatgtgactaattacataatagttatacaaaaaaacatattctagatcagctaattaagcaatataaaatatgttttgtgcacaaataaagaaacatattgtttcattcctataagatacataaataaagttattttggactgataaatatttttttcaactttcaaaagttccagggtacatgtgcaggatgtgcaagtttgttacgtgggtaaatgtgtgccatggtggtttgctgcacagatcaacccatcacctaggtattaaacccagcatccattaactattcttcctgatgctctcacttcccccaacccaaacccctgagaggccccagtatgtgttgtccccctccccatgtgtccatgtgttctcattgttcagctcccacttataagtgagaatatgtgttgtttggttctctgttcctctatcagtttgctgaggataatggcttccagctccatccatgtccctgaaaaggacatgatctcatttctttttatggctgcatagtattccatgatatatatttactacattttctttatccagtttatcactgatgggcttttgggttgattccatgtctctgttattgtgaatactgctgcaattggcataaacgtgcatgtatctttataataaaatgatttatattcctttgggtatatacccagtaatgggattgctgggtcaaatggtatttctgcctctagatctctgaagaatctccacactgtcttccacaatggttgaactaatttacactccccccaacagtgcaaaagcattcctttttctccgcaacctcaccagcatctgttgtttctggactgtttaataattgccattctgactggcatgagatggtatctcactgtggttctgatttgcatttctctaatgatcattgatgttgagcttttttcacgtttgttggctgcataaatgtcttccttgagaagtgtctgttcatgtgctctgcccactttttaatgggattgtttgttttttcttgtaaatttgtttaagttccttgtagactctggatattagacctttgtcagatgggtagaatgcaaaaattttctctcattctgtaggttgtctgttcactctgatgatagtttcttttgctgagcagaagctctttagtttaattagatcccatttgtcattttgcttttgttgcaattgcttttagcgtttttgtcatgaaatccttccccatggctacatcctgactggtattgtcagattttcttctagggtttttatagtttggggttttacatttaagtccttaatccatcttgggttaatttttgtataaggtgtaaagaaggggttcagtttcaattttctgcatatggctagccagttctcccagtaccatttattagagggaatcctttccccattgcttgtttttgtcaggtttgtcgaagatcagatggttgtaggcatgtggtctcatttctgagttctctattctgttccatgggtctatgtgtctgtttttgtaccagtgccatgctgttttggttactgtagccttgtagtgtagtttgaagtccagtagtatgatgcctgcagctttgttatttttgcttaggattgtctttgctttttgggtgctttttgggttccatatgaattttaaaattcaacatcccttcacgttaaaaactctcaataaactaggtattgaaagaacatacctcaaaatagtaagagccatatatgacaaacccacagccaatatcatacagaatggacaaaagctgggagcattcccctttaaaaccagcacaagacaaggatgccctctctcaccactcctactcaacatagtattggaagttctggccagggcaatcaagcaagagaaagaaataaacatattcaaatagggagagaggaagttaaattatctttgtttgcagataacaggatcctatgtctagaaaagcacatcatctcagcccaaaaccttcttaagctgataagcaacttcagcagtctcaggatacataatcaatgtgcaaaagtcgctagcgttcctatacaccaacaacaggcaagcagaaagccaaatcatgaatgaactcccattcacaactgctacaaaaacaatgagatacctaggaatacagctgacaagggaagtgaaggacctcttcaaggacagctacaaaccactcctcatggaaaactagaaaggacacaaacaaaaggaaaaacattccatgttcatggatagaaagaattcatatcacaaaaatgaccatagtgcccaaagtaatttatagattcaatgctatttccattaaactatcattggtaaatctttttaagaaaaatttatagtataaattaatagtttaaagatggcaatttttatttagatagatcaaaaaaaatgctgtcacagagagatgtgaattgaactacctattgaggaagtatgttatcattaatgctttctcacaatttctttcatattaaggattttaaaaagttaaattatatacaatttcatttgtatcatcactatagtttctttatcaaatatgtgttgagtaaatgctgtgtttcagacattgtgctggaattggagatataatggtaatgaaatgaaggatgcctcatggatcttacagtctaattgaggtagaaatacaaatacacatacatatatacaacacatatgcacatactaaataatcacacaaatatatgaatatttactttcagataatgttactaaattgtggttatttctgtgctggcaagaaacacccagtttcttgaaatttacttttcaatgacttcttccaaatttaatcctgtttatgcctaaggatttttgttgttgtttttttaatctcttaaagttgcacattgaatcactgctgatttgtatgcatgaagttaccaggacttctaattttgtaccaagtttatatgtgctaatattttccattagtaaagaagactgaaagatgcctcagttgcctggaatttatgccaccaaggaaaaacagtgattagtgtgtttaaagagttagatcattgggttaatcatgctttgccatagtatcattgctatcctttaaataaaaaaaaaaggtttagttagaaaattttttaacaagataaaattaaccacagactataacgaaaagtaatttcagcaggattatttattctcccaaagttgaaaaaacaacaaaccaaaaaaggtgtatatgtgacatctacttaattttttaaatatgattatttccatcttttgttctttgatctccacatgagcagagacacataaagtggcaatggggccaagggtgctagatggcttggcattcattaactatggcaattagcaccatttagattgatatgttcccaagatgaaagtaagaattggactagacaaaaaaaatgatgatcgcatttgtgaaagtggaacaacactgaccaacaagaaacaaagaaacagagctcaccttaaaagacttggaatatttgaaaaattgattatgagataagataatttcaacataactacaattccttgaagagttattaatgcttcggtagcattaaagtaaaatgaaaagacaccagggcagtctgctttaatagcttgctggcttgaaccctaatacataatgttcttgtaatagtttatgggtgactgcagtaaattggtagtgaatgtttttcatttttttggctcttcatatcagatctgctcttggagaacattttgttctgagaatattatgaaggcagttcatctactttagaagttgcttgacaattttaatacagtgttaacttttctcccctccagattgtgtgatttttttgtcctttgtacccgacatcaatttatggtttgaaattcagcaatttgctcagttatactttacctaccctgactaaatattttaagtgctgccacaagaaaagaaaaaatctaatttttcccaatgttgttgttacccctctctgtttatatagcagtttaaatctgcccttcatcttgacagagaaaaaattttagatggattaattttgaacctaaataatttgttgacaaataatttatgatcatattcaggggttgttttgaggtaaaaagaaaactgcattgaatgaattataccaagtgaaatcatggtattttaaacaaaatgaggtttataattacctgggatttagtgaacaaaagtatgtgatgcagggctccctgaagaatttagtgcatgtcctatgttttagtgcttcaagcagcaaatattatgtatatacaataaaaaaggaagttgcagacttaatacatactgaaatggtctcaatgttaacattagactcatgaaaaattagcggacatctaagtactttattcgttcttttagtctttgctgtacctaggaacatttgtttcatataaaagttatattacaaaattaatggactgagggtggaaagagaatttgaaagaatgtgaaataaagtctggatatatactgaatgcaggtggaagatgtctgaggaacattaatgacaataaagagaagtctcttcctaagttacagacatccaaaaccaaaataagagccaatgtggttacataaaactgcaaagaaaatcttggttggacagagaactccgaagaggtagtaaaaggaaaaactgagcaaactagggaagacaaatgcagagaaaagttagaaataattagagaagaaataaaatgcttccacaaaaataagaacaacaaaaattcaggagataaatgcagaacagtccagctaacagaaaaggatttttgaactgtgtatgcaagaagcagacagcatgattggaaatgaagtatttgctctttcctctaagagtggaagaacaagacattcctgggcagcacaactctgcgtaggattagttgcacttcctcaaatgtattttcaagcaaaaagctgaaacccaaatgtcttgagccaccagaagtacccaggctcttatgtaatacaggctttagtgttttattgcttattcaaaaagacaaattatattttaaaattgatatatgtgtgagcatggttatgctacacctataaattaccaaacgtaataccaatagcagccaaccaacagtttagcctcagtattttcacaacagttcaaaatgttttgttaaatcccatgaaagtagcttcagtgacaaaggtttcagatctttgcaaatgataattaattcagaggcatataatgggaaacactacagtcaggtctagacaggtttagataaactaatggcccaactagttatggcagctacagtttttaacttcaagtaaaggaatcttaaagcagttcaaggaagaaacattttctttcttttcctttttaaaacatttaattgtcttttttgaggatgataaaagataaaatctagagactttattgtactgtactcattatagtctctcccctgcctcatatgtaaatctagtttgcttcttcatgtttattcatctctactttaaataaacatattgtacatatactctatacacacacacatataatacctattctcttccatttatgcttacattgtaagtcttttaaacatttattgaaacatttttgttggattgactctacattgaatagctttattataaatgaaagacttcccttctattaaacagaaatttcttttaataccactatgaggcagaacattattgctatggtataactttgtacgatcgaatgtcctactggttagatctgtgagttaatttaaatttttacaggctgttagatggagtaaaaggcaggatacagccatggactgtaggttttttatcctttagttacttctttaacttttaatttacattaatggacaagtttcatctagtctaattttatgtattacttgagtctttcctcatatttttggaatgccatttttaatttagagtgttttctaagttaaagtcttaattgttcttttcctgaataatagcttgcatgaatacaaagaactttatgtttgaattttggatttagtcagcttgatttttcactgaaatcaggcctaaacatatgaagttcagcagcaaaaacaaaagcaagcttacttactgaaaacgcattgtctttctataacaagcttactgtaaagactggggtagtatgtatatttccatagatacatatatatagtatctgtgtgtacacatatacacgtaaagttaagaaagtttgtaaaaaaactacacatacgcaacattagaaatactgttaaatatttatgtgtaatgaagctgttcttttcaatgatgtcctacattgtaaaggttttatttaaaaatttttatataatgaatgcaaacttgagtcactgttcaaacatgaatattttctcaaatgaacatatttgcatgtgttatgctatataaactgagttctgtaaaaaggatcctttttcttctgctaccaagaaattctacttttataattcaaacaatctactctctcccacactcaaaataagtcatcattacttaaaatatgtgtagtgtaacaatggaaatgtttgtatatttgtcaaactaaatattatgttaaaatattttatacatttccactgagaatgctcttcttagttaaaaataaataaaatttaaaaaaatttgaatggagacattttgaaagtggctattccaggtaggataaatatttaatttactccatagcataataattttaggaatcacttcattttgaaaaattattctgaatactagcaacattttggcctttaagacactttattaacagttttgaagaaaaagttgagacatttgttcaaaagatttgaatctattcacataatagttcagacaatctccatttttaaattcctaaattttgaaaatttaggatacgtaaaaaagataaattaaggaatgatggtttaccacatggaaaaagtattatttataaaaattttaaaagtataatttatttacaaaatttagttatttaataacatatataaaaagactcaagttgatattctaaaacatacttttaaacaaaaggaactgtctattacataatgaaaatttatgcaaccaaaatgagtattattctttgcaaagtagttgccttgggagacagttctttaaacagtatagctattgctctaaatattgcacaatgtgcgaacaatgttgaccttcagtgccaacaacatatcattttgaatattttcactgacaactgctctttaattttcgttgctttttagaaatagtcaagagtaacttagagccatgtttacctgacagagccaagtttattgccatagcaaaacctggcctgtatagttatagaaatcccttatcttcatttcttcacctccaactctacaatctactccaatttgttgtcctttgcctcctctactcccttcaaactaatctttctaaggctgtaactatctgttttcagtcaccaaatgggcaatcatttaaaaaatattatggaaatgataaaagccatttatcttgggtggttttgtgcagtttctaaaggcagtttcaaaagaggtaagtaactttgatagtgatagaatcattggaataaatatattaccttcactatgacaaggatatttggatgtttaacttttggatatctgatatgtattttccattcagtgcagtatttattgagcacctatattatgcaaaacactgtgcgagatgctgagacaaaatatgaagatgaagaaacaatgagaccagccctgactcatgaacaaatagtgaggtaaggagataaccttcaatgactctactgtgagacagatttaagtgttctcttggagttagaatgcactatataaatagagagggaagaattcattttaactgaagcatgacagttaaattgtgcctagaaggacagagattgaaaccttaacaggtagaaatggaagaaagaactaggaagaggaagtaagttgttcaatgtagaatagggtttctatctttttttaaaaaatggacagtttactttctattcatagcttacacagtaaaactgtgcttgtttcaactttgctggcactacacaatatgcctagattcaattctgttgaatcccataaactctctttttttgttttgtttttcattccatctttctatgcctgtgccccatgtgttctttctcagctctcatgtctgtgtctttttcagttctgcatcaccttcttttcttctacatctgtttctcacctttccctgtctctgctatcccctctcgtagtcatctttccgtcttgattgccataaggaattgaaatatgctatacttctctttgacaaatccaaacttgaataaactcttacactatggagttttcaacaaatccttactctttgtacttttttccttttttaaattgttccttcccttcacttaattccttgtaatctgtccaaattttatattctcctcccccacttttctcccttttctttctctcctttttgattcttacactacactactggtgtactcagaggaaaaaatgatgctaaaataaagaaaatgttctttacaatcagaatattattaaccagtacttccaagcataactagttcaatcataaaagttcatttaagatttcaatgattccaacttatatctctttatctctttttgagtcaagtattaaatgactagtacttcaaagttaaatgtattttactgtataatttttgagactgatcatttatatttgatatctatatctcatttcataactatactacatggtctaatgtatagcatatggaaagtttttgtagcttacctcttcttgcaagactaaatgagaggactactgttggcagaaagcaaagttggtcaaggccaaaaataggactgactgttttctttagaccctccctttttcttccttgtaataatcttgaactcctagattccagtttttcctttatttagccaataaatatttactgaatcctaactattttccaggaactatggtaagtgctattgatagatgtattaggccttctttgacacggaagagcttacaacctaggtggagagggagaaacataactgcaatataaattgataaggcccataatgggacgaagaacaggctactatcctcattatacatctggtactcagagacctctacgttattccttggattttccccatacttgcaacccacctttttatcctcctcattaaaacttacctgttattgaatcccattttcccttaaggcaccccttttggataggtgctttgggaaaacaatcccacaaattaactcacactggatattaaaagagtaaagcatatacctcacatccctcttgcattttaacaagtcagtccatttgaaaagaactggttgctagtgatgggaatttcaagaactgtacagtaggccattagaaaagtaaaactttcctcatacacttcaatcacaacagagaggggttgaccgtacaacataaaacttccttttagatgccctaacactattattatttaaacaacatagcagctacatattcactaagaaaatacaattgaatttaattgttgttagtagtagtagttaccgctagtaactactgttactaaaatagaaattatatatcgatttaaaattataaaatttgccttattctttctttaacttttattttaagttcaggggtacaagtacatgtttgttacataggtaaatttgtgtcatgggggtctgttgtacagattatttcatcaaccaggtattaagccaagtatccattagttatttttcctgatcctttccctcctcccaccttccatcctctgatgggcccagtgtgtgttgttcccctctatgtgttcatgtgttctcatcatttagctcccacttataaatgagaacatatggtatttggttttttgttcctttgttagttcgctaaggctaacggcttacagccctatccatccatgtccctgagaagaacacgatcgcattctttttatggctgcctagtattccatggtgtatatgtactacattttctttaaccagtctatcattgatgggcatttaggttgaatccatgactttgctattgtgaatagtgctgcaatgaacatacacatgcatgtgtctttataatagaatgatttatattcctttaggtatattctttgatattattatgaagattcacatgaaatagcaaggaatggttttctagttggaaaagtatgattcccacaataaaagtaataaaatataataagaaatatttacatatatcaagaaaaaatgattcatgggatcacaaaataaaaattatacaaattgaggaaagccttatttaatataatgtctttaggaaaaaaattagtatctgtggacctgggattcctcccctgtaaaatgaagggtttaaataagaaaaactccactttcttgcttccaggcttaacacatatgtgaatcatttgcataaatatttctcaattttcctactacatgaaattttagttgctacaatatcacaattaggcagtctgcataaataaaggagtttctcttatatttctaaatataagagaaatatataaaatatactaaaatactaaatatataaaatatttaaaaatactaaatatactaaaatacagtactaaaataatgcctaacacaaagtaactgccttagcataatttaggtggctgattggatggattaaagcttggattaatagaaaaacacaatgatgcaaatgtgaagtcaggtatatgtctacacatctaacaacatttaatgagagacactgaagacccagaaatgagtatttttacaggcttacaaataaccgatgttcaatttgggggtcaaaacaagaaatagagaaaactgaagtaagttaggtaaggtccattttgactaggattatttctggcaatttcccctcatctactttctgcaaattcatgcatgttcactgtactgtgcttactgacaatctgtaccaaataactcctggcagtttgaaatcatttcatctataacatataaataccttatttgcttcaactgtacaaatgctggaccccatctcaccaaagttttctagaatttaattgttcttcacctaacatctttaaaactcaatttattggtctgtaaaacagtaagacctacattatagagttattgtgacaatcagacggactcaaagcatgtcatagtttcacttacgtatctaccaacccactatcattagccttctacttgagaccaacccctttacctaagtactaaatgtggtaatccttgaagtctctgggacttttctatacaattatcatttttctctgcttgacttcaatgtcttctctgctggctctttatttttcaaaacatgtaaatcatttgtattctaacattaccttgactctgtgcctctttttaccaacaattctccctcctttcatcacctgtgtatattgattaaataaacaaaaaacaattcaaagtaattttatatgaaaaacattgcgggaggaaaatagaataaaaagcaacagtaacaatataaaaaaaaaatcacctgttgtcaaccacaggcatttcttcccaggtgtaatatagttatataaaataaacttgtcatcagaagttttgaatctcagtatttttgcttaatattaaattttatatagcattaccttttctaaaaaaagtgttaaaatagtattttaatgactgcataatatcctatagtaagaatgaaatataattcatttattcattcctacatttagacatttaggtactgtcaaaaatttttgctactataaatggttctgataaacatgcttgcagataaatctttgcatacgtctctgaatatttctacaaaataatcttcaagattggaaattattgactaaagtaaaataaacaatgtgaatagcttttacctttctgacacaagcttaaagtctttgttctttcattaagggaaatttttccatttaaatttatactaaaaatattgtgttattgacaaggcaagtaaagaaaagaaatcaatgctactgaatcaggcactctgatggatattctgtctcttcctattcaacacattttcctttggcaatctcttttcatgagcttatcaactaccaatgtattgatggcttccaaatttctcttcaggtatgaattctcctttgagcttgaaactcccatgtccaaaggcttcttgactatatcctatggtgtgtcatgcagtcctttggattctgcattaataaaagtaaagtattcttacttcacaaaatattctgtaaataattacccaattttgttaatcaagtcatatggaagacaatgcataaatatacaaaataaagaataagaaatgtactacaaatattcagaaagcattaaaatatgtcaaaatactgttacagatatatactaataaaattgaaaatctcaggacataatcttctaagaaaatatacattttcaaaattgactctataaatggaaaattttaacaggccaataaatttaaaaattaattaagaaaggttccagaaacaggtggttcaagagcaaattctatttaatttcctttttcaaaaattgatagataaaattctatgtattttccatgtataacatgtttttaagtatacataccttgtagaacaactaaatttagctaattaacacatgtattacctcacagttatttctgagtaaacatccattcattatttttcaagaatacatgtattattaactatagtcatcatgttgtacaacagatctcttaaacttattccacctaattgaaatgtcatatcatttgaccaatatctccttaaaccccagttttaatagaaaattgaatttcattaagttttcaaggatcaaaataaacccataacatagtaacaaaaacaaaatatttccaaattcattttctgaagctagcaaaagcctaaaacagtacagcaaaggaggctactgagcactgttacttcactccattgaattaggactggatgcaagtgtaaagcatcagatttatagaacttactataaaaaactctaaaatatctcattaacattttcatattacatattaaaatggtaatatcttggctatattgttttaaataaaatacattattaaaattaacttcatctgtttctttttactttttaaaaatgtagtcacaagaaaattttaaattgcatatatggctcacattgtattcctattagtattaatatagataattttgcttataaggatacaaaacttctcagcgagttaaatataacaatatattaaaaataatttgtgatgaccaagaaagttgaaagttttccattagaatatctactaatatatatgataaatttatataagtatgattttaaaaacaataattttgatagtgctgaaaatgcatgcaataaaaatcaaccacaattcttaattttaaaactcttaataaactatgatgaaactctttaatgtaatgaagaatatctacctataaaatggttgacactacacctaatggtgaaaacattagtggtattcccagtgaagccaagagaaaaacaaactcttgctagcacttattattataatttggaagctccagcaataccacctaacatgaactataaacatgagaaaggagtagaataaaaaaattaagaaataattagaacttataaatcagtaacctgcttgtttactatacacacacacatacacacacacacacaccaaaaacagccatttaaaaatgcaaaggaaagaacaatctcttattaccaatgataaaaaataaaaactacatagaaactaacactacaagaaaaatgtcagacttatatggaaaaaatgtttttctaagtaatgttaaaaaattttgaataaattaagacatcttccagatgagaaacctctatgtcaattctccctaaaacagttcataaatttaatgcaaccactctcagaagtccaataaaattgaagggggggggcagtggtagagagaccttgattaaataattctaaatctcttataaaaaattggttaagaatagccagtaaccttttaaaatgaaaaatactaaaaagaaacttttattagcaggtttaaactgtattgtaaaagccacaataaatagtgtagtcctagtaaaccatatagaaactgatagaactgaagagaaaaaataggctggaaatcaaatagaaagacaagaaacaagcctatttgtaaattaagtatttagcatatgataaataatgcattttaaatcagtgggaaaaacatagattttttttcaattgatggtgctgagacaactggttaaatatttagaacagagtaaatttagagcctatctcacactgtatatcaaaataaaattccagatggtttgaagagttatatgtaaacaataaaaccataaaagaaatagaagcaaatacagaagaatttttaatcttatcttgggttggagaaggtcttcctaagcataaaagcaaaggcagaagccataaaaaatgtaatatggtttttaaaaatagaatatttgaacacataaaaatgaaaggtcagtatagcaaaaacaaatgaaactaaaaggcaaacaataaatttagaaaaaactatttgcaacatatgacagagtatcatatagcagctgaaaacaatgtcctatgaaaaataattaaggacctgggaaaaacaactagcacatagtgttaaacggagaaattgttataaaacagtacatacattattataggaactttgtaaaatacacttacatttgggtataatggtttcccacatataccatgtttataatttccatgcttttatacatatagtcccctttgactgaagagatcctccttccttccctgtctatacatctcctattcatctttcaagcatcatttctgacatccctttagacaacaagaagtcttctttgaattatcaggctggaatatgtgcccttcctttgtttgcccatagtacattgttgtacaccatcaaattaatgctatttaatattatctgtttacatgtattactccacccctatgattaaagttccttaagagaaagggtaatattttacctctttctgcatgctcatttcctagtattatatctgtcaattagtacacattcgaaaatattggtttgaattattgctaaaatgtcttctaattaagattattccaaaatgaagctaacatcaatagggagacaaacaacacaagaggcatcaaactgtataagaagtctgaaagaaaaaaaagacttaacgtcatgagagatgattctgtcctcattttcacgttaaaccagaagcttccttcagggtacagctcaatgagtcaccctagagtattctaggtatatattgatattcctaaaaatctaaacatatgtaccatatacaaaccgtgtcccacaatttatcacttaaagtttattgtttttaaatgatttctcatttatgagtcttttctctcattagacgttaatctctgttatgtgaagaggtcatgccttatctaggcagatatcctacaaagtgtttggctaagtaccctagtactttaataaaaattcaatatgcacaaattttctatacagctttaagtaattttctgtttttatttacatacatcccttcataattttctaagaaaatcaggatctactccaatttcctcattacccatcatcatccagaatgatgaagagatgtatagattattaagaaaatatttgcgtttgctgagtaaacccgatattatctaatcaaaagaacagcttcggctgtgctgctcctagctgtgctagtccacacagctttcccagttttcatgaattagtggaggtaatgttaaaccacttttctagtaagagtgcataaggatatttaagtgagctcatccctctaacaaaggaaagaataattttcattaatcattattcaacagtacatcttcttgaactaaatcatgagaggaggaacttatgatgttttttattagtcaaaacattttctatatatagcttagtatatgcaacgtgccaaattacagaattctatttactgctaatgtcaatttaccaccacattgcttgatataattcaaagttttccaaggagctatttgacctcctatagactgaaaataaaatcatgagatttaaattacttaatgccaaaaaggaaagtcatctttttctccttcttatgtctttgtttcataaaactattatcagacagtccatgcaaacaactaaaaacaaaaaattatatggtgtagttaattgaaaaaatgcttttgctacacacagaaattgacactaagtgctgtattagaaggaaatcagtgattttcaattgacattgcacaggaaatcatttagtgtcaattgatattaaatgggtaaaattgtactgaattagtacaaaatgatttggtggaaaaaaatgtgcttccattaggtgacttgatattaagtgggcttaaatgtaataagttttagaggtcactagtcaacaaaaattggggcatgctattcaaccctgagtacatcagactgcttgctcttaataccctcatcaaaagataagttagtgtcatactatcatgacaaaattgtcttcctttgggctttcaagggaagtgggaaaattcaaattgtttaaatgagctaaattagccagtggtaaggaccatgacttcttagatttatctggtggtcctaatcctttaaaaatatttttttttctagaatttttggcatgaaatgaaaggcaacataacagcacgtattttatgtaatatggtccagattgcgctttctttataaaatggctttgacagtaagcacacaataaattatattgtgttagggagtgatatgattatatataatgaagtaaccactttattgatcttttaagaaacctatgtttttaaacctgagtaatgaggaaagagaagtgtgtggctgcaggagacacaaggaaggagaagaaacaggaaaagttacattacacagtcactacaagaacaaattgaataaaatattatagatattttctgggaagagaaatgggggtttgtgaggtacagaaaattgtaaaactcatttgttacttagtaatacaagaaacaataacaataaaacagacatactgggaacactccacccaacaaaaacagaatacgcaatcttctcaagtgtatgtaaggcaattaccagtgtccaggatagaccacatattaggccacaaattaagtctccatagatttaaatagacaaatatcatacaaagtatcctttctgaccacaaagggataaagttagaaatcagtaacaaaatgaaaacagttaggcaacatactcttaaacaaaggatcaaaaaagaaatcacaagagaaattagaaaacacccagagatgaatgaaaaagtattatcccaaatcaaaacttaagaaacacagcaaaaggagtgctaaggggaaagtttataattataaatgcttacattaaacaacaaaaaagacctcaaatcagaacctaactttacaacctaaggaactaaaaaaaaaaaaaaaaaaacaaactaaacccacagctagcagaaggaaagaaatacgtattagagcagatgtaaaatacagaatagaaaaataagataaaaccaataaaaccaaaagttggttcttcaaaaatattaataagattgacaaacctttggatatatatactaagaaaaaaagagaagactcaaattacaaaaatcagaagtgagagaggaaacactactactattctacagaaataaaaatgattataaaagagtacgatgagcaattgctaggccaacgaattggataacctagttgaaatgtagaaattcctagaaaaacaaaacctaccataactaaaccacaaaggaatagaaaatctgaatagacctatataacttgtaaggagattgaatcaatattcaaaaatctcccaataaagaaaagtcctggacctgatgacttcactggtgagttctaccaattatttttaaaaagaataatatcaactaaagtttcctcaaaaaacaaaaaattgagctaccacatgatccagcaatcccactgctgggtatgtatatacccaaaagaaaggaaatcagtatatcaaagaggtatctgcactcttatatttgttgcagcactgtttacaatagctaagatttggaagtgtccatcaacagatgaatagataaagaagatgtggcatatatacataatgaagtactattcagcaataaaaaagaatccctctcaaacttttccaaaaaaatcagagaaggaaacactccctgattgattacatgaggcctgtattaccctgatgccaaaaccagacaaaaacacaataaataaaaacaacagaccaatatctcttatgagcattgacaaggattgaaaatccttaacaaattatagcaaaccaaattcagtagcatattaaaaggattttaccctatgaccaagtaggatttgtcgttgaaatgcaaggatttttaacagatgtaaacccatcaacataatacaccacattaacaaaataaagggaaaaaacaataatcttgattaatgcagaaaaactacttgacaaaatctgacatccttttataataaaaatcctcaaaaactaagaataaaagtaaaaaaccctaacataataaaatccatgtattaaaaactcacagctaaaataatactcaagggtaaaatactgaaagctcttcctctgagatcagcaacaaggcaagtactattccacataatactgaaagtcctagtcagagcagttaattaggaaaaaaagaaatgaaaggcacccaaatcagaaagaaataagtaaaattatctctgttcacatatcatatgatctcatatgtaaaaaacatattccacaatttccaccaaaaaaaaaccctgttagaactaataaataaatacaacaaagcagcaggataaaaaaaatcatcacgcaaaaatcagtcacattgctacacactaacactgaacaatctaaaaagaaaactaagaaaacaattccatatacagtagtatcacaaagaataatactatttagaaattaaccaaagaaataaaatttttaccaataaaatctataaaacttttctgaaagaaattaaagaagacataaatgaaaagaattgtgttcacgaattggaaggcttaacattgtcaagatatcagttctgcccaaagtaagatataatgtattccctataaaaatccaaattatgttttcacagaaatagaaaaactcatcccaaaattcacacgaagtatcagagaacccccaaacagccaaaacaaaactaaaaatgaagaataaaaccaaagcactcaaacttcctggtttcaaaacgtactacaaagctacagtaatcaaaacagcacggtactggcgtaaagacaaactaagaaataaaatagagtccagaaataaaccctcaccagtgtggttaaatgatccttgaaaagggtgctaaaattattcaatggggaacagacagtcttttcaataaatagtgattgggaaaagtgggtatccacatgcaaaagaataaacttcaatccttacctaacaccatatataaaattaattcaaaatagattctaaatataagctttaaatataagatctaaaactataaaactcttggaagaaagcatgaggcaaaagcttcatcatactggatttggcaattatttgagtatgacaacaggccataggcaatgacaacaaaaaagacaaattgagcttcataaaaattaaaaattaaatgcacctcaaaagtcaccatcaacagagtaaaaagccaaaccactgaataagggaacatgtttgcaagtctcatattggataaggggttaacatccaaaatatacagagaactcctaaaaacacaacaacaaaaatctgaatcaaaactgtgcaaagaacttgaatagacatatttccaagaaagatatacagatggcaaacaagcacatgaaaagatgttcaacatgactaatcatttgggaaatgtaaatcaaagctacaatgaaatggaatctcacaccaattagaattgctactatcaaacacacacacacacacacacacacacaaaacaagttttagtgaggatatggagaagttggaaccattttacacctttgatagaaatgtgaaaaacagcatggcagtttctcaaaaagttaaaaaatagaactaccatatgacagagcaattccacctctgggtatatattcaaaagaactgacagcagggtcttgaagagatatttgttaatatgttcatagcagccatattcacaacacccatattcacaattactaaaatatggaagcaattcaagtgtctattggatggataaatggatacacaaattgtgatatatatacacaatggaatattattcagtcttaaaaagtaaggaaattgtgacatatgctacaacatcagtgaactttgaggacactatgctaaatgaaataaagccaaacacaaaaagacaaatattgtatgatccaatttatatgaagtacttagggaaattaaatcataaagacagaaagtacaacggtggttgccaggttgctggtgggaaggaaaaatgaggagttgttcttttatgtgtataggctttaagtttgcaagatgaaaataattctggagatacttggtggtaatgggttcacaataatatgaatgtacttaatgccaccaaactgtacagttaaaattgaataaggtggtgtattttatgttatgtgtattttactacaataaaaaagttgaaaaaaaaatgaaagaaaagctttgtgatttttttttctttcttttttttttccgagacggagtctcgctctgtcgccaggctgaagtgtagtgtcgcgatctcggctcactgtaacctccgcttcccgggttcaagtgattctcctgcatcagcctcccgactagctgggactacagtcttgctctgtcaccaggctggagtgcagtggtgcgatctcggctcactgcaacctccgcctcccaggttcgagcgattctcctgcctcagcctcccgagtagctgggactacaggtgcgtgccatcacgcccagctaacttttgtatttttagtagagacggcgtttcaccatgttggccaggatggtctcgatctcttgacctcatgatctgcctgcctcggcctcccaaagtgctgggattacaggtgtgcaccgcagcgcccggccactttgtgattttttaaatgtgacctgccccaccccaaaaatacatagatagggaactcttcatggtaatcactgggcttgaagagatagcattaaccttttttctaatttggccctgagactgaaaaatatatatatccataggaacccatacagaacttacgatgaatgtccacgaagtaaaccaagaacattccccctagcattagcagagagcattctaaaatataatttagtttcatcacagaggaagcttacaatgaaactggagctacattcaggacagtctttaaggttcaggagaatgatttgctgattcaaatggacaacagagaaatctgattaaataataatatatttatgatcattactgtttattaagcttttactaatagtgaggataatcttcagcattcttcattaactatcaatcgttttgcttaacaatctgataaggtccacctatttcagaaacaaagatcatgagattaagaaaactgaccaaagtaacaagcacagtaaggtgttaaacccacatctatctgaatccaaagtaaagaaatttttggggggggcggagtgaggaggtggaaacagagtctcactccgtcacccaagctagagtgcagtggtgcaatctcagctcactgcaacctccgtctcccaggttcaagcaattctcctgcctcagcctcctgagcagctgggattacaggcttgcacaccatgcccagctcaatttttggatttttagtagaggcagggtttcaaaacgttggccaggctggtctcaaactcctgacctcaaatgatccgccagcctcgacctcccaaagtgctgggattacaggcgtggccaccatggtgggccccaagtaaagaatttttaactaggtaatttggactttcaaaactgggacatagttggtgatttaaaataaaaatcctcttgcaagaatctgaagctaaaatgttccaaagcacaacaggagctgtgaacaagttagtagtctataaggagaagtataaatacattggaagaattaatctagggggaggaatgtggtttaagcagtaattgataggtgaagatgagcacaaaaatcagaaaacacataactgtacctgtaagttgctattcctttaaatcttgccttatttttaaataaataaatatgctagaaaacatttattctttgtggttttagtacatagaataatattttaatttccaaataccacaaatgaggtctaaaacatgattaaataattaactccattatccttacaatagaaaacttagctattcaaacaatgaagtttcacatgggtgatgccacctcctacattgtcacacattaaaaagttatagtcacaggtttttaaagaaataacagcttttccgggttaaacttccaatctcaagcctattcatgatgataaatgtcacagggtcaaagacctacagggaaaatctacgttagctctaaggtgggttaaccagtacacactgattaatccaaaatccatttgttaggaacaaggcaagtactacacacccttcattttgaagatactcataaacccaattaacaattttcaatgacaaagcttgtccctttgtatgtatgtataataacatcatagaactctatacaagcacatacaaaacaaggtgaaaactgacttggccatacaggtttgcaatctaactagaaagcataaatatcacaaataaatagatgtaaatacaattagtacattgataaacatacttcatactcttatgcagtaaatactcaaaaaaataagcaatgaaaataacatagaatacttgttgaactgactaaactcatcccagtgaagtttcctgaatacattttccttgaatttttattataaaactgcagctaaattttgcctaaacaagtttatccctaaatgtaaacaatgcatccaacattatagaaatcatcaatttttaaaaatctgttgttggtaaactattaacgtcattatattcaaaggaaatgttaaaattattaaaattttaatattttaattctaaaaactatatactactatcaacatttgcttcacacatctgcaatatgaaagtggtaacgtctaaaggtttaacattttaaaataatattttcaccttttagccattgcattatatcaaagttatgcaattttttacctttttattattattttttgcattctctccctttactggagattattgccttcttctctgacatcataactagataatatctcaatgacctgttactgtatccttggataagaggagatagcatctccagtaaggtcaaatatgagtcaaccatgtgatatgggtactgaaaaattccaattaaatcttaaactgacctgacagaataacagtatctagaatgagggagatgacattcccactctcatcagcaatggtcagatggcatgatcaatactgtgatacatgacccagaagcacaataatatcctaagaagggggaagaggaagggtgaaagactagaatcataacatatttggaatggtagaaagaatcaagggtattacatgttgactatgcgattaggaaaacaatcgggatagaaaacgtttcaaatgtttgaaaacttcaaatgagattactctgtatgttcccaaggcatatactattaataaaatgatgggttgagaatactagatacaggtttcaactcaaagtaaataagaacctcttaacatcagaattgctcacagatgacgtgttgcttgaaatattagtgaacatatttcaagcagagactggaggtgtttaaagcagttttacaatatgattctattagtcttctcaaagctcagaattaaaatatttaataatgctgagtggtggatgtttttacagtgtggcctggaatctgcagttatcaacctacaagtgtctgatttttattagcaaagtattaaaaagttgttcattttcccaatttaagaagaagtttatgcactggacattgcttttcaaaagttattttttgaatagtggtaaccaaaggttggggcttgcgtagtggggagaatggggacatgttggtcaaagggtacaaaatttcagttaggagatataaattatggccatctattttacagcatgaaaacacatagttggtaacaaataatgcactacacacctgaaaattgctgaggatagattttaaatgttatcaccatacacacacatatacatacacacaaatgataagtatgtgagatgatagatatgttaagtagcttgatttattatttcacactgagtatatatatgttaaaacatcctttgctcaccataaatatatacaatttcatttgtcaattaaaaataataacaaagttacatatataattttttttatttcaagtggtatggctttatataatgctgaatgactcactgactgattgaatcactgtcattcattcaacagacatttattcagagcctggtatgtgccaaagactgcaaagtggcatacaaaaagaaagaataagacaaagcctatgcttataatatgtcagggtaagtagacacccaaaaataatcattttcaaagtttaagatcttattctagaagcctgtgctctgggagcacactggaatggcatttaactttccagaagaatcaaggaagacttcactgaggaggtgatatttgagctgggctttaaaagattaataggatttaactagatagcaagggaatggaatgatatttcaggcagaagaagcattatgtactcagaggcatgaaagtacatggtgtggttagtgaaaaaggcaagaaatttggtaaagctgaaatgtgaggtataaagtatggaaagagtgaaaataagactgacaaagtagatcatgactaaatatttggggtcaatataagccatgctaaggtgtttgggtttaatcttgggcacaaagaaatgttttcaagtagaaaggtaacatggttacatttgcattttagacaatatatgtgcatcatgtgtgagaaactcatttctataaatactagtttttgccttgaaacatttcagggggagtggaatcctcgagttactggcaccagcaagggtaaattaatgggcactagatggcggcatagagtgcccaattcttcataatatcagttactatttctgagcctgtatttttgacttaaataattcctttattcaaaaatcccattaaatgaatatgcactatttagactgattggcatgaagtaatagactactgtaaggggaacacgcattttttaaaagaggtaaagcccatgttggtgcatgatggaaaaggcagttgaggattataaaaatatttggataaaattaaaaatacaactttgagttcaatggaatcttaaatttctcttgcagaagttgccattcgtctttaaataataatacatatatgtgtaaaacacctaaacttcataaagtcatgttatattcaccatctgtcctcttcttcaattaccaccattaccacatggacaaacattacaattcacattttacaaggaacgaaactgaggctcatgtaaatgtttttcccagtttatatggtacagttaataaataatagtaccaaaaccaaaactctagtttttttattacaaatccagtctttggttcactttgtcatgtttcacaactgaaaaacaattgggaactaggacaagattaagacaaggaaatgatagaaccaaatgattctaatgccattctgtgataaacagagagcaaatactgtaaattggattgtatattcattaagcccatggtttctgacaattattttggaagaatttacatgtcaaagaaaattatgaccaatatttagttataccaaggaatttacattggagaagctctatatatttttaatgtttggttgataatatgttaacaagatgattagtaagaaacacaaaaatagtttgtaacttaagatgtaaaagattccaaataactataaattccctatggagaagccatctctgccccatgtcatcatgcctttaaaattagacgcaaaagtttgaatactcaacagtagaattgtttatttagtagtgtggaaggtctacctctgtctatttcctgagggaaagcggctataatgagcctgcctgaattatgagaataaagttttccttttttaaagagtttattctaacagataggaggtaacttttatttctgccttcctctcttgccactccatccccagctaagaatccaatccctcaagagctgtcatcgtttttgttgttgttgatactctccaccaagacaaactaaaccagactgagaccatgccattttagcattatgaaacaagaaagaaagcaaaagtcaccaacagagcaatacaggaatttgagatgtacagaggaactgaaaaaagaggagctgataggagcattctctttcaaagctcaatttagtgttccaactacttaaaaccctatcacaatatactctatgccatcagggaagaaaaatgccaattttaaaacattattttcacttttttataaaaggtaaaacatgttaaggtccatacgtaaaatctttccaacacatcagttcatctgcaaattagtagctgaagtctgctcaaacgcagaggaaacttccatttaggtcttgaaaaagaatagagctcattttaaaacatctttatttatttgtgcaacagtgagtttagaaacaaagtatccagtgtattttcctagagttaaaaaaagaaatatttttattgagtacattccaaaacaattaaatattctcttaccccacccttttcaccaactgaatagttttcgtttgactttgaattaccacccacttactgatttacaaactggtcaaattcagcatatatacccacactcatacaaaatgcatttcaggtttccctttttggattaaaaactaaaattttattttacagtgagagctaatttgttaggtaagacacaattaaaccaagaaagataaatctaaacttacttacttcttccaaatttgaaaattgtccatgagatcttcaccaataagctacatcttttccatgctttatgatcataccccattttttgtatgcaaagaagaaaggggactaatatctttgatcataagtgttgagatcctaaattaaatctaagatttggggccttattaatacaaagggagaaaatagttaactgaagatgtcattagtaaaaattttcattaacttctatctctataatttctggcctttccagttttcggttgcatctttctagaaatgcatgtccttttcctagccttagctctgaaaatattgcttctacccataaaatgtcatgttgataatgctttaaatattgaactataaaatttctatatcagaattaatgagcctatttcatgttttaacactgaaaatacattctaagagtttagaacttctttaataatttgtttaaaaagtagttgaaggccaggcatggtggctcacacctgtaatcccagcactctgggaggccaaggtgggcggatcacttgaggtcaggagtttgaaaccagcctggccaacatggtgaaaccccatctctactaaaaactaaaaaaaaaaaaaaaattagccaggtgtggtggcagccgcctgtaatcccagctactcgggaggctgaggcaagagactcgcttgaaaccaggaggcagaggttgcactgagccgagattgtaccactacactccagcctgggcaacactcagcaagactctggtctcaaaaagaaataaaataaaataaaataaaataaaataaaataaaataaaataaaataaaataataaaataaataaaagtagttgaaaccagaaaaaaagagatcatctaacatataggagtagaattttgagatataaagttttactccacattttctttgtcactaatatttccccactattccttgcactcataagcccttattttcagaatttattgtctattatggttttaatatgtgtcccctccaaatctcatgatgaaatgtggtctccggtgttggaggagggcctggtgggaggtgtttggatcatgggggttgatacctaatgaatggcttggcaccatctccttggtaataagtgagctctcactctaagttcacatgagatctggttgcttaaatgcatgtggcacctcctcacctccttgctcctgcttttgccatgtgaagtacctgctcctcctttgccttctgccattactgtaagattccttaggcctccccagaaaccaagcagattccagcaccatgcttcctgtacagcctgcagaactatgagccaattaaacctcttttctttataaattaacttgcttcaggtatttctttatagcaatacaagaatggcctactacactctccaggaagtttcaaatcacgtaagactaaatgttagtattcttactgcaagccaaccagcgtaggttcaccctcttttattttgcagcgagaaaaacaaaacaaaacaaaactaaatccatagagctgattttgatttacagatacattcattttatttataggtatcaggcatacttttttccaagcttcagacctccaatgagaaggcaaagcctaatgtggttcagtcttattacctggctaatttgaaaggcaaaataaatgacagtgaagaaataaaagacagctaaaccagatgatgttggtttgtaaactttaatgactacttattaaaattttgcaaaaaatgaaattggttattatctatatcagtgatttccaatggtggctaccagaagaattgcttgggaaccttttaaaacataccaatgccagagccctgccttacaccaattaaatcatatttggcagtgccaagtttaaaacatacctgaggtagcattttgttaagactgtttaacaaagttatcgagaacacaagctactttcaatctgaacttcatttgcctcatccccaaaatgggcagaataactacactatgtggatattgtgagaattaaatgaaataatgcttaagaagaatccagaacaatgactggctcacagtatgtactcatttgtaggtggtattgctattagagctcctgttgatctgcactggtaaaacctgtaggtgttacagaaaggaaatggtatgcctatgaataaggaaaaggaagaacactctttaaacatcaatcgcagccagcaatgtgctatacccatgagacataggaaatacagcagcaaatcatacttagcattcctgtgatagatgttagccttaatgaagtatcttcatgccatacacaggaccacaaaagcctctgtgggacccaacatacaatttcctataataactcgtgaatcccattcattaaattagtcatattgaacattcttattcaatttctctatatctaatgccaataaactaaaaaacatgtagtatatgttcctatttatatctgcatataaacataaatacatatttttacatatatatgaaacattaaaaaacagaggtaatttttttgtctatataattttcccgtagtggccgaatttcctaaaataagcatacatcatttttataagtaagatgctgatttcattttaattaaacaaataaaaagtcatatatatttaaaaatacaaagaaactacacctttctacaattaatttattagaagtttgtttactggtattgttattgtctgcactgaccttaagcctccttaaagaaaaaaaaaaggcaaacaactaaaatgcaatcaatccagtcaaattcatggtgttataaagttcttcagaacagcactaacatggaagacttttataataggaaaggaaaaaccaaataagagagaaagagaatataaataaattattcagccctccctttcaaaaagtaaagaaaatattttcagaatagattatttctttcattatactactgacatattctttccctaaattctaattctgatcctaatctttttctctacttcttttttctcctcatattttaagattctaagattgttctcaaactgttggcaactgctagatcacttgatgagggttcaacaagcatgtggaccaccagttttagttggaagaatgccattgtttacaatctttcatcaaggtatctcttactggctcaatgataaattgtgtgagccatagatcaggtgaaatttttatccagaaaaataattttaaaacatcttcatttgtactgaatcagaaaatcatgacatacttagaggtcactgggattaatactgaattcgagatggctctgtcaggtagttctagataatttgcaataagcatcaacccagaggttacgaaaaggtttctcactgaagactaccttcaatatgtaacagatgctaagtcaaaaattatattacacacaaacctaaaacgttgaaggttttaactcggaagatggagaaaaaaggattcttaatccatcttttgacagcactcagtcctataaagttgttagaaaaaaaaagtcttcatgttttgcacctggaaattatttttaaatgggcttaataatgtggcatcaattcctttcccccaaaatgagtaaacacatcaaatgttgggtaaaagtcatgttctcagtgatcgttgagccatatgtaccaaaattaatattctaaagaaattctgctatcttgtcctcaactaaaaatcttgttgaccttaaattaataggtcaaggctacttaagaattgatatgtatgacttaataagactacttgaaattataggaatagtttttataggatttacaagtattatgaagaaatagtttttcattttttcattcatagttgcaaaatgtaggttatgaaataactttaaaaaacaacatttccattcatgtaaaaacctccctctccttgctatgggcaagtctggttctccataccgtcacaatgacactttcgcagtcaacatcacagctcaggaaataattattaaaaacaaacaaacaaacacaaatatctattatagagtatgggtttttagtgataagaaaaacaaaagtcatcaagcatttcttcacatattcacagaacaaatgccaagagctgatttagaccttccaacttaaaatttaattatctgctaccacatacgttagatggtatctgtttttccacagtacagtaatatgttgatataatgcagaatccaacaatttggtatgataaaggaattttatcaatactttcttctgctttctctctgaacatatttgtcatcatctttgaggctgatttaccagttttgaagcaatcctgcgcattacttgtaactgtttttgctatgaggagtacaattctgaatgaagtctttgtagttttgatcttttcacctttagtaataaaagtcatctattttgtaccagaaaacagtaaaatggcaaaaacaaaaagtttcaatagcttcctttgattatttgacaaagtttgagaaaagacaacatacttggaaccagaggaatcaggaagaaaaaggactgctggtatttgtcagtgggctttctatttgtgcttcttaagctgattgtacgaaatcctcacacctccatgttcactttacccagcacttattaaatgtacattttattgctccagaaaactattcactatttatacttataatcattattgtacattattgttagaattttcatatttttatattttaatgaatctcctttaaactactgatgtatttttgtgaattggaaatacaacagaaaagtaacaatgaataatgcaaaatttaataaatgtaaacaatctgcaagttatgtaaaacatattaacccggacatattatatactgtatcctgttaaatgcctgttggttgagataaacacaagcaaatcagtttcaggatctaattggtggtgaacagctttcactatagtaaagttaactttatgtataacgaaattgtttacaaggcctgcattccacacaatgacctggaattgtgacagttcctcagtcccagagatgctatattcatgattttgcaataaacaaaactaatacttattaagagctaagaaaattttctggccgggcgcggtggctcacgtctgtaatcccagcactttgggaggctgaggcaggcagaacacgaggtcaggagatcgagaccatcctggctaacacggtgaaaccccagtctctactaaaaatacaaaaaaaaaattggccgggcgtggtggcgggcgcctgtggtcccagctacttgggaggctgaggcaggagaatggcgtgaacccgggaggcggagcttgcagtgagctgagttcgcgccactgcactccagcctgggcgacagagcgagactctgtctcaaaaaataaaaataaaaaaagagctagcaaaattttctaaattaaatcctaaatcttttcttaattgtatcacatcttcacatacacacaaatctactatttctatctcaattcagttagctttatattcctgaattggtttgactcagatagaaaagttcccacaacaactcattttgagaccatttcaaggtctgcctatttaatgtagtttaaatcctatgtcaaagtcagggccttgggtttatataatttatactgataaatcataatgataatcataataatatctcaacagaaatgtctgtcatttcaggtaagataaataatcttgactaaattaaaacaaatgttgaggtaattattactatgtacatttgaaagcaaccataagcttcacaaaatgaatcaaattcacaatcgctactctcacaaagtttatgtattaaggactattgcaaaagtcatccattagtcttttcttacacaaataggaagtgaaaccaatgatttaccctttgtttacaaagatgtgactatttttaaattgttatttacatttaaattgagcatttatttagcacttgtcttaaaacagtaatttttggatgatatataaaagagtatttattaaagacttctatctaaaaaaaaggatttataccaatccatgcacatattagcttacttctacaacctcacctttcacaggtacacatacttgaacctccaaacttactccattcatactgaactatgtgaactatatgcaaacccatgaacgggtcatatactttttttttaatgctaaactttttaataagctgtttctcttcttataaaacccttaatacttgtaactggctaattcctactcaccttttcagtgctctcttagccatcatgtcctgtaggaagtcttccctgacttgggttaagtgccccttcttgtgactctatacctctctggtatatagagagaggaattatcactcaacagcaattattataagatattgaaaatgtccagtgcccagcctgtctctcccactataccatacattctcaaagaaaaggagtatctggtggttacttttttatttctagcatctagacaaataacaagtattgactaaataaagtatatttcagaatacaagttgggtattccttgtccaaagtgtttcgtatttcagattttttcagattttagaatatttgcatacacataatgaaatattcttacaatagaacccaagtctaaacacaaaatttatgtttcacatataccttatatacgtagccttaaggtaattttgtacaatattttataataattttgtgcacctctcaagtgaagttaggtgtgaaattttccacttctggcatcatggcagtgctcaaaaagttttggactttggaatattttacttcagattttcagattatggatgttcaactggtataaggcaaactgtttagtcaatgttatttctcagaagaaagactctcatattatgggccacacttccaattactttcttataaacaacaaagtagtatttaggaaagatttattagcaaggaattacctcagttggtactggtttgtcatggctttagaggtcaatctgctagaatagttaaaaatagaggcaaaataaaatgtaatacaagtttagtttttatttctggaatttttttcacaattgcaaatgttagctgctgatttaaatatgcctttcaaacatcatataaaacagccaaaagattatatcattacatagtacagatcgtaaatatatgcttaaggaacaagtgttgaaaaaaattcccctagtgttatggaaatggtatttgtgtcttctgatgaaattttaagtgacagtatcaaagatgaatttaaaacatgttataactaaaataacttaggtaaaaccaaaaatgatgtggttcggaaaacattgaaaaggtacgaattttataaatgtatgtgacgaatatgaataaaacgttcataaagttaggattgaaaattaacattagtaaattaaaatattattttatatgactttagttataattatgtatatgctatgaaattataagtaaatatttgtctctcatatctaaagctcccttcaaaagagtttttttatgataaaatataaaattcattagcttagagttatttgggggcatgtatgacatttgataaatacatgattaagtgaatgaattaagctctcttcatcttagaaatcaaaactagaattatattatcaaacacctttatgtttgtttatataaaaataattttaatacattttataaattatgatactttaaagaatgtatgcattcctaggggtcctctgaatctctcaatgatttattaacttttatttcactttctataatccctaccataaatattcagtcacataccatctcacgcatacaggcataactggcatgtaaacttaggtaacttttcaccgaaacttttatgtgcagatgacagttctgattaaaggctatgatcaatatgtcctctgatatggacatatggttaaaatatcactgtgtagttttccctacagaaaagggtaataataaaaggatggtaataagatgaaaggtactctacaactctattagaaacaatagaaaaacaaagtcaatccaaaatcataggaggacaaaattacaaactattgtttttaaaataatgatctatcattttttagcacaatcttcaatttcaggtataagcttcaattcctatactcagaaattccaaaacgctgttatttaaattattaatgatttaacggaaattttataatactaaaacttaaagcttaaggtatcttggctaaatttttttgctaggtacattcattcaataattcattcagacatttaggtaataattaaatgactattaaagtcctactatattttgggtagtatgttagttcctatggtgacaatgagaagaaaaaagcagacacaattccgttttcatattactaatgccttgtgggaaccagacattaatcaataatcataaaattattatataactataaatagattttggagagaaaaatgagattccatgatagcatctgaggaaaaaaaattgacatgcttaagaagatttcactgagaaagtgatgtttaagctgatatgatagatgggtaggagtttagagactagcaaattaaagctaatagggaccaggattaatattaagaggttcttttttaaatgaatacataggtattcataggtagtaagagctgttgattagtaaattgttgggacaggaattaacgttgttacagtaataccttcaaaatagtttgttttcctaaattggcgagaaatcattctagaaatgctggccataggatctttgtgtttgacaaacccgtgttttgtaagacaaatttcagcaagttctttttccaattatcataaatttagaattatattttctgtcttcatccagtttcacactgctctaaagaactacctctgattgggtagtttatgaagaaaagaggattaattgacttaatagttccacaggctgtacaggaagcatgcctggggggcctcagaaaacttaaaggtgaaggggaagcaagcatggcttactatggaggagcaggagagagaaaatgaagagggaagtgctacacacttttaaccaaccagatctcggtgagaactcactcactatcatgagaacagcaagcgggaaatttgcacccatgatctgatcacctcccatcaagtccctcccccaacattggggattaaaatacaacatgagatttgggtggggacacagagcccaaccatatcagtgaaatcctaattgatgagactttagccacaatttaatgatataataaaactttctaaagataaaagtgtggttaggcatggtggctcatgcctgtaatcccagcactttaggaggtggaggcgggcagatcacaaggtcaggagatccagacaatcctggacaacatggtgaaaccctgtctctactaaaaatacaaaaattagctgggcatggtggtgcatgcctgtaatcccagctactcgggaggctgaggcaggagaatcgctagaaccaggtagttggaggttgcagtgagccaaaattgcaccggtgcactccaacctaggtaatggagtgagacgctttctcatggaaaaaaaaaaagtgactagaccacagtactatcttgtatactaaagaaatacagagttaaagagatgagattataattatattgcactaataaatggaaattcgtcatctttcctcctgcaaagtttaactaaaagacaaatatcttgttcaggaagaagcttgtcaagttttcattcctatcactgattatcctacaaacacacacacagacacaaaagtgagctaatttaagaaatcataaatttaaattactgagagttttgttataatgtttgaggtatatctaattttcactataaactgtaaatgctattataggagactcagaaaatgcaaaaagctagaaatttcagaagataaaattattcagaatcccatcactgcaaaatgagcactgtaaaaattttcatgtttgaattgtttttagtaataataattttcattctttaattgaatttttaattaatttcaaaaaacgtttatagctaatcaaactctctggtcattcagttttttgtactcttcagtaaagtccacagtaaaggctaatctgaatgctgacatcactgcctataactctctctgttgtggtttagccattttagctcccctttcaagaacagtaattccccctgaactaaatattgttaaccacagataaagaagtacaaaacaaagcctatgttgttttcctgtgaatccaaatgagaaataacgactttaaagcatttgatctatccctttaaaagatgtaacacattggagactataaatcttctccctataaatccaacagagcttttcttatccttcatcgttggaacagtttcttgtttgtttgttttgctttgttttgtttttatttcagttcagaaccatataaagtaactgaattggttttaggtcaaagctatgtattttttggtgtcatcaaatattagaatcactcagaatggcaagatgctcacatcctgagaagtaaacagggatggaagccaaccataactccaatctcactcagggtggtgagttcactaatcagcaagagcttatttaagtggaatagtgagagtacttgctcaataatttgataaaaatttcttttttaaatgaatgcatatggttaaatttgtgtaaattaagtatgtgtatattaactcacatttattgatgagattctactgtatttcatcccaactttcattagaatacatattctttctataatttaagaatttccatattgaaacctgcaaataatttgttctctgcttatattatccgaatgccctataaacctgtctgatacttaaattctgaatgaaacttctaggagatgtaagatgataatatccagaaaaataaagaggaaaaaggatgaaaacaacagaatgtgtcggtataaggacatgttacaaagtttttactgggtttagtctgtggttggtttatcattatattgcaaaaaactctcccataaactactaatgattgtaattcctattaaattgggctttcatattaaattgtttaaattagttctttactctgtaagcataatcataatccattgtcccccattagtcaatttctgctttgtaaaattaaatattctgaattttaacatgtgaggcattgaaatatacaatgcttttcacatacccaagacagaaagcctatgactaaacttatgaagaaacaaactatagagaaatagctgtgaaaaaatacttcttattgtgataaaaatatcaaatgatctgtttacagggagcaataaaaggcaccatttcaactttcaacataggttgttccttttcatttgtatttccaggaaagcgctgaaataaccaatagtcatccagtttaattattctttaaacttttttaatttaagctcaactatttgaatcatagcaagtttgtaagtttcacaaccaacgtcttaatattaaaaatgaagaacttaggcttagagagattgtatgaattatctcacatttttgcacttactcagtagcagcattagaacccaaactcaaatcttttccccgtcaagtattccattagaacactacagcatgttctattttgagtctctctaggctaagactacatagttcaagtgaaaattaataatgcataattaattatttgccaaacaggaggaatatttaaggttaacctttatcatgcaagcaacaattacttagataatacaaaatcaactgatttgacactttgattattataaatcacaaaacaaataaaaaactaggaatggctcccaggttggcccatagagggattattaagatccctacatgtattcataaaagtaatgcaataattttgatttttcttagctctttatgcttttcacactcaatattttactcttatagtgacttacaggcatcaggaaaatgcagaaattaattataagaagtgttaggacttgcctcaattctcctgctaatccatgtagaaggtcttcaacctcaggtctgagttcttatagaaatcaaaacttttataggagtccatgctttcctgacaacagacaaacattccaggggttccttgagacaaagccatgtacacaatgcaggtcccagtttcttggacttctttctattatcactaatatatatagccatagagtaattttaacttacaaacttttgctccctccaacttacaatcttttgctccctcctggtaatctctctctctctctctctctctctctctctctctctcactgtccactagccttggaagaaaccaactgtcatgtcataaggacactcaagcagccctacagacaggactttgtggtcagaaactgagacttcctaccaagaaccataggattaatccattttggaaacagattattctttagatgaccactgacctggtcaatatcttcactgcaacctacaagaggctctgaactagaagcacccagtaaagcaggtcccaaattcctgacccacagaaatagtgagataaatgtttgttgttttaagctgctaagtctgtggtaatttgttatatgacaatagatagcaaacacccactatgagaaatccaggttaactactgaatctgtttcttcaccgttacaatgagataatagagatataaatatctaacatatcgcattgttgtaaagataaagaatataaaaaacactgtccctagaagacagtaaaagctcaatgaatgtcattttttatttttctattaatattataactatcattatcaatctcagaagtttgccatgtttcataatcttttgctggctcatgtttacttcattagctgagcaagtgaaattcatacactaaaataaatacagataattgaaattaattatagagaacagtacaataaacgtattataagaaaacactaagaatattttcatagctttggggtagaaaaatgttccttggcataatccaaggtaaagaccctcaaaaagttgagagatatgactacataaaaattgaaaacatctttagagtaaataattccatataaaagttagaagtcaaatgccaaaagggtgaaaatattttatatatgtcaaaaagtgagtatctttaaaatacagtcttacaaaataatgagagatacatataagcatgtatgggagtgtgtaaaacattttttacagcagaataaaacaaaaacatgcaagtaagtgaatggaaatttcacagtagttcaaatgactagtaaacatataaagagatgctcaaaaaataaaggaaatacaaaatgaaaaagtcatgggtatcactttttaccttggcttagactgaaaatgtttattatcgatgagagggtagagaaactagcacaaccctgtgagaggtaaagaattcttgaagagtattctggcaatatgtatcataaccttatatgtgctccctcatgcccctgcaacctggcaatgattttatcctaaagaaataatcataaaagtcacacatgatttgcaaagagtcatggacactgatacacataaatacttgaaaaacaagcatctttcatatttttgcattttaacaagttagcttatagaataatatgtattatatgttgccatttttgtattttaaaaagtgtcttctcttcaaaagttattttaaaaataccgaactatactaatgattgcgtgagggtatgtggatagcatcaggaggatcttctgtttatatccagaaaataataaaccataaagctacctagttgtttaatagtcaaatcttaccatctcaattttatggtacaccatttatgtaagtggttatccatatttcattatagggtgtttgggcttaatatgagaaaaggaagagcaaagaagtagaataaggaataatgtactctctttatttaaccagaaaatatggattgagatgtagctacttaacaataacaggtttgtgtctaatgagagcctcaaggagttggagtcattctgttgtagcacatatctattccagaatatatgtgcttgtataaattctgttgagaataaaaataatctacatactctaattacttaaacataattttcaaaattattatagagtcaaaacagttaaccccttttcattatccttctgtcttctctaacacctctggtggatgagctgctattgcaactgtcattgcaattattgattgcaatttttgtcattgcatttattgatataagaaagtttaaatccattaactttaacttcgtatttcttttctgtcccatgtgttctttatttttttttctctttgtctgcctttttttgaaatagttgagtattcaatgttccattttatctctattttggccttactgttatatctctttattttgtaatgattattgtagggtttacaatatgtaacttttaacttatcaaggctaccttgaaataataatataccacttcatatataatatcaaaccatttcaacaacacacttctatttccctgctccaattatttatgtaatttatgtcaaacatcttactactatataacccacaatacattgttaattattttgctgcaaagtgttaccttttaaataaaattttaaaagaaaaaagtgtgttatatttactcatatatttaccatttctggtactcctctttactttgtgttattacaaatttccatcttatttggtatcattttccttcttcctgaagaacctccattaacacatcttgtagtgcttgtctgtgggtgatgatttctctttcagcttttatgtccccaaaagtctttattttatagaattctaggttgactctttttatctttcagcattttaaagatgtctatattagtccgttctcatgctgctaataaagatatactcaagactgggtaatttataaaagaaaaaatttaattgactcacagttcagcacagctggggtggcctcaggaaacttacaatcatgatggaagaggaggcaaacacatccttcttcacatggcagcagcaagaagtgctgagcaaaagggggaaaagccccttataaaaccatcagatcttgtgagaactcactcattatcatgagaacagcatgaggtaaccactcccgtgattaaattacctcccaccgggtccctcccacaacacggggattatgggaactacaattcccgatgagatttgggtggggacatagccaaacatatcaatgaaattctaagtcttctagtttatattgtttctgacaagaagtatttaatatttgtgtcttcctcctgtacataatgcctccatttcctgtctctttctgggattttcttgttatcaattgttttcaacaattttagtatcatgtgtcttgatgccatttccttcatttttctcctcttacttatagttgaaatctctagatctttgtaaatacagttttagtcaaatttgaaatattttcagtggccaggcatggtgggtcatgcctctaatcacagcactttgggaggctgaggcaggcagatcacttgaggtcaggagtttgagaccagcctggccaacatggcaaaaccctgtctctactagaaatacaaaaattagccgggcaaggtgggggttgcttgtagtcccagctactcaggaggttgaggcaggagaatcacttgaacccaggaggcagaggttgcagtaagccacgatgtgccactgcactccagcctgggcaacagagcaagactccatatatatatatttcagcctttgattgtccaagtaatttttcttccttccttccccacctcctttttaggactaacatacaggttaaactgcttcatagtgtcccataaatctctgaggttatatttgtgtgtctgtttcaatcttttttctcagattgtgtgtgtgcttcagattggatagtttctattgctatgtcttcacattcactaatcctttttctgtagtatctaatatcctgttataccataccaatgtagtaaattttttcattccaaatatatttttcatctctaaaagttccatttagttcccttttatgccactcatttctctcctgatcatagtcaagctttcctttaaatccttgatcacatttataataatggttacaaaatatttttcttctaattccgtcatctctgccatttctgaacgttttttcattggtaatttttttcccagttacatgtcacattttccagctttttcatgtaacataaattttattttgatgtcattcatcataaactttttgttgttgactgctgaattttgttgaacttcacaaagtattagacatttttctggcaggctggttaatagcttgcagatcagtttggtccttttgagtcttattcttaagctctattagggcaggcttgttaggccctactgaaaaagaattatcctttttgggatctcatttccctggctattaacaaagtgtctccactttggctgaacaaaactcaaacacttccaatccgcgaaagctccaggagtggttcaccttttcagctctctggttgttctttgccggccttctggaggtttacccaaagtatgcacagtttaatattcagcattcaataggctcaaggcaatccttttgcagatttccaaagttccttgtctgcatatctcccttcctccggtattctacctgcaaattctactgcctcatctccctgaatttcaatttctatctcctaatctcagtgtgatcactgtgctctgtttaggtttcccttctgtacattatgatcaggaaagtacatccaagcataaaattttttctatgcaacagaagaagatattatttttaagtgtatacctctccctattatgtcatacaaatttcagggcttattttcaagaaccatgtcttttatatggtatctggttatgttgttactattttgaaataaaatacaggaattgaatttattcagtgtttcatctttgaataacctgaaaattgtatagtaattccttatcttctcacccaaaccactgatatataaaatactatttaagacgacaagatcaaacaaggtcacttactatcttcctttgggcatacctatattttagccatgcttaactttgtatcattactcaaacaacctcttttaacacccatcttcttgattctatttttaagagaatgagatctatggtaaactgtctaagttcaaatcctgacccaactagtttataaagcaagttatacttaaagcatctttgacttcatattatcatgtccatgtagaaataataatatagtctacctcaaaatgattatgaagaataaaagaaacaatatacagtcaatgaatgtgagctaatgttatcacttgcaaaccttttccctatttctttatatgcaaaccctatccgtaattccatttcagttaaaatgccatctctacaggaaggctttcccgggatccatgctgagaggattctttcttaagatactcatcacagggcatttatgtgatttatatttttcttcttagcttctatactaagcaattaagttcttgaaaggagcttccatgttttactctctcttttttcaaaaagatatcccacagtggacagtaaattgctttgtatttagtaggctattcacaaatacttgcctcagaaaagaaaattaaacatgactatatgggggaagtttttcaaataacttatgaatctccctaaatctactgccatcattttatcaaatcccttgtttacaccaagatacatatgtttgcaaaattttcttagctaacaacccagttaactttatcagaaaaggagaaatgagattagtatgacatgacttgttcttggtaaaataacaccttggtttctacatggtcacaaataatctattcaatatttcagaattttgcaggagataaagttaactctgtaggttagagaattcacctttatttcatctttaatattttatatgtttgcttgtatccattattttatatcttccgattctccaaatatgatcatttctggaagttatgatgttcagtcaaagaaagtttagactttggagcaaaagtccttaggtttggattccagttgttctgatagacagcagtgtggcttgaaaaagatatatttactttcagttaacacatctataaatggagataataaaattttcttggagcatggtgattattaaatgagaataagtgaaaaggtatgacctactgcctactgctaaaaactttttatttgcttccttttggtttcctcacctgcaaaatgcaaatagtcatccctgtttacttttcaggattcccttaaggattcagtgaatacatacattgtgatactttgaaaaacacacattatataaatatgcaagtttttaaaaaaattatggtcattattattcttgaataaaagttaccaaactctgtggacttagattgtaaatttgccaaaatagtctcctattaaccaatttattgatttccattcatttcttctaatttgaagattattcttcttggaaagaaaaatataggcaaaatatttgttcatcatctctgccttctctgtgtcatctctgaaaattatgtcatattctcccaagtaatgcctctatctattcagtctgaggtgacttttcaaatctcttctaaaagtttacgattttacaagagtaaattagagtgttcttgtacacacacacaagagaccaaaaaaaatcagaacacattttcacaaacagctgaaactatttaatatgggtatccttaaaaacaataaaatattatgaacagtaaaagtcaattatttattttatgacagaaatatttcagtgtgattatatctgagtatatcttcaattttttttgttcaggcagcaagcattggtcctttttaccaaccactacaaattatgcaccctaaacattatgcactctatgctataaaatgacaatataaaaatataatccaatctacattaattgaacataaagtacattctgatactcagcttagactaaccataacacagaatttgtcattaaacgttcagttcacacacatacactcaaaactgatccaacaactcctattatgccagttaccagcattgccagcccctttgcccttcactgcctggagaacgtccatcagaaacagggaagcagagcaaactgccacaatgcaccattgatgtttgagcaaggctgcctaagcagctgcaataacagggcaactcttcaaagtgtcagcattgaaacttacaattctctctcccatacactatcaatgaaaacctttataagctacaatcaattataaaataaatctttgagacaaatcatgttctttcttcatttcttctctccttcttttcctcccaaaaccaaatgtccttggttaaaagaaaaattcaaggagaaatatcccccctttctatcttggtctctgcctctgcctctcttatgtctaaaaattctctcaaggaggtttaaggatatctgctaaacacttttgtttacaagacaagttctggggttttttgtttgtttgctgttgggtttttattgttggaatgtttttattttaaaaattcaaaaggcacttgatattttgagcacactcatactagatttttggcaaagcatgtttttgattattaaaagacaatctaaattctgaaatgcatgcaccaaatcacataacctccatatttttgtaaaccacaacaaaagtgcctcatattagctacagatgaatagctaatgagtcagcaaacagttaaaaacattccatgagaatagatgcactagccatgcaaagtttttgagggaaaaatatattaagtatttaaaaactacttagaatgaagggaaactattctttctttaacaaagcaactatgtttaatttgtcttatgattatacctaccaaaccaaatgaaagtttatctgtctttttctatttctccttagccatcaatagttaatgcctttttaaattttgtaacatatatttaaggtctcagaattgtagcaacaacttttagattcttcatcattgtttttatcattcaaacagcatgcgaaaaccccttcaaatataatgtcaaggtataactctaattcctgcagataacaaaaatatatacacttcatcatgagttaatctactacctgaacaatcaaagtccaaaatacttggtatctgagttcagggtgcaataataataaattgccatagacttggttaaacaacagaatttaacaacaaaaatgtatttctcacagttctgagggctgagaagtctgagattagaatgccagcatgaccaggttttgatgaatgcctttgtcctggtttgcatatagtagtcttctcactgcgtcctcacatgatggagggccaagagacagagtggaagcaagcttctataagggcactattcccatcttgagggccccaccttcatggcctaattacctaccaaaggccccatgtacaaatgccatcacattaaagattaggttttcaatatatgaattttgaggtgacacaaacattcagctcatagcatttagaaatctgtaagaatttttagttatcatttctcattattgtcaaagcaacacacacacacacacacacacacacacacaaacacacacacacagtttaccagttaaatagtaccacaaagtttatacaaaatacagcatcccgtatccaaaactttgaccctctgccaaaactcattctagtgtttgcctgatttctaaataatatgcttctattgttatttttatttataaattttagacataatatattaacttcctatcatggcagaagacttagttctttgatactacctcatttccctttcttccatccttccagtaatcagtgaagtaatatttttgaatacatttggtaccttgagtagtaacaatatttccttcctattgttaatattgtcactttgccccccacattcccaaggtttgcaacagaaatgtaaaacctctataaatataatatttcacactcttacacatgaagaatcctattctaattctttcccctgaagacatccctttcgggagttctccatcttctagctcaagtaaagactgcttatttttaagatcaatgcacagaagttatccagtaacttcccttcacctttctcacctcattttaatcacctgtttcctgaaccctctatcttggtcttttctcctcagtttttcctcacttggacgtagcatacccttgaaacaattccggagaaagcaagtgtgggggtacatttggagaaccatgtgtctaaaaataaaaatgttttttctacccttatacgtaattggtagtttgggtgtagaattcaaagttaaaagtaattttctctcataattctttttttttttttttttttttttttgagacggaatttcgctctcgtttcccaggctggagtgcaatggcaaaatcttggctcactgcaacctccgcctcccgggttcaagtgattctcctgcctcagcctcccaagtagctaggattacaggcatgtgccaacacacccagctagttttaaattttttagagatgaggtttcaccatgttggtcaggctggtctcgagctcctgacctcaggtgatccacctgcctcagcctcccaaagtgttgggattacttacaggcgtgagccaccgtgcccggccttctctctgaattttaaagccacatcttctagctttgaatgttgtcattaagaaatcagataccattctggttcttgagccaatgtatgaggcctatatttctctcgggaactttctattatcatctatttattactgttattttgaaattttccaattatgcatcttggtgtggaattgctttcacatttttatgggcactcagaagatccttccaaactggaacctttggggctgaaaaattttaccatatacttttataacagtttcctccctatcattttctttgctctcgcctgccttctgaacttcccattaatcagatgttcagcttgttggatcgtttgtttgatttttatctcttctctcctattttccatttatttgacttttttttgctctattttcaggaaaatttctatcatataaaagcttatttcagttattataaaagtgcttattctctggttatttcttctttttatataatcttgtcatgtttcatagtagcagtatcttctgctatctctctgagtatattaattatactttatttctacttcagctactgttttctacaggacatactgcctctaattcttaaacaggttctggagtatgaactgtcttgtttctcattgacacaacactctccagtcacatgtattcggctttcccatttctgccagttcctcctttacatcttccaaaagttgtgtctctttaatatgttgcttcctcttccttatgcctgtggatttatatattttttagtcttttgctcaaaatttttagtcccttactaggaaggaacatggaaaaacatgtgttcaatcacgaagtttaactggaagtctgctgttaaatttcctgaagatgttaatcctagagctataatcatgctattcacagggtcataaaatcatagggctcttactataaaaaggttatcagagatcatccgattcaaccctcttattttataaaagtgagaaaatggaaacccaaagaggttaagtggtttgtgcaaggttatttaaatagcaatccatacatttggtatttgacttgctttcattaccatagtgcctcctcaaatagatatccccttaaagtagtgactcagaagactcccagacacatcctagggttaacacatttgaataagccaatctagcttttggatataaaatggaggagagctgtcattaaagaaaatctgggaaaaaatgtctccaagaataaatatttgactctggacatcctgttttctactagtagaaattccctaatcaatactctcccatgaaactcattccccttattcagcttcagcataacacacttatcctaacttttactctttcaggttacagaatcacatcatattttctcaaagcaaggtaaatctgtgtttgaaattcaaatgaatcttttatatctttcctaagtttctaccctcaattccttcctgacctctggctggccaccaacctcctactcctaaaatagtccttttttttttctgcaaatggcaccacccaggtactcgagaaaaacatcttgagagtcatcctaaacttctctttttctttaacagcatccaacttccaccccttcaccgatacagtacccaaatcttatcaattctacttcctaaaaatcccttgaatccattcctcttaggttcctcatagcttcacagtcactgtttcagttcatgccctcactatacttcaccctgatttccattaattgtcttctaacagtctcacagactctggtctgctttcttcataccccttcttccacactcaattgctgaagtgctttttctcaatagaactaagaagtcatttcctcacttaaaacccttcagaggatcccacctcatttctgacttcttagtatagcatatataaggcacttcatgataggcacctacttatccctccatcttcatctcctgtggctcttcaccttgcatgttatggaactagaaatcagaaaatcaaaagtctcctctcgggtttctattcacactggattttcaacaccaaatgccaaatgtcccttcccctgtcttctcccaaataaaggaatccaacaaaagagagtgaaaagattaaaaaccagttaaaaccatttaaaattattaaagtgcttttaccataatattttacatttatatttataatattttatctttatcttttagggattatagtctgtttaaatatgttggtagtacattaaattattattcagaacactgaagatgtaaattaaatatgaccataacaataataattagactcttatcatgtgaaataattaaggaattaacacattattatagtaagggccaaatctaagaaatgtactataccataccaccagactgcacacttttagtagacaggactgtgtcttaatcatctttacattccctactatgccaaatactatccccaacataatagatgcacagtgaattagtaaatgattaaataaaattagaaataatatcacacccacaaacccgggaagcaattatttgcctactacttgatgaggccaataattcaatgatatttattattatagttgatcgagttagtcaaatgtcatgagtgcctcttaaaaaatttatatatatacacacatttttctgcagatctttatacggaacatcaatctaatctttatttgggcatataaatcattcaatggataacacagtgaaaattttcaacataacagaaagacatatgctatttgaaaaatcagtaaaaaaaaaaaaaaagatgattctattgttggtattcttatcttcagattgtcctccacagcacatccctctgatacagagaaataaaaactttcttacctagaactctgatcaagttactgccttttataccactataatgatattcaaactggcttctaagcaaaatagaacagaaacattgcacatgcacatgcacttgaattgtacacttcttctatcgtatcaacttcatgtaccatgatatgctcgccattaatatgcactaaagctaacttgctagcctgccgcaattttattgttgcagcaaaacaatagtggtggattaacccatcacctcaagtttagcaatacatcctggaccagttatagatatgcattaatccacaacttaaaatgtaaaatatcaaggagctgggccaatccaggcatatgagtcaagaacacagcacttcaaacatatccaaactgaaactggttcttttctctgcctagaaaggtacttaacaatgggttctgaatatcatgttgactgacaggtatgtcatataaagaaggaaatcctcttaaatcttacctccttaaaaatatcaggtttaacagaagagtatgatgtgtagatccctactagatagaagcctgaatacctaacccattatataaatagtatgtattgtatagtatataaaggctgcgattttctgggctgctgcctactttttatgttttactgttgtcttcatgtaaaataactgtatggaaatggtatacctaaagagacaaaacgggtgaaatttaaatcaaccaactaaagaataaacagtataggttaaaaaggatacatgttaacaaaatgatgacacacagcagaataaagaaaatatatgaagaatacacatctgagggcaaaaggctgaggacagttgaaattgatagaatttgtaatgactgaaataaaagcacaagaaagagtagagaagaaacttgaataatattcatagataggaatgaactgtggaaattccaatgccatgataaggcacgatatagaatgattgtatttcttttatccaaaagcttcacgacaggtaaagatagactataatctgaagaacaaatagacctaatttccattataggccccgaaagtgaccaatagtgatacttataatatttaagaaagcaactgggcacttaactttagattataccatttaaatttttttcaacttgggaaaatgtttcaaattccactttgctacctacttgctttattttttaaaaaattagaaaaatgccatgtaaatcactgtagatagtattgcattgcttgtttgaaaaaaaaaaaagttgacagtttgatagtgcattcattcttatgcctccagcactgaatcaaccactataacattcaaaccaagaggaaactttcagcagtcttgatgctgtctcctactctgaagtgtgagtctcttttctacaaagagcacatgcttagggaggaaaacaggatatgaaattacacaaaaatatgtgccccagcattcagaaagaaagcaggtaaaagcttaattctcctccaaaaaaagcagtttctaaatgtggattcattaatgaaaacttacaacctagcagtcagcagaagcatttaggaatggaaggcatacagtacaatgccaactattagaatcagtgttctactaccacacaactattctagcttagctaacagtcttttttgtcacgacttttgtttctttttcctttgtttcctctgttttcaatcgggagagaactgtgtgaagctgagtgttcgtttaagtcagaaacacgttggctagatctaggttcagtgtgggtgagtactgtgtaagcattccacacacctccactaatatgccacgaactctccatatcccaagctttctgataggattcagttgagactacacatagcgcttttacttatgtcacacatgtgatctcaggtctcagcacgtactgacataggtagttaccatcaaacttgctcttctcataaatcctgagaaaaaaaggtaggttggaggtagaaaatggacagaatgtctctgctaacctaaacagaactagtatgtgttgctgctaaaatattccaatagctggcagcaatgatccataacattatatttgtaatataagtatacataaacactacaacagatgatctcagattgtcattgataatgatgatggctaactttttttagtatgttacttgtaccaagcattgctctatgtactatacatctcatttaatcctcatatacaaaaaaaaaaaaatattcttgggtaaagttattttcattttcattttacacaaaaggacattgagatacagaaagaaactgaataaattgattttaacatatttaacttatttaaagttaaaacatgaaattatttactaaccctttgatgtaggaccaatggctgtcactgactcttgatctgctatataaagtttcatgttttccttcttgcttaaactacaccatgatgtatcacctatgatttcctgttttggtttatttaaactcaatgacagcttaaaggtacttggaaagcaaactgaatgagggatccttccagctttttacattttttcacccctacctcaggcaatctttcacagttgtctagcccacacctttttaaactgcaatttgttttagcaactcacctttaaaaagtctttccaaagcaccaacttaaatttcataaaatcaacaactctttatatttttgaactcatattttatcagtttgcataattaaattacaattgcacattcatttggcataaacaaattcaaaaacaaacacaaatgactgtagataagcatggcagcaggtaaacagatgaacagaaacacaccattttttcagagtattctgttggccagaagcaggaataacctaagagggagtctactgtatacctaccatttcctaattataaacaatactatttaataggtatattagctttctggaagaatggatttaccatggaaaaatacaaacaaatttagcagggaggttcacaatgataccaaaattctacactagaaaagtaatacattccttcttatctttctttaattagaaattgtaggagacttcttcactgacaaaaactaagagcacaaaattccaccccaaactcaattcagcataagaagactcctacccaaagcataaacatatatactcacataaaaaataaaaaaaacttttaaaattaataaagaaattaaggttttaagaaagaaactttctccctactagagaaaaccatcacctcttggtggggaaaactgaatttaaagttcaggttcgggcagttactacttatgtgatggagtaaatcaattcacctcactgagctatagtatccttttctgaaaaaaaaaagataataataatggttctctcctcacaaaactgtagtcagaattatataaaataaaatatataaagacactctgcaaactatcaatcatcttatacatataaattgttattactggaaatcctagcttatattttggacagagaatttcagagtcaagggaagtcatttcacaaatgacaaggctgtgattcaaaagcctaaattactttcctacttacagtggcatggatgacggagcagaaatagagaattcttgattaaccaggagaagaatatcataggcatgggtgtgagatcaactggagattcaaggaagctaaagtgcccagaatgaactaatgttgtaatgtagactgtgagcagagataaaattccagaagccaaggagtgttgtacggtaagtcctggcagtgcctttggtgaggagagtaaagaagaaatagaaagattagccaaaaaaaatttcaactataccaaattagtattccatcctgcacagtaaaattttgatgcctttacaaactaaacaaagtagggaatttaagataattcccatgtttatgctgtttctttccactggtcagaataattaaccataggttaggaagttaagaaaacaataggatagacgtcagtgaagttcaagtgctttaattggattcctttgggtacagtttgtttccctttttctctgaccattaatccagcagaggaaagtgatctaacacagcaccatgacatgaagggacggaccctgagagcctgtctctctatgatgactgttcttgtgcatccaggcagcctattgaaactaacaatgcctgctgctgctgccgaagaggatcatccaaactctgaaaatgaaacacatcacacaaagggatgaaagaattcttattccacagggtttagcttgcagctggtcatgcatgccagagggatgtgccacgaggatgacaaagaagcttccaaagagaatggaaggggcagccagccggacattttgaaatacttagaaaactattcttttgaaactaaggcaataaactagacttctttatggcagaacttgagaaatatcagggtttatttcttttatctctgcaattcacccacatttaaacattcttgcgagtaaaagaaatttgaataatttctaattggttatacagttttgagggtttcccattcataagagaccatattatataattgattattttttcctccgagttgaagctctatatcaccccagagtttaaaactgtatggaagaataggtattgggcttttctgtaactgatgtagatacaatgaataataaatatgcttgttataccaagtagcatgctggttaagatcacagactttgaggtctcagtgatgtaactgacggaatactcattgcatggcatcaggtctcatgggttctaaggatctcgaatagctgtgtcaggtaagagtttgcccacaggaagtgctccaaatagaattaagagtcataagaacctgccatacagctgccattgctcttggcccctcagttggtcacagcaacgcataatccaactcttaagctgccttggatatccatgtttaaagagggtcaaaagcagcacctaaagttttgaaagacaatgctgcactggggcatcggccttttctgattaagttcactcattcatagcaatctaaaaagaacactggctctccctctctggcccttctccactactgttccaaaaagctcaccttcctctgtttacaggataaacgtgaaaggctcttttcattgcccttaacagtacacacaatagacttggcaatcatttctaccaattacatcaatgactcatatgaactctgcataaccagatgcgtgactttgtggaagttatttaatctcatttagccttagattcctcattggtcaaatgaaaataatatctgtcttatgagattgttgtgaagaataataagataatatttacctcacagtttagttataagcacaaggggtgattcaataaatgtcagtcattatcagtgtcattttctataacaggagtaacaaatagttcatgtaagaaactgaaatgagaactggaacacagtatcaaaaatattcccctatcctgtcaggatgctgtcattgattcaaacattctgtcatttatttcaggttagaacacagtttaagaaaagcattgcttcctcaaaagattatgtcaaagtgaaaataactaattgggagaaatatttcttttccatgtattcaacttgtttgttctaaataatctacttcaaactactgtaaataagttcttgttaaaagtgttttaacttttcaaatggctactaatatacgatgttttacagataaatctttggcattggagggtttccctaattgttctgatatttcttattcccgactcctaccatccacttgctcagaagctcttccaacctctctcaaaaagagaaaataatttgaatgaaaactcatactacaaaagcaacgttaaaatatatttgagaaaaaatgactctcaccctaggtcatgctacaagtgctgtaccattcaatggcacaaaattaacttttagctctaagttcattaccaaagaattctaaagactaaagaaagcatagggaaattaaaaatatttataactataaacaaagataagagattataatgagaaaaaattgtatataaggagatatttataatataattaaaaattaaccgtatacaataaaatttaactcaaaataaacctttccctaagaattataaaatattttaaattcaaacttaattctagtaaactaaataaatccctaccattaattactactttgcattatgaaactttgctcccaaaattttatgctaaaatcttccacataagttctgaagaccaaaaaaatccctactatttcattctaaaacaattggtccataattagtgaaaatctaagtcatttttctcacctttcctttcagcaatgcccatccaatcaatcactagatcctgtcaattctttatttccactattatagcctagaatcctaaataatctaattattttcagcctcttacctctttcatccatatttatgcttcaagaattaccttctattaaaaagaaaggctcaaagaatttccctcacctcctcaaaaaccttagattgtttacagaataaaatgtatctctaagcatagcattcagtctttcacagtgtggcacagaactacaattaacagtaattaaataaatgtaaaaggtattcattaactgcctgataggttccagactccaaacttgatagtgggttggtagtggtgacaaagatgagctcaacacagtacctgttctcaaagaagccagtttagtaaggaagcaggtaagtaaactaaaacttgtactgccatttagttagtacaaaaaaggtaactaactacactgtgctactagaattagacagtaagtcccaactcattgaaaagtaaaatagaaatatgttggttttctgcttctgaaaatgatgaagtaacagaaatagcatacacctcctgccttaaacaactaaaaatctaaacaaaatatataaaatatttgcttgcagacattgcacaacaggcacagcacagcaattgctgagaaaaggaaattaacaaggttattcctgctattgctgtagtatgctgtcttgagagagttatcagaccatgactcagggaggtagaatcctaacagagattgttttatctagggtcacactaatagtgaggagtggagctgggcctctgataggaacctttctgactgcaaagtccccagaagttttaatttttactcacctctacctttttattttttcttttacactatagaaatcatacttcaaaatttaaatactaatgcattcagtgaatctccccgatcccaactgttcccagtcacagtaaagatattaccatcctctaaatactgtattactttgtgtttacggttatataacattaactttcctgctatatttaataataattttaatgtgaattaacatttattgaagccttactacattattttatgttagtaagaacacttaaaatgagatctaccctcttagcaaatcttaatagtacaatatttttaagtgtgcagtattgttgactacaggtacaatgctatacagaagatctctagaacttattcatctgcttaactgaaactttatgtccattaattagtaacttcccattttccctttccttcagcccttggcaaccaccatcattctattccttgattctatgaatttaattattttagatacttcatataagtggaatcatgtagtatctgtctttctatgactggctcatttcaattagcacagtgtcctcaagttttagccatgttgtctcattgcagtatttcctcttttttaaagactgaataatattccactgtgtatatataccattttccttatccattcatccatagaaggacatttaggttgtttccacatcttggtcattgctaatctttttgagatcccgatttcaattcctttagataaacaacaaagtaccaacagaagtaaagtacatcaacatgataagcacatatatgaaaaggctacatatcagttttcaatggaaaaaactgaaagctattcctctaaaatcagcaacacagcaaggatgttcactctcggcacttctattctacatagtactggaagtcttacccagggcaattaggaaagaaaaagaaacaaaagccattcaaattgtaaaggaaaaagtaaaattgtctagttggtagagtctatgcttttatatacagaaaatcctaaagactccattaaaaaactgttagaattaataaatgaattcaatagagttgtaggacacaaaatcaacagacaaaatcagctgcatttctatatattaacaaggaaccatctgaaaaaaaattggaaaaacattcccatctaaaatagcaccaagaagtataaaataggaagacaattaaggagattaaagattatatactgaaaactacaaaacattgatgaaagaaattcaagatggaagatatcctgtgttcatggattggaagactttaatattgttaaaatgtccatacccaaagtgatctatagagtcaattctacatttctgtaattcacatggaaccacaaataccatgaatagccaaatcgatcttgagaaagaaaaacaaagattgaggcatcacattttattgcttcaaaatatattacaaaacaaaaataatcaaaacaatatggttctggcataaagatagatatatagacaaatgaaacaaaatatagagccaagaaataaatctacacataaatggtcaactaattttttacaagggtgtcaagaatacacaatgagaaaaggatagtctcgtcaacaaatggttctgggaaaaacagcaaaataataaaattggacctttatcttacaacatacacaaaaataaactcaacatcgattaaagacttaaatgtaagacctgaaactaaaacttttagaataaaacatacaggaaaagcttcataacattcatcatagtaataatttcatggctgtaacatcaaaagtacaggcaacaaaaataaaaataaacaggtaagactatacatcttgactgcacagcaaacaacatagtgaaaaggcaacctatggaatagaagaaaatatctacaaaccttatatctcagtgattcccaacctttctggcaccaggaactggttttgtggaagacaatttatccaaggacaggaggatggttttgggatgaaactgttccctctcagatcctcaagcattagttagagccttataagaagtccacaatctagatcccttgcatgcacagttcgcaatagggttcacactcccatgagaatctcatgccactgctgatctgactggatgcagagctcaggcggtaatgctcactggccggacactcacctcctgctgggcagtccagttcctaacaggccagggaccattactggtctgcagcctggggcgtggcgagcaggggtgaattccctgatatatctgataaggggttaatatccaaaatacatgaagaactcctataatttaagagcaaaaagaaaaaaaaaactaataatccaacttttaataatgcactaaggaatttgctaaggtctgaatattacccctcccccaaattcatacgttgaaacttaattgcaatgtgatagtattaagaagcagggcttttaggaggtgattaaatcatgaaggcagatcactcatgaatgggactagtaattttaaaaagagatgatgagctgtttgcccttccacaatgtgtgggcacagaggccaccatctatgaagaagaggcccttaccagatacaaaaactgccagtgccttgaccttggactttccagcctccagaactacgagtaataaatttctgttgttcataaattaccctgtatttccttagagcagcccagactaagagacacttgaataaagatttatttaaagtagacatacaaatggccaagagatatatttaaaaatatttaacatcacttatcatcatcagagtaattcaaattacaaccacaatgaggaattgcctcacacctgtcagggctgttattaataaaacaaaagacaagtgttgatgaggatgtagagaaatttgaatccttgtacactgttggtaggaatgcaaaatggtgaagcactatggaagatagtctgaagtttcctcaaaaaattaaaaatagaactgttatacaattcagaattctcacttttaggtatttatcaaaagaaactaaaattagtatcttgaaaagagcttaccacggtatttctctaaatgatgcacttgtaccaaatcatttaatcctcaggacaacccaataggtactacttttagcctcaatttgtagataaggaaactgaaacccaggctaaataacttgcctgaagtgaaataactagtgagtttcagagcaggaattcaaaacagaaaatctggctccaaagtccatgcacataacctcattgcttccctatctgaatcacctaatagacttcttaaatatagagacaattcatataactaatcttgttatttgtatatctcacactatctagaacaacgtgttattgctaatagatattctatgttgtttttgatatgaatgaatgaataaaagagcaatatgaagctatggaggaataatcacactgagtgctaagccagaactctggtaaaccataaactatatataaagtgtgcctaaaattctttatgagaaattattcttcatcctcacaactcctcagaaattttatccacaagtaactaaagttttcacatgtttcactcataggatcttcactcttagctaacttcaatattggaaaattacagacgattattttatgtctattcttaatgaccattatggcacatatttcatacattttagtctaagtatagaacaacattatcagtaagaatatgtgtgtgtgtgtgtgtgtatatatatatatatatatatatatatgaagagtgagagagagagtggggtagatgatatgggggttgaggtagttgggaatgaagaaaccagcaatggtaataacaagataatagaaatgaaaacaactaacattttctcaaacacctatcaagagctcggcaccttattaggtcttttatgttaatcatctcacctggtcctcacaacaaccatgaggtaaaaaaaagttgaaccctgaaattttgatattccttttctttaacaatagattgtatcaagtgaattaaaagaatgtaaagtgaataaccattttattagagttgaagcttaaaagttattggactgctataatacatgaactacatttttttcaattagcgttttcaccaactttataaaaaaagttatataaagggctgacaatcactattattctgtttatactgataccatcatgagttcacatatgtttaatatttattccacataaacttatttacaagttagtacactgttcactaagaaaatatggtaaagttgtcagattcttgaggtagggcacaataacaagtgctagaatcaacacactgtatgaattgccttgaataatcactctagatgttcaagaagtttccacttactctccagggctaatgagtattacatgcaataatcataattaaaacagaagtaatggaaatatgtgcgcatagctacaaaatatcataatctcagaattaatcttcagttcctcaagtctttcttatttatttatttatttatttatttagagacagagtctccctctgtcacccaggctggagtgcagtggtgcaatctcagctcactgcatcctccgcctcctgggttcaagcgattctcctgcctcagcctcctgagtagctggaattgcagttgcctgccaccacacccaggtaatttttgtattattggtagagatggggtttcaccatgttgtccagtccaggctggtctcgaactcctgacctcaagtgatccacccaccttggcctcccaaagtgcagggattacaagtgtgagccactgcgccctgcccctagagtcttaaatcacaaatgtttatcaagaagtttaagttctgttcattaatttaattcactccattcttcgtaaaaaccctgatatgctaaaccttcaataattcaattgcatattatccatactttaaaaataattgctcaagtgacatattgcattacattacattacattattaatggatactagaaatagagtgcctacaatgtgctggggaaaatattaggtgtttacgatatgatcttatttattctccatcattctagtttggctttcttatctgcattttacagatgaggaaaatagctcagtgttacaaactgaatgttcatgcccaaatttatatgttgaaactatacccccaatgtaatgccactagcagatggggcttttgagaggtaactgggattagataaagtcatgaggtttatgggattagtactcttataaaagagacccccaagagctagcttgatctctttctaccagaaacacaatgaagagttagcagtctgcagcccagaagaaggtcttcaccagaactcaaccgtgctggcactctgatcttggacttccagcctccagaactgtgaggttacagcagcccaaattgactaagacactcagaataagctgtccatggtcttacaaagatcaaacattgtactagaaggggaactcaaatccaccttgggctaccacaaacaataagaaaattttgcaaaataggagactataaagttaacatacaaaaatcaacagccttcctacacagaaacaaatgccagctagaaaatatagaagaaaagagcctgtttagtatagtaaggctgtaagaaagtaagcaagtaaataaataagtggatgcaataccaaaaggcagacttaataataaatgtttaaacctaaagccaaaaggaaaattagaacatttcagcaagatacaacagttactgagcaaatggaaataaaaaacagattcttggataaaaagattcaccctcataagaacattaattgttgtgatgttaattcataaattccttataatttcaatagaaatgccatcagggattttctttttcctcaagatctgctagttgattataaagttcacttggaataacaagtatgcaagaaaagccagaaaacactgaaaaagagtaatggtagaagcagggagggaagctaacatttcagatataaaaacaagttataaagcttctataattaaaataatgtgataatatcacatgcatagacaggtcaatggcacagaatagaagaatatagaaatacatctgactgtatagaaaaacttactataggatatcatgcaagtactagaagaaacattgatgaattcccttacaaactggcactgggaaaactgtttctaattatgcttcaatgtgataatatccaagaaagtcaactaaacaactgggtattaaaggcaaatacctctttttatcaaataatcatcattctctggattctatgtaaagcaatatctaaaacaaccctgggaatcacataaatctcaaaattgttgagtagaacaaactttaacagtttctcttccttcatcatcatttttaaaccccagcagaaagatcacagtaatataaccaaaacctaaaagagcctaaaacacacatctgtagggtttggttggaaataaactacactatcctatatccagttcatatctaagacttttccttgcatttcagtacgatgctgcttactttttaagaaggattacaatccttgaatatctcaatccacaatttatatttaaaaatgcataagtaatttctatgtgctagagggcaagggcccttaatagatatttagatttatactataattaaaaaataataataatgcaaatgtatgtcaaagctctgtaaacaatattttcagaaaatttgttgtggagaaggacccctggtgtccagctggatttaagccagtctataatatagctgttgactgcattgccttcaaatctattatcagacagatctttacttaccttgaaatgtttgacttcaccataaaatatatcaagcttctaaaatttgtaaagattatatttatgaataaaaatattggtagtgctacatttccaaataaacattttgagaagcatgatatagattctttagacacggaatacaccatcactgactggcaggaatgtatctcagacacaatagttacagtgtctgattggtgtctctggaacgtatagatagcatctacatttataaaaataaatactatattcacaagtggcttctggaaaagcttcttttaaaaaaacaacattaaaatggcacattggcaaaagacatcacagccttgctgtatactaacactgccttgcaaatgaaaaacctgcactattccttatgatcagggtttcacccatttatttggttaatcattcaaatggctaaacagacctctaatttgaaaataaaaaccaattgatgcaatcacaaacaagttctaaaattgcggtttataaaaattgaaatcttgttctaagccaaaacacacacacagttaccttttcctaatcagagcattcatttctcctcattatgatctcacaagcacattaaaatcttattaacattaattacttctgagcgcctatgcatgagcagtgacagtcgtgagtgtgcgcgtgtctggatcatatctacatttatataccttgctgcactttgcttataaaacatgtgaaaatatttctgctaacaccaattagctaatttcacacacacacagatagtaaactgctgtctcactgcacagcctatcagaaaccagtaaacatatggacaaacggacgggaaagaaagcagaaacacctcttgaatgtgaaaactaaaatgccttatacttgagcctgaatacttaaggtgaaaacaagttgggaggacaaaataacaaaaatagaaaacaatttaaaatgataaaaccaagcatactattttctacacagatggtttcagtgataaaatgatagagacaaagaaaaactggcaagcaaaaagcagcaaacacaggagaaatatacagaaatgaaaatgtccttccttacatgtgtgtacatgcacacacatgcacaaacacacacatatctgctcctcttaaatatactcatattgtaatttgaataaaaacaatataaactttactctgaccataaggtaatagcacactacatttcaaagtcaaacaggtctatcctcacaagcaaataaatattcctgctcaaaccaaatgctttatggattctacttatactaagaacattatatacaggagccattaatacctacaatggaaactcaaggtaaatgcaaaaaccaaggcaattatagccacaaagctacatataactcttatctctttgcttcacaatctccttctctcagcatacaactattttatcattcatacatatactccatcaatttgtattcttctttgcctcatcatatgtccttcattaggaatattattaaagaataaccattgatcatcgcatccacattttctttttcaatccatgtgcccatcttctcctcacagcctagagtttataaatccaaagtcttattagataccactatatctatatagtctttctgccatctttaatttccttgttgccatcaaactatactgtttcacaaagaaaataccaaaaaagtctgtattccataatgaaattttcagtgatgaaaacacttaccctcattggattacaatacctatgtttgtaaacaaaggtgaataataaaacttaaacctaagagtattatactttttatagaaagttattttagaacatttgactacaaaataaatatagaaagaatatattcagccattcagcacaattcatgttaagttgatttaagcagttaagctataattatagctcatgctataattccaattttctacctattgtccagcaggctcattggcctatagcataggggtcaatgacccatagcaatataggtgtgcatgatagagatgggctacataacaaattcctaagtgctctctctgtagagtaggatatatattggagaagaaatggtagggagcagagagagggtttctaaatatttttgaaatagcattaaaatatatgacattggtattaatataaaatgtaaatggtaaccaagaatatactgtattttgttttaatttagtattattcaacatgctcataactgaacaaagtttagtggatattgtctgtgaaaactaaaacttgctaatataagcactattagctaataaagtgttaaaagtttttttaataaaggatagtaaaataatgttagatgcaataaaatggtatttaaagatgagcaagagttatttcaagtaatttccagtttaccataacaatttacaaattaaaattatcatccttacgatgtttacatagactttgtataggtaagtagcaactgtcacagtaatatttactacttgtaaatattctgacttaaccaggcttaccatactgcatgaagagtgccaaaaaaaaaaaaaaaaagactagagaactaagaaaataaaaagttgaaaacctaacagaattagtggttgcctgtctcataacacaatagcactctatgcttaaaaaaaatactgatttttaattagtaaacactgaaatatttgtttataggccatttatagcccactaaacaaaatctgtgaaccaaaaattaaagtattaacaacaattgccaaatgaaggtcaatctgtttttttaatatctaaattaacagatcagtggaaaaatatgagatttgtttttttaaaagattaatttatattaacatcttcaagaatactttgcattaagatagatccctaatgatcagaaaattatggaaaatcaggagtgaacaaagaaataatcttgagtaaatataaaaagtatcatcatgttaatcagttagctatgctgcagaaagcgtcccaagaatccactgacatatgaccaagaccgaactagcaaaaagtgcacaaatatgttgagacttagaacccaccttctctttcataaatgccccatcacaaactgcaaagattaggtggccaaatttcaacatcaaagattcacttggcattctgaaccagatctaagaatcatggtctttattttccagtaaaagctaataagctgagacttacttaacgctttcctgttttgttttgttgttgttgttgttgttgttttgagcttctcaaggaatactgaaattggagactacatgtgaaaacgatagttcatcttttccaaaaaaagatattcatccagattgccctccaatcggtgaaatctgagatgtctaaaaagtcttctttgtgaaagccttacaaatatatccaaagatgttgagtcccatatggctctgataaatgaaacccgttattgtgaatttcaagctcttccttaaatcaaaacactattgggtgaatttggtgctcatgaaataaagcactaattgcgtggcctaacaacactgaatcctctgcctagcagacattttaagttgtgccaaattggttttgggatgtgaacaaatatcctggagccagactctctcacatgcacacactactccctggaagtaagttggacactcttggaaactgcattaactctttcaggccaccagggaacctaactctcactaaaggaaaggcctcttttaagataaaaacaagtcatttcatctaaagttaaacctaagaaagaggtaaaagagcaaaaactaatttgtggctaaacactaaaatgtccatagacataaaatagtccttaaaccccagtggatgctttttcaaatgtatccagaaaatcttatttgggcataatttccaagacattaataagagttgtgtgcattcaggaaaagagaattcattttaagcttaatatgccacatttgcctcaggccgagtgataagaaacttttgtttctttggtaatcactctcaagcttattatatcaggaaatttcttgagtttctatttcaccacatgaaatatgatttccacactagaaatttttttatggtctttttgttctggttcagaaagatgcctacaaacatgaagctgagtatttaaatggcaattaatgtaatcccatctcccttgcactcaaatttaggagttcataaaaacaatttttaaaagcacctaaatataagaaaaatgtacaaaaacgggcgttgtatttctttctctattttttagtcttaatttcttcagcagtaatttcttagaaataagttgtttactttggtagggcattttaattaagcattttatttgcagtatgatgaaagcacagcatttctttccccttttatctcactaataaataccctggattatatttgtccccgggattacctaaactaactacaattttatgcttttaggtcactgtcattttgttgctgtcattcatctttcaccttaaaggcttatgaagatatagataaagtaaaaactacttttttggaggtggaaatagctaaatgcttgtgaaaatggtatttttcagtcatttctagtttaagccttctatatttcttagagaaccgtatttattttgtgtcaattggtgtgaatttaagagtattactagaaccctatgttccacctccaacaaagctttatattctaacaattagcctgcatgtgctgctgctattgactcttaataatatataaaaaaaacaacagccttgtcagccaaccctacaaggaaactagctgctatttgcaagtagacaggacacagttgtaaatcaaatgtgtgtagctgcttcgggcttctattggttcaaactgcaattcttagaatggaatacaggctatgggtgtgtttatatgaaggtcctctacctgattttctctggggttttggatctctgaataattcatatatttccaaatcaaaatttagaggatctgtagtgcactagtctgtgtttgtactatgtctgatgtgatggcatcacttctaagttctgttgcatattcagttagtcagctctggtaaccgagtaaaactcacactctagtagaaattgtttggtatctagaaccttactaaggacactaaggggtaaatggtaatattcaacagataccacattaaaaagttttcactaatttttaagtcaaatatttatcatatcagtgagaagttgatccaaaacatattcacaacttagggtgatactagggccaaatagcaactttcccctggggttcaagcacagaggctaactgggacagttataaactttatggaagtctaaaattctgattcgtatttctaccatggtcctcctttccaacttaaatccatctaatgatatcaatttaggaggaaaaggtatcaaaatttagcttatgttcatttcaaatacctcagattaactgtaattaggaggtaaaaataaaaatggcctgtctttaaataggtgtccattacatttttcacgtttagaactctgccatgagctcagaactatttattcaatgacatttcctttttccagttatatcttcattacttacatgatccaaataaaatagagaaaaaaaggcttcacgtggtggacactgtccttacagctcagctaattctaatggttttaaaagtctaaatatatttaataactagcctctacacctgagattatcagcagaatacttttttagatgttaaaagacagtagccaaagaaaagaaggaaagaaaacgtgagtagggatattaggagagcatctttatcagcaaaaaagctggattgtccaatttcctcactggagcaatgaataacctagttcccagtaccaaccccaacactgaaaactgctgtgtaactgtaggcaagttatttaacttcaactggctcctacttcttaatctgtgatgcaagggtaatatagtttcaggcaccaactgcttcctgcatccctatactggctaggatcttttaaaaattatttcctggacaaaacctcacccacatgccatcagttattttccctcctttttcctgcctcctttgcctctgcagggaaataaaattagcagtcaaagttaaacatgcccagtgggcaagacagactttggtttaaggaaagggatggagtaagttgtgttaaagtgcttatttggccccaaatggttcattgttgggataccacctcccacaactagctccactggaatttttctcaggaaaatggagaactgttttaagatagacatgccctgtaagctggtctcaaatcaaaataaatttaggatattcaaaaaatgccctacaggatttttcctgtggagcctaaataaatcactgaccaaattttccaattcatgctctgctgctaaaggggacgttctacaaaatcatgttttaatttctacatctgaaaaaggagtataggtaaagttcttcactttgggttttcattcttctctcttctctgacagtattctaaaagaatgccatttgagaaaagaccactcttagagaagaaaattgaaatataaccccaaatttccaataaacttgtaagtctgctaaagacaagaccataaccctggttagagattttgtgggtcttcctttaaaaaaaatgaaccttttaatacatagagaggtgttaagaatatcccaaaagtgtacacatatctaaatttacaaaatcatgattattttcacaactaaaggatatattttagagctcttttaaattgtgactgcccttactgcattttactgcatatcaataatttgcatattattaaatatttaaaaaatataaaaattacatttttagctatccatacaggataagtgagaaattgtacaagtttgcatacatgtgctgtcattttatactatgaggcattgtttttttcagacaagaacatcaggaatgctcaagagtcagtttttagatgttatgaagcactgaggcattgatgctgttaacactttcattgaaatttaaatgcaaaccaaatattttaagaccaataacaatggatatgccatgaaattgttgtgtttcacagcgtgtcataataggtaaaattggaattttccttcaaataatctgtcccatccaagagttttaactctcaaatataaatataaacaaaagattattcacttcaactgatttccctagaggattatgcattatcaattccaaactttacaagatttaagaaattactggactgattaagtgtggcaaactggtttgttccctacaaaggaaacaaacttaaatcccacaaagtttaattagcatttagtggctcaacaaatggaggaacagcctgattctgaataactgcaaagcagagtcagaaattgtatatactactggttaactttgctgtgaaaattagagtgaaccagaattcaatcccagttctgccacttactagatctgcaatcttcggtaaaccacttaaccattctaaatctttctttcctcatctttaaatagggttaagaaatacttcatagcaaaggcatggtggttaagagatcccataggcgaagttccttaacaattcattaactataattatcactacaatttagaccccttctgaccattgagaacccatgaattctacatccagctaaaaaccattttgcaatagaaaaattttttcaaaactcaatttacatggtctaagcaacaattatgatagcatgtcaggggctaatgtggtgccaaaagttagacattatcatttaacacaatgggaacctggtaaagatttactgaatgaggaaaaaatataataggatgtaatagaaagaacagagactaaatcttggctttgactcttagcagctgtgtgaatttggcaattttttctgtaagcttcagttttttcatctaaaacataggcagaaaaccagtgtatgcaacaaagttgttgtatgcaaagattaaattaaacagtttgtgtgaaaggtgcttagcaatatctcgcttccttaattttagcattataggacaagagttctaatcggttttcaagcctaaacttttcttatatagcagtatcaactctggcctcctacataaagtaagattatgtttagttaaggaataatgtgagagatgaggataaattcaggtgtgacagtaaatatattttaacaatataccctagaaacaagagtaatgattctcaaaccttgcaatattactaggatctttggtgtagtttttgcaaaatatggaagcccaaataccagtctagagactccaattttagatatgtgggagtagaacctaggaatctgtgtattttaaaagcccttggctgattccgacatataataatcaactaaagtcgagttttctgaagtatgtgggccagctacaactcaggatgcctgagttccattccatacccattaataatggagctcagaaatttgaattttaacaaaaatccgaagaatatcttatgtaaactaaagtttgagaaccactggactagaatatagtaagataatattgaaaagaatttttttcatatttggttatttaaacttttttccctctatttttaaataaacattactgtcaaaatttatgaatgatgggtaaaaattttatctaaagaaaatattagttttagggtaagtattatcattattattacaggtttcaaaatcaaaatgggaaatagagataacattttaagtcatctacagagggtccaccagcacagaaaagtatatcacctaggaaacaccatgcgtttcactgtttcttaaatttgtgtgttttgctttgacttagttttttattatccattccttctttaattagagcagtaatgccaataaataatatttgtatactactttactatttataaaaaaacttcatatatattaacttaattaatccttacaataaccttgtgaggtagataggaaaggtaatatatattatcacatttctgccaataagaaaactcttaaaaagtttgtgcaatttgcccagtcataagtttgctggtatttatggtaatacgtggactgaaacctctagatgtaaatttcatgcaaaactgtgtgaaatttaaaacttaggattcatttttaagtgctatgaatcaaactcaaaatagcatgagagtctctgaactgcaagtagtccatagtcctctaccaacctgtgggttcatcttactatataagttcattgtactttatttattatatggttaaagaatagaaggagagtggagctcaattaaccaaaaacaaatgaacaaaaaagtgaaaaacaaataaaaaaatggaatattcatccattataatactatttactctgcctacttgcaattcattcccctataagcccctttgcctcagtttcctcttctaaaacatgaaatatcaaatagcactttcaaaggctagcaatttcattttcaactatgatggtactttaaaaagtacaactaaatatacagctagaataatactaacatttgcccaatccctacaaaaatcctgtcaaatcaactagtccagtccactcattttatacataggaagtagacctaaaaaaacttaagtatgttaccccaaataatagcaaatttgttgtaaagctagaattaaaaattatctttacatcaaagtcaattacaatacacacttgtgaataggcaatgccttgttttcataatcaaaaagagaaaatggtcattttaagataaaaggaagaaggtaatttataaagggatgtttaggcaggaagtggtatcagaagctgtttttccaaagtaaaaaggctccaaacttatttacaacaaagaaatgtgtattttatatatatatatataacacacacatatatataatacatacatatatatatatatatacacgagaatgttataaaccagctagacataatcatttgtttagacctcaaatatttgcatagctctgtgctgaatgccaatagaaggttctggaggatgaataagacacagacactatcctcaagaagctcaaggtttagttggaagatgtgcttacaaacaatggcaatacaatgtgagaggtgatattgccaagttatgcatataaaattgctgtgggaatgtgaaagaaggagcacctcaatgcctgaaatgaccgagcttaagtgagtatctctgacaatccctgtcttctccatttccaattctaaattaaatacttccctgtttatgcctagaattgttaaagaattttttatataccctgataggagaaaagtagtaaagtgcacacatcctaactttttcttgggtaataagaaatttcaaagactaaaacatattatagaattttggtacagctactacgaaatcagggcctgaaacaatttgccaattttttgcaaatgtcctgtttttttgttgttgtttgtttttttcactaactcatgcatcagttacttgcacagcaacagggacacaaggtggcactgtcgtgctgacattcatttcagggtcctttctaaatggacaaatttgtaagagacagaatagaccctattgtgacaactaacaccacagttgtaatactggccgactgggtctaccaacattaacactggcctaaagaggagtattttgcatttcatgaatattatatcatgcctatatagaaataggacatattctctgatgacttctccaaaatgtcatgtgtgtattcatagaaatgtccaaaggcatagagtgcagctttgccattaggaagtcagaagtgaactgcttgctattggcaaggcagtggacacggatcgcctctccatctagtggccagtggagaggagtggagccatagtaaccatgctgcacttcattccattaaaaacagcccttttaccaaatcacccataggcaattaagtcagtttgtctgacaaatgactatttttggtttatggcattcgttcaatcattaaacagactcaataatacattatgatatgtagttaagctaagaaaaatcatcacaaaattaaagtgcctgtgctctctcaagccacataaatgtccgttattcttcctttattacccaccctaacttttctccatttatttgtgacttttagatagaaaatgcaagcaagattatctacatatatagctacttaaaatcacagtctttaagatgaaaaaatattttaaaaagctttctcctcattttacaggaaggaaactgagggacagagagatcatgatgtactcaaagtcacaaagtcagaacaaaaaaccagacctccagatttaaccactttaaatcctttttgatattgattaatacctcctgattccccaggaaatgctttttgtatcacaccataaagtttctttcaacataccagaaaaataatttctaaaaatgttttttattcatatattttcagactaaggtgatataagtgaaactactgtgtataggccgtaccacatcttcatatccataggtatattttgaatgtgttataagaacacaattatttttatattaaggaattacattcatccaacatttagaaagcgaaaaagcaagtggggtagggaataggtggatgtgttggtcaaaattactatacaaaaaatggtttcagaaagccattatgtgaaacaacctgaattcattcagactgctagaaaagttctttttgttttgtttcatacaaattatttgactttgtttttaaaaaggaaacacacgcacacttatccagctaatcacttcatctattttaattcagcatgtgatgctgtttgggggcatgttttgggaatgtgttgttggtaaagcttcttatcaaaacaaatgaaatctgtccaccaactataaaaatctgctcacaactccgaacccaagaattaaagggcaaaaggtatgaaggaaacctggcagtggatgttctagaaatgtgagatgttttgactttttcttctatgatcttctttggtggtaccactggaatctgtcttggagtgcagagggaatttatatagatctgctttagagagatgcaaaaactaatgctgtacagataagtcaaatgctttttaacgggagttagggaagaagtctttttatttcattatacttctaagtttagaagcttcaaaagcaccaacccctcagctaccctcagctttacccctgtaccctcagctttatcccttcacattatctcaacttctctctacttgtttcttaatcatctctagtcgtctcccttctagaaatgaggtgaggggataaagatcactgttgatttggagaactagagaaagtaagggctaatataaaaagtaagttatttttgccttacctaaagctaaggtaataggtacaagtaaccaagaagtggagaaattagtaaatatggtcagaaccagagtatatttattgggccaagaagaattttaatgtgtccagtatttaagaagaaaaaaaaacaaaaaatttataaagtcaccattacaaagtatttgcctagtctatttaaataataaaagagaggaacattttctcactgtttaaatgtcttggtgcctaaataagatatttttgtttatttaaaatgaagccacatagttttcacatacacatatatatcaactagaaaaattacatagcctggaacatttctagttttctgctagtaatagcttttttttttttttaactaagttttaagttgctacctgaacaaactgacaacattaattttctctcaattacattccatttacaggaaagaagttcatactataaaaggaattgcaacaacaaatcacaatttaattacaacagtaattcacagaaaatttttgaaaaggtaaaaatggcaaatatctaagctaattcagtaaaaaacaaaaatgtaaagccttctaaaaattagagaaaattaaaatttaaataattttaaatgtttcattttaaaaagtttaaattaagaattttcccaataacaaaaatagtactactatgtataagattcgtaattattaccatttctacatttttagttacaaccaattgggcatctatctttttgatatcccataaccccaacctcataccataattttatatttgttgaatgtaaatccttacattagtaatgtaatataaaaactttcaaatagattgaccttttaaatgcataatatgaacattaaattcatcatatctcaagacacagaagtattcagtgacaaaattacttccaatatcaagaaggtaaacatattatgctgtaattaccacattttctatcagagtttcaaaggtaagactgaatattcagaattaataaaaaatatgttcttcttccctctggaaactagatgaatcaatgaactcatagtccttgttccttgtctcagtattctcacttgaaagtcagtagccagctttccccaagttaagacaattacaaaggttgcattggttaactgaactacaaaacaccaaggctagagtttcagctgagtgtcaaaagattccagaaaggcaagctccatgtcctcaagctgattactttcaaatgaactatagaattaccaaaaggcttgatcctggagtataagagaggttatgaagccaaagtcaagcataatttttccacagtttagtacagaaatagcatgccacttattcattattacagttgaacagctagagtggcaaaaacaaaaaacaaaacaaaaaaaagccctttttcttataagcccttgaatgctgtttctaacaccggctgtagtggttactacatacatgatagtaatcatagatagcatatttcttcccatagcctcatcagcttgcctatgctgaattagaactaggggagctcaaggatattttgatatattaaacataattgtcatcaacattatttgatgattaatgtataatatctatgtaataggaaaacatgaattcaggtattctctagaatatctaagatatgtatattgccttcaggcttttggtaaagaataaaattgatcttgctagtttatttgacattagctatagttcctggagattatgcaaaatgctagaatttatttaagcaatggaaatgtatgaaatgggtttttcaagaaaattacaagtttcaagttttgtaaaatacctacacacctatacatgacttgaaagcttggtgtaaagtatcaaatgtaaatgctgactgtattagcactgtaaataatccatagtaattgtataaaataacaaaaatgtcttacacagtatgaaacaaattattttaaagatttggtttctaatttaatgataactctggcaggtacacacctgtccgattgctagtgtttattgtccttgatggagggtaaactgtttctatgtaggtaatacctgatttctataatgtccctgaaatagttacacagccatgcaaatgaaaatatttagaggttcttttcagtgctttgtgacttctcatggtaacttagatcttcactggttaagaaagtgagggataaggatactattttacttatgttttacagtaaaacatgtctcccaccaaaaatgtagtttgttaaaatatatttataaagtgacctccaagataaaccagctttaatgtccattttcaacatttagacttcagaggccacccttgaggctgaagaacccaggagctagcagcattcaaagaatatcaacaccagtcattcttttgccagaaaagatcactagttagcaatattagccaggtgctgctgcttcaacataccttgccagatgttggggtaacacgtttgctcagggcctgaatttggcttcctatgtggcggcatgaccggccactgcttagagttgggcaagtccatgaacacatccactgataatttctatatttatagaaagccagaacatgtgtagataatcacacaattagatatttatgtagtgccagattttatgaatacgagaatttgttaattagcacaaggactaatcattaaaattcaaaaatagataaataaacaggaatgccatttatttgttaacatttcatggggaaagtatgcagctgctatccttttgatgaatataggcttctggagataaaaatgtgcagaataaaaagtatctgcaatttttgaaaccctaatgagtaaaatccaataaatcactatatagtctttatattaaaaataatcatagtgattctcctcttaagttaaaaaagaagaaaaagtttaaactggcatatgcttagcatttgaattatatggtctggcattccattttatttgattttatttatttatttgttttgagacgtagtctcgctctgtcaccaggctgcagtgcagtggcacgatctcggctcactacaacctccacctcccgggttcaagggattctcctgcctcagcctcccgagtagctgggactacaggcatgcaccaccacgcccaggtagtttttgtattttttttttagtagagatggggtttcaccatgttggccaggatagtctcgatctcccgacctcgtgatctgcccgcctcggcctcccaaagtgccctattttttttaaaaaaaatctactgtttggtccttttcaaagagccaaagctgatttttatcagcacacacacgttaaaaagcacacacacgtcactcagtaccaaattgttttagctacagggcatggcaaagcatgaagtaacttcttagagcacttcctcatgtgggtgtgttaggtaactgtctgctccaacattaaaatgaaacacactgtgacctgaccaagactttggggatctaaacaggcagatatcatgtgctgataggaagagcccactataaccaataaggctgattaatgaatttttctggcattctatagcgctcctgtaacgcaagcctttcagctttccaaatccctatacagcagagtacagtggtttgaagtttatttatgcacattttataatgtccttctgtatttagattgtgacagtccctcccagaaaaggccaagattatttttcatactaaaaatattttagatctactgaaggttaagaattataatgcaaaagaaaacatatacacattctaaaaattaaaccaaacataaaaatggctacattattacttgcttttattcttgctaaaaggttaaaggaaattttcatttttctcttgaaattctctccattttttgtttgcttgtggttaacataaacacacataaagtgaaatttttaaaaatattgtatctgaaaagaagctgtgatgtatttatccatacatgtatgacttcgtgtcatacatgcacatgtatgcacagatatcgccactgtatgtgtgtacagaaaaagagaatgactaatcaagacatagatgaaagatttctattgataaaaacagtagaattttagatggtcctcacaaggctaacacagaaaatgacaggtgcatgagacatgtacacttttgacatacagtatcagttttgaaacaaatttttgggtcaccgtcagaaatggcataaagtatatataaaattgtatatgaaaaacaaaattatcgtgtaccatattaacataaaatactctcctaaagttccccttagaccttacggaaaaaaatctccgacgggacctgattgagcgtacttagtatttgtactactcttggtcaaagccagcctatccagtttaaaaaaactgttcaggcaagataagcaaattgaaagtctcagaattaattttttaaaagaagaggtaaaaaagtctttcagcagcaaaagttcatcaccttcctgaaataatggatttttaataaacattttactaggtttgaaccttgagaatgtgtttgggaatctgctctagtgtcccaggtgggttaagaatattgctttatggacttctttgtgttgtcagagaagcctaatggaattaagggggaaaaaagtctgccacttctgttaaataaataatttattacaaaaagatgactgttattatcaaagatctctacagatcagcatccattttctaacattgctctgtatatgccgaaacatttgtgtatctatgtgacttaaattttatcaaatgaagagcagttttactttgacaaatctgaaataaaattccattaagaagtccatttcaaatggcccttattaaaataatcctttcaattttgaagaacactattctgggaaaactcttcaacaatgtctgctagtttgaaatgtaacttttcccactataaaaaagaaaaaaagaaataaaggaaaagaaagcaccacaaaactgaatttgaaataaaaattatattatttatgctccccaaaatgttaaatgaatacttacagttgttgtgcaagatggcctgatacacttcatagcttccactttgtaaaaagatggccagcccctcactccaccctccccaagcataaataaacagtaacatactaaaaggaaactgtcctaggataaaaactgcttgttaagaaagttcgcattcttactaaccaaagtgatattcctataaatgtaaaagcccatctgcaaaataaaagttagaaaacagaataccttatttgtttaaaaatacatcccccagatgcaatgtttctatgtgtgtgatgacaaaaataattactccattcttacccaccctcagcaactacccctcaccttatgtccaatggcattaaataaacatgctggcaaaaagtattcaacctgcttcaaggatttaaactgtaaatatggactttaaacttcaacataaaacaaagaacaagagtctcactttagtaatacccacactggcactgcagctaaaactcattggcaaataactaacaaaaccgagttagcaataaataaggacaacatgatatatagacagacagatggaattgcataaacagacaagaaaagcaaagagacaaacatacggaagggtctgttttaaaagagtgaaagattctgatttatttggtactttagtgagaaaaatagatttgtttgtaattatttttaaagtaacaaaactgaatcacaagggcacacccctaagtaagtaggaagaaaattagtaaagggtaggcctcctacagatgttctaaattttaagctagcactagctctgtcaaacttaaatctggaaattaaaattcaagcaggaaagaataaaggcattgggggctaaaggagatgacagagggggcattgaggaagcaggatttttttttttttaagaaagttgtctgccctaccttcttccccagcgctgagtttctcttcttataatcggtgtctccctggaagtacagtgtgagtggtaatgactgcctgcctccctaatgagtccattttcctgctcttgatgttgtgtatatacacacactgcaacctaccttacaaaccacagagacgggaagagagagagagagcaagagagaggagggaggggggaagagagggagagagagacagagacagagcaagcgagtaagagagagagaagaggagagagagagagagagaaagaaaaacagaaagaaacagagagaaaggcacagacaaagccctcctaccagacagcagacagctctccttcccctatccagcaaaatgcaactcgtctaatgcagcaacaggttcagtattgccagactaacagagtgaaaaaggtatattctctatatcattattgcttgcaaataaacagtttaagagcagctggctccaccttctttatttatgctccattatgaggaatgtattgtttcagttctggcagtacatgtaattatcataaatacattttttgcatataagcaggaaatagtgaaatgcatagcttatttgtgcaatcttttaaatttatttttaatgtgagaagaatgtgaacaaatcagctctgacaaaagcctagtaatgattttaaagtcagagcagtcttaaaggaggctctgtaagaaacagactccatacaataggaaaactgatctcagacaaaactgataactgcaaagaagaaatcattgctcagttaataaatcgagaccatatacaaaattgcagacttacaaaattacagaccaaaacagaattaagcttaattaagtaactaataggctaggaacctagaagaagggagattggcttctcatttaaagcatctagctgtacaaacatcacaatgcaatgtactctgtgtgaacaggtgcaatgcgtatagtacatagtggtacaacaacagaaataaatcccataagaagctaccatcacaatcaggatgatatttcatagaatatgggactgaaactacagcagttacccttaatcttttattaggagggaaaaataaaaataatcaatgcttctaaataaacttgccttaaaagagaaaaaaaacagtttttctttgtctgatacttctaaccagattttttctatattctagttccaaaattatgatgttattatactcctcaccccatcacatgcttcccacccactttccccactcctaggtgccctttctcctgtaagtgatatatttgcagctatagaattacaaacatcagaaaacagaaatagttttaagccactctcctcgtccccgaatttttaaaaactagactctgcttgacgagtcatatctccttctagcactattatctatctagacacccaccttccttaatatatttctatacagtttggctatgtgtcatttagatgggacttaagaacattataatagaggtaaaattttctaaaaaatatttacacacaaataaaaaatataagtgcatttgacttattcaaaccctgcgtttgggcaacaataatcctaagtatatgaattgtaaaaatcatcctttttatgtggttttgtgtattaacatgcttcaaaaattagaatatgtccctctgcataaacaaaactaccttgaaacaacagcttcaattcttttgtttaaaaaaaatcagttttcaattaaaaattaaataactttcaatatataacttatagatcaaccgattcttcaccttattcacaaaaatctttaagaatgtcaaataaattttgggtcatgtttagaatacagatcaatattgctttagctattttcagggtggctaacctacagcacagacattagaatgtaatatctacctatacattatacaagctatcctgggaaaatttctagtaagaaaccaagagtccagaccactctagtctcatcgtaatccaccaattcaacctctctagtgctgcagtagtatatcaccctcccaagggtggatgattaaaaggagacagacacacactaaaaatgatttaacagtctcctacttcaggtcacttgtctgtagagaaacttttccaaaatatatttagtgtgcccaaggtaccagcatgtatctcctcctcactatttggcctggcagctctgcttttctactattgccctattgtttctccgaagctttattaaaatgtattaagaaaaatgtcaattaaaaaaacacataaaacttagagtttgacagatggatttgaattagatatttgtattttctgaatttttaaaataaggttctaggtattttattttgtttcattttgtttttattcaaggagaagacgtatttggtttctaccagcaggaatcaaaaggaatataaaggaccatgaaggctcttttctaaaaaacaacctgagagctaaatttaaaaggaaaacaaatcttttggcttaagtgaaaaatgagaccgggcacagtggctcacaccgtaatcccagcactttgggaggccgaggcaggcagatcacaaggtcaggagttcgagaccagactggccaacatagggaaaccccctctactaaaaatacaaaaattagctgggggtggtggtgcatgcctctagtcccagctgctcaggaggctgaggcaggagaatcgcttgaacccaggaggtggaggctgcagtgaaccaagatcacaccactgcactctagccttggcaacagagcaagactccatctcaaattaaaaaaaaaaaaggtgaagaagaagaagaagaatgtacaacatctcaaaacttttcccatatctgtacattttactagattcaaagcacaataagtagtacattgttagtacttactggaattcaagatatactttccctagttgggactggagacaataaggtctgaagaaatcattgtaattgactaccatactatggaagttataaagttatttaattaaattgcttcatgtgttgatatgtcatggggcaatttggttctgtagaaagatcctaaagtggaagttaaaaactggttctgtcccaaattgatctatagattcaattcaatcccaatcaaaatcccagaaagttattttgtggatatgaactaaatgattctaaaatttatatggagaggcaaaagactgaaaataaccaacataatattgaaagagaagaacaaagttggacaaatgaaactaccagacttcaggacttactataaagctacagtaatcaagaatgcatgatgctggcaaagaatagacacagcagatcagtgcaacaaaatagacagcccaggagaaggcccacatatgtatagtcaactgatctttgacttaaaaggaaaagcaatacaatggagcaaagacagtatttccaacaagtggtgacggaacgactggacgtctacatgcaaaaaaataaatccagacgcagactttacactcttcacataaattaactcaaaatggatggatcataaacctaaatgtaaaatgcaaaattctaagactcctaaataggaaaaaatctggataattctgggtttcacaatgactattttagatacaacaccaaagacataatccatgaaagaaataattgataagctggatttaattcaaattaaaaagttctactctgcaaaagacactgtaaaggtaatgaaaagacaagccacagactggaagaaaatatttgcaaaagatgcatctcataaaggactgttatctaaaacatgcaaagaattcttaaaactcaacagtaagaaaatattataacctgattaaaaatgggcagaagactttaacagtgacctcaccaaagaagatatacagatggcaaataagcgtatgaaaggggctccatattatatgtcattggggaaatgcacattaaaaataacaatgacataccaccacacatgtaatagaatggcccaaactcacagcactgacaacaccaaatgatgatgcggatgtggagcaacaggaactctcattcattgttggtaggaatgaaaaatggtacagccactttggaagacagtttggcagtttcttacaaaactaaacacatatacaatccagcaattgcagtggttggtatttatgcaaaggaattgaaaacttatgcccacacaaaaacctacacacagatgtttacagtaattttattcataattgccaatatttggaagaaattaatatgcccattagtagatgaatggataaattatggtacatccaggcagtgaaatattatttagtgctaaaacgaaatgagatatcaagccatgaaaagacatgtaggaaacttaaatgcatattactaagcaaaagaagccaatctgaaaagattgccttctatccactgtacgtatctatacactgtatgattccaactatatgacattctgaaaaggcaaaaccatggagacagcaaaaactcattgtttgcaagagtttagggtagagagagggatgaacaggaagaacacaggattttcaaggcagtgaaactactttgtataatacaatagtgacagatagatgtcatacatttgttcagacccacagaaggcacaacaccaagagtgaaccttaatgtaaactatgggcctggagtaataataatatgtcaaagttggcttatcatatgtaacaaatatatgactctggtgggggatattgatgatggggaggctgtgcatgtgtgaaggcagggggtatatgagaaatctctgtacctccccatcgattttactatgaaactaaaattactcaaaaaaaagtctattaaacaataaattaaaagaaaattggttctggtcccagcattgccacaaatagcttgcgtaccctcgtcaagtcatgcaaccatcctgagtttcagtttcttcctatgctaaaaataacaaatttaaaaggacggaattgaacagcgtatcataataatagttattaaagccaatgcttaagtgcttactatgtgtcaagaactgttctaagtactttttatttcttaactctttaaagcctaacaattaccctataatgtaggaattatttttagtctcattttccagatgaagaaaaaagagagattaagtgacttgcctgagatcacatagcataataataatgataggatttgaacccagcctgtctagcttagagtttatgtgtttaatccctacactatactgttttacccaatacctaaagatagttaaggccccatccagccatgactctgtggttgtgagtcaaatctagtaagtcctgatgatttcttaccctatcttgcttactaacacagaatagtgaaaatttgctgtttaatacccatagctctcaatacgttcaatttaatggtacccagcaactccatctaaagtacatactctatcatgcattcttaaaggttgcatagttcaagattcaaatatctaatagtaatgcaaataattgtttaaagaactaaataataaacacaataaaatatttcctattttctatagcctgagaaaggaattaaaaaagcaagaattcaattgtaaaggatttgtgtattttgggggttttgtttgtttgtttgttttttgagacagctccgtcgcccaggctggagtgcagtggtgcaatctcggctcactgcaatcttcgcctccccagttcaagcgattctcctgcctcagcctcctgactagctgggattacaggcgcgtgccaccatgcctgtctaatttttgtatttttagtagagacaggatttcaccatgttggtcaggctggtctcaaattcccgaccttgtgatccgcccacctcagcctcccaaagtgctgggattacaggcgtgagccaccgtgcccagacaagaaaagtctgggattagtgggtcaaaatgagtaattgctacgctaagtaaatgactttgccattgaggacaccaccataaagttaattgtaagtggcgtaattacacaataattctttttttttttttttttttgagacagagtctcactctgtcgcccaggctgtagtgcagtggcccgatcttagctcactgcaagctctgcctcccgggttcacaccactctcctgcctcagcctcccgagtagctgggactacaggtgcccgccaccacgcccagctaattttttgtatttttagcagaaacggggtttcaccatgttagccaggatggtctcgatctcctgaccttgtgttccgcctgcctcagcctcccaaagtaatggaattacaagcatgagccactgtgcccggccaattaggcaataattcttaaccctagtcatctattttaaaattgtatcccatcgggcccaaggacaatagtaggccaggagtaccatccttaaatgggaagagttgcacatctaatttaaattctaatcaacaaatgtttaaatttaaaactaaaataaagtattacatgtaaactaagtcattggaagtacatttattatggccagaggattttatatgcctctctccctacaagactaagagactccctccccaccatcgccaccttcttcccctctgccccccagagcagagaccctacttattaagctttgttggtctagcatctggcagtacacctgtaatatatctgaagctcaaaaaagttttcctgaaagaatgaatgactaaacaaacaacagtacatagggtttataaaccttggttaattaaaaacttaaataaatttgagatataaggatgatataaacaagtaaatagcatttcaaaaaatgtattgtcacatattaaacacatccttatcttaagatcttgtgacaaacaaaaatagaaaaagtaatcttcaactttgctgtatgtttgaaagaatttcacaataaaaagttggataaggctgcatgcagtggctcatgcctgtaatctcagcactttgggaggccaaggtaggagggtcacttgaatctaggagttagagaccagcctggacaatatactgagaccgcatgtctataaaaaaatcagccttgtatgatggcatgcacctgtagtcctagctacttgggaggctgaggtgagaggatttcttgagcccaggaggtcaaagcagcagtgagctatggttgcaccactgcactgcaacctgggtgacagagtgagactgtgtcaaaaaaaaaaaaaaaagtttgttaaaaaaagtattcatatctcacaccagtcagaatggggattattaaaaagtcaagaaacaacagatgctggcgaggctgcaaagaaatatgaacgcttttacaccattggtgggaatgttcaaccattgtggaagacagtgtggcgattcctcaaggatctagaaccagaaatgccatctgaccccacaatcccattactgggtatatacccaaaggaatataaatcattctactataaagatacatgcacaggtatgtttactgtagcactatttacaatagcagacatggaaccaaccaaaatgcccatcaataatagactgggtaaagaaaatgttgtacatatacaccatggaatactatgcagccataaaaaggaatgagatcatgtcctttgcatggacatagatgaatctggaagacataatcctcagcaaactaacacaggaatagaaaacactgcatgttctcactcatatgtgggagctgaacaatgagaacacatggacacagggagaggaacgacacacaccagggcctgtcggcgggtggggggtgagaggagggagagcatcaggacaaatagctaatgcatgtggggcttaaaacctagatgacgggttgatagatgcagcaaaccatgatggcacacgtatacctatgtaacaaatgtagaggttctgtgcatgtatcctggaacttaaaaaaaaaaaaagatattcccatacaactatcagaatttcaataaacatcatttctgaaaagaaaattcagcttgccttcacatttcatttatctattatttctttcaaatctataacataagtgtttgtaaaaggctgaagttggcttcagagtacttcatgggaatggaattgtcctctttgaggaaaacatcttgataagctgctggagtcagagagtgaggcatgaatatttcttgtggggttaaactgtactacataaaaaatgagtaacaatttgaagttaggggagcacagagatgagagggaggaagaagaggagtagtgggaatttcccaatgtaaacgtggccagattttttaaagtaatgcctaataataaattctatgaagtttatgttttgtgatgcaaatattctccttctctccaaactttcaggaaaggataatgtatattctacagtcttatatagtagtagaacgaagaatcaaataatgaaaaaatgaagttattgcctcacattcacccatatactgtagcctttataatcacggcagtttcctaataagacagaaaatattaccggagttcctcggagtgaccagtggtagagtgaacagtggccagtgaatagtaaatagcaaagagtagaaaatcaaaagtatctttaatatagaatgactcatatctatatatgagtcattttccacaattgtaaaggagaaatatgaccatggggaaaagtggcacggagtttagtatctgaatgataagattattatgctattatagctgttgttactactcctataagctgatcttaaatgatatgattatctttagaaatttagaagagggtacttttgtgacacaatcaataaatgctaaatcaatggattacaaaatataaaaatgttatttgtaatatctccctggctccagaacaacgtattagacacatatactatatgaactcttctgctgcctggtcaatcctctctactaaacaatctacaacaatgccagcaactatcttaaaagtttccacatctacataatttacttatatgtacagtttatatttaatacaaaaggaaaggaaagagaaactacagagtgcattctataggaaaaataaaagtcacagagaagatataaaaggtacatcttaattgccatagatgtttgtcaagcaggttggtgagatccttactgtttgacctggtgcggctatactcaaaaactcaatagtcttcatatctttccaaaatacaaaagttgctactattaataagaatgctttattaaaagttatctctactacatgtgtcagaaacagcccaacatacactttctcatttaatcccccaacagcattaaaagaaatctcattttcagattatacataaacaaaaagaggcccaaagacacagacctaataagtagtaaacgtcgggcctaacatctatccaaatagaatgtgtaaggaatagaaggaggggctttataaaattactccaaaaattatctagaataacagactggtgatattaggtagaaaaagaagactaatgatggggaacagatttgaaaggatatatgttccctagataatttcagaacttaaaattttatatttgtttgaggaaaagtatattaagtatctcaaagtaaaatttaaagaaaggataatggaaaagactagtatattaaaaaatagctttcaaaagcgatgaaagaaacataccatgaaccagtttgattaaagagttggaaacattaggcggggcactgtggctcacgcctgtaatcccagcactttgggaggccgaggtgggcagatcacctgaggtcaagagttcgcaaccagcctggccaacatggcgaaactccgtctctactaaaaatacaaaaaaattagctgggcatagtggcacatacctgtaatcccagctactcgggaggctgaggcaagagaatcacttgaacccgggaggcggaggttgcagtgagcagagatcacgccactgcactccagcctgggcgatagggactctgtcttagaaaaaaaaaaaaaaagagttggaaatattaatagcaatctgtccagcaattttgaagcgagttattaataacggagtcagcatgatagcagcctgctaagccctctgaggcaacaggccatagggatgattcaaaataggtagaaatggtatcttttatttttaagaaaaatcacttagccccaataagctgtaggcttatagccataactttttaaaaaatgtataaggtcagatcaaaagtttttataacataatctacataaaatatctatcttcttcatttgtattaaatacaaaaaattactttacagtatatacattcagaatgtatgtccgatatgtttggtaggattcttgaaaaataaaaatttgaaatgaattacattaaattttattttacacttatattgggtatttcaaaattgtcatttacttaattttgactagtttatcagtttatatctcaatgaagagaattgtatataaaacaaatccggccaggtgtggtggctcacgcctgtaatcccagcactttgggaggccaaggcaggtggatcacctaaggttgggagtgtgagaccagcctggccaacatggtaaaatgccatctctactaaaaatacaaaaattatccgggctaggtggcatgtgcctgtaatcccacctacccaagaggctgagacaggaaaaattacttgaacctgggaggcagaggctgcagtgagccgagcttgcgccactacactccagcttcggcaacagagtgagactccatctcaaaaaaataaaaataaaaataaataaataaataaataaataaataaataaataaataaaaataaaacaaatcctccttcatgttaaatgtccacacatttgaatggattgaatttacttatcactaaatatgatgtactactctatttcaaaccgatggcactttaccactgaaaatgtaataactggatcttccataacacaaataatactcccaacatcacttaaacctatgtgaaatttgaatatcaaacagtatctcaccagttgagaaaattttattagtaatcaacaaaagaacactgcccataatgaaatctgtattaattacaaaaagagttatgaaagaaataaatcattattatgaattttattttaaaaattaaatggtttgggactccaatacatacctcttatgatgttttatctgaaggtcacaaacggaaataaactgcaaaccactgtaagctaatatcttaataaaattcatgtaacttttgtctaaagtaattaaaattctctccctagtatttttccaccaataaatgcacttaatacccactcaataattaatttgcactttagcagtttaatcagatgtttaaaaatacatatttacaataaaacaatagatattatagaatatttgataacataaaataattcaataattaaattctgaagttttccaggcactacatttttactattactattattttaagttaccttaataagtgtatagaaataaataataaattagagaagttttaggtagtgctcagtggcagtcaaaatatttatagctcataaggaatgggcacagaagaaatgttaccatgactaatcaaaacagatgctggctgtaaatacagtgtgtattccctgaatatcaaccctagctttaggtgtcaaatcaaaatccatctcttaaagctaatcaagaaaagtgaagtaatatgtagttttaccactgagttccttcccctactctcaagaaattgattctccgattattaaaaagtgtatgctccctcagtaaaaacatttaaaactttgcacagatcactgttagttctcaactccattcctatctaaattttagattattactaaaattttaaggctcttccatgtttgggtgtgtattttctattacatttttgtgcttagatttaccttttattttttaaatgacataaagtatttatacatatttatggggtatatgtgatattttgttacatgcataaaatgtgtaatgacaaagtcagggtatttaggttatccatcaccctgagtatttataatttctatgtggttttctttttttttgagtactctcttctagctattttgcaatatagaatatttttattaactacagtcaccctactctgctattgaacattagaacttcttttgtctgacgtttgtacccattaaccaacctctcttcatcctctcccaacccactcaatcctcccagcctctattatctatcattctactttctgcctccatgagatcaacattttagctcccacatgagtgagaacacgagatatctgtatttctgtgcttggcttatttcacttaacataatgacctccagctccattcacattgctgcaaatgacattccttctgtcttacggccaaatagtatttcattgtgtgtatatatgccacatttttttatccatttgtccactgatggacacttaggtttaatttcatatctttgctactatgaatagtgctgcaataaacatgggagtgcgggtgttcctttgatatactgatttctttttgagggggatactcaatagagagattgcaatagagagatctgtttttcattttatgaaaaatgtccatactgtttttcataggggctgtacttatatacattcccatcaacagtgtataagagttcccttttctctacatccttaccagcatctgttattttctgtctttttaataatagccattctgaccagtgtaagatgttatctcattgtgggttttgatttgcatttctctgatgattagtgatgttgagcatttttcctatacctattggccatttgtacgtcttcttttgagaaatgtctactcatgtcctttgcccactttttaatgcaattaattgtttttactgttgagttgtttgagttccttatatattctggttattagtcccttgtcagatgaatagtttgcaagtattttctgctgtgtttaaaaggtttaattttaaaaaacagtaacaatgacatcctacagcagttatgtgtctcttgacttcgatttattcactaaaatagtttgcatataattgatgggtgaattcctcttccaggcactctttctatggtagaagttaaaaactacaattcttagatggctttgccagaatatgaagcattggtataagatcaaaggcaaagacagacttcttcctgcctcctgcttttggcactgaaaatctcagcaatggtgctccaacagggtctgcagcacagaagtcttggtatctaggctctggactgctgattgcaacactggttatgcaagtgcagaacaatgcaagtgcagaacaacagcagccaccacaagtgactggaagctccagcagctgttacaagcacaacagaattcaagaaattacatattatcctggattcttgaagtgtccataggagtgcggacacctggcttcctacagtgcagtgagattggtgattccaacagccacagcaaaatgtggaagcagcagcagcagcggcagcataatacttataggctctggataacaaaactttcccttgctttctgaaggaatttgttactaaataatattgccaccttctatttgctcaaccagactttccaacacttttgtaatcaattccctggattgaagttcctcttttctgagtcatttctgtttgtcttggcattgattaatataagcccatactccaatatatgcataattatttataatatacatacattactacaatacatacattacagaacatgcagcaatagatattttaaaagactgaggtaaacaagaagtaaacattctaaatttggggctctgtttatcaacaattttaaaacattttgctcttactgaagagcaaactgctcttgatgctcttactgaaaaacattaaaacaaaaatttgagtaaatatgtgtcattctctacgtcttggcttggttttacactttgtaaaacagtcatctgaaaatacagtactattttcaggttacttagatataatggttgtcatgggtgcagaggaggggtggtggtaagttgagggagaaagcctcacaaaatagtaaattcaaatggaagaagagtatcaatggctgtgcttactacatcaaaataatcaattttcaatattaatggccaattatgtaaaatactttgttgaaatttagctagtaaatttccatcttcagatgaataagtcattcctataaactaagaggtgtagcgttttattttttaacaaaaggattttaaaatcaatttaaagattacatttgaaagatcttaaagtaagttataacattatgttccaagttttacaaaatatgccaatatatttttgtacaattttcaatgtatatagaaactagttttacaaatacattggtttttggcaagaaaatcacattgtaatgaaaagaattacaaacattcaatatgaaatgttttctccataaccacaggtccttcaaaaagcagttaccttctcactcattattagtactactactttaaaaagacagatcgaatatgttatttttcaaaaatatacattagagcgcatagtatggacagtcacctgtcataacagaaaaggtgagtaaaattagaaccttgtcattctgtaaaagaaaaatgcataactgccataaatttcttattacttctcaatactctaccactggataaccagtgaacctcaagtggtgcaaatgatattcatggcccattctccatcttattacaaagtatcataaagattccactaaaattttaagattctttcacatttggtaacatatttttgactacattttaaagctttaacttaaaaaacgaaaacaaagtgaccacatcaatgatgtcctacagcacttgtgtgtacttgtgacttcaatttatttgttaaaatagcttgtctgtaaaagactgaagggatttcatgtgtagaagtagttctgtaacctgcctcggcaagcttttttctattccattcaaatcgaccactccaatattctaaaactatgtaactatagataacatagattttcaagaacacactgttttactgtagggcagtattttgctgtttagccacaatcttctccagtgattattttggtgatttataacaacatagttcttcgaattatttcaattgagcctagcaaatatcattggatgaaatgttagaaatattggtactttcatttaactatatagtaaacattccacactgcataatttgttcaatacttgtttttgcaaatcttcagcaatgttttctatacatattctagcagtatttgctgacaaatgtgatagtttgttgccatattatttttcacacattatttcagccattattgctcttgaagaacagtgtttccaatggtaaatatgtttgtattttaatattgttttttaaatccccaaaagtcttctaaatattaatttaatgattttgtaaagtctgtactgagtctcacgtgacattaaacactgcttgattcatgatctaggtagttagattttaatgccttaccaatgaaatggtcttccaccatcgcacaccatacactgagggtgacattctttttcaatgacagtgaatataaatcatttcaaatagacttcttgattattatttttgatcaatgttcaaatattgctaaatcatcattgttcttactttataatgtagtttacaaagtgttcataatatgtttcagggatgttctttttcaaatgggcttggattattagtatcatcttttctatgctttttttcagtcagttgtctgttttgtaagagttagttttagttaaactaatctgtcactaatctgtgactccacataacaaggcacagataacatttagtagctccaactctttaacaaactccactctctcccatcaggatgttctgtttaagtagcaatgcatgtaaataatgctctgatattgcccagctctatctgggcatattaactgctggtaactttaacttcttagattttttaaataaaaaacacaaataacaatttttatttcctctcaaaccctaacgcatcatcttgcatatttcttggaatgcatggactttatttttgaggccactattctacagtatgggctttggactcagattttaaaaatatttattggatatgtatattgaagcaggttacttatccatgagtctcatatagcttatctataaaataagaataactatatcacagaactgtttgataactacattagattgataataagagataacatttttgtgaacatacaaagtgcaaggctctagtcaaagcacacaaaatttattaattcttgagtatggcgtctacacacaatgagcatttgataaatattagttttcttccccaggaaagagagaaagagaaagaaagagagagacagagacagagagaaagaaaaagagagcaagagaaagagattaactgttcaaaataagcaatatttattagggcaaataaagttggttgtttacatgcctatctcttccacaaaaactcaaggctcctaatcatgctgtagtcatcatgtatctgtattcaaagtacaaagatctgaatatgttatgtgctcaacaattaaataaatattgttaagtgaatatacatagggtgacaccatagcttgctgtttattatctgtaaaaattacagcaaatccagcattgacaggatgttcaattaactgcacaaccattgcaaaacatgctattgtttttgccaaattctattatactgttgcagaaagtgcagaaagggtaacactctccagagcttttgaaaatacagtactctttgattatttatactaacagatgggacataaggtatggataatccaaaaataatttgtttggattttgaaatgtgtttttatatttatatctaagcattggcatacctaatattctataagaatgaatgtactttgaacaacaaaactagagtatgaaaagctgacttagaaaaaagtttaattttaacacaaattagtttctcttatctttttccttaacacttctgtgtaacctataccactttgattactccagctacatagaactcaccttttcccagaccttatcagattatctaaatgttggtttctacaggaatattttctgtataaagcagggaattctcatcaataaatctgaaatcaagtttgcctaggtattattaaaaaacaatcaacagaaatataaaatatgtcatctgcttcaaaattaggaatttttatttttaataaattattttattcctttgtgtattacaatccattaacgttctccacaactcttttttttttcagttaagaaaccagaggtagagaaaaactagcttgtgatatacaatatttagttatgtaatccatctgatatctcacaagttttcctgtcaaattcatagtgctcttatttttttaaaagataaataaattattgtgaaatgtttaaatatagtaaaaggaggaataataaatgcaaggcatcactgtgtctcaatgagaaactgaaagattagcttttcatcttactcttaattattcatgggccatacactctatctctaggtgtatgggaagcagagtgcttcggtagaaagaacgtggcttttaaagtcaaagcctggatttgaaagaagcttccacattcactacctgtgaccttaaacaagttactatttttccagaatttcagtttcctcatagcaaagagaaggcaaaagtattaaatgagaacatatataaagtgtttaacccttaggaaatattcattacatagtaatccaatttctacctttcttcccaaaccagaaattctcaaattttgttgtattgtagatctcttttttaatttttattttttagagatggagtctcactctgttgcccaggctagagtgcagttgtgtggtaataacttaactgcagactcaaactcctgtgctcaagcaatcctcccacctcagcctctgcagagtggctggaactacatgtgtgtgctactgttcctggtttgtattatagatctcttctaactactaatgattcacatcaataattgatacttctctatcacataagttataaaatttcttcacataaactgttgaattaaatcctcactgtcactctgtaatcatactttaacctaggtcaaccagcgcacttaacattccatcaagcctgctcccctattttaaaaaaaaagtcctcaccagaactaaccgttttacactaagaaagtgacatctaatgataataaatattattaaactatttggctaggtctaaataagagcatattcacataaatatcactagtggttctaggacctaaaactttacctggtacaaatttttttttttttttttttttttttttttttgagacggagtctcgctctgtcgcccaggctggatggagtgcagtggcgcgatctccactcactgcaagctccgcctcccgggctcacgccaagtacaaatgtttttgtaacactttcctacaaaacagcttatgaaacaaattaaagaaaatatgctcacatgaaaacttttaatagctattatgattattttagaaagagaatgaccctcaaataaaatttagtatattttctattctttagtaacacattaaatttcctcagtataatttatttctttgaaaacgatattgaaaaaatagataatgtctaaaatactgggtggtccatcaaaacaagatccccacttaacctaaccaactctgagagaatagttggttaatcacttagattatcctagggccacctctcaagaccacaatttaaaaatcatttattgatcctttaccttctcttgaatatgtttcttactaattagaaagaaacagagtataaaagttaaaggtatgtgggttctgattcagattgcttaagttcaaatcttggctttacttttaaatgaattccttaacattattaacccttttgtactcatcactaaaatgagggaaataaaaggacctatattatagagtttttctgatgattaaataagataattcaagtactggtaataaaagttgctaaaatttatcaggcattttaccatattcagacactgtgctaaatattttatacatattatctcatctaatattcacaaaaccctgtataatatatcttatagatgagaaatgtgagatccaaggtgccacaactcatacaccagaaccatgattaaagcacactaatcctacagtacaaacacttagtgctaggtacatgggaagctcaatgcctggcacatagaaagcattcaataaattttagcttgtgtttatttctattttatctaaataccaatttatttgaaagttctaaattgaataaagtagttctcaaatattcaatttcacgattccgattccttgcttttaccgtatccaaccccactgttctaaaacagagagagagaaagcacacaagcaagagtgtaatactgtgaattacttatatgacacttagctaataaaagtcaatagatggaggagtctttaatgcatattactaaatgaaagaagccaatctaaaaggctacatactgtatgattacaacaatatgatattctggaaaaggcaaaactatggagacagcttaaaaaaaaaatcagtggttgccaggggctgggggagagagggatgaataggtggtggacagataatttttaaggcagagaaattactctgtatgagtcttataatggtgggtacataatattatgcatttattcaaacccataaaatgtataacgccaaaagtgaatcctaacataaactatgactctgggtgacaaagatgtagaaacgtagttcatcaattgtaacaaatgtaccgctatgctggaaaacgttactaatggtggaggctatgtatgtggcggtaagatgtgtttagaaaatctccgtatcttatgctcaaatttgctgtgaacctacaattgctctaaaaaaaaatcaagtctattaaaaaatttatcatgtagtagatcttgtataaagtctcaacaaatatcaaagaattaacatcatacaaactctctaagcacaagcaacttaagtaaaaaattaacagaaaaaaattttttgagtcaataggagttattttgggaacaaaacacaaagtaaagacttgaggggattgaaaccatcaggatgaatgtaagccagacgggggcaaattgcagaatgtcaattgccttaacctaggaaaggtaaatttctaaaaatgataccaaatggttaaaaatcactaaatgaggaattgaagagaatttcaggttagaaggttgtaaaaagtgaaataattgtccaaagtcaccaaactagttcacgagaaagctggaactagaaactcatgcctctcaatccagtgttctttccactgtaacagattggcaccatagaacatgtttgactcaaggcagtaaattaagtacactgaagaaaaagataagaaaaaagtgataaaatgtaaagtctttgattcagacccaagtattacagctgctatggcaaaaaatagccacaatttctaagtgactttaaccaggaaaaaaagaaagagatgagatttgaaaaggaattaaatttcaagaatcaacaggaagtgatgacagccttccctatttggtagtttcaggcctgaacttttgtcattaaggtaataattcaaagtgctttaatgcctggactgaccacactaaataacaaaattataacccgttgagctacggtcagttttataaactgtgcctaaaatttcctgagttcaaatctgattataaatgggcaataaattcatctgttcattgggctgatttactttattttctgggtgcatttaaaatcttttttattgtggaaactttcaaacatacaaaaagagtacataataaatgattcccttgtacccatcattcaatttcaataagtcacattttgcctttcaaattttacctattgccactaacatcctttttttttctggagtagctgaactgatttaagatgaaggaggaaaaataaaggatgaaaggaatattttcaatctgttattcattgatactctagccaaaaagattccagattatgaggcaaaaagaaaaaaaagacaagagtcaagaagtcaagaataatgaagttgaagtctactagtgagatggtctagatgcattacttcaaaataaatggaactattgtctatgggggaggagattttaacaaactattttccaataatttaagtttgaccaaagaaaaatggcagagaatgttgtaaagctttattgatattatagtttatagagatgggcttatcttcaaggaacataatgattaatcacatcatgtttaaattcatataatcgctaacttaccatattccagtaagcacctataggaagaaaagtttgcactattcataaaatttcaatataaccaagtcttagtttattcttaaagctcaaagttcatttttatttcccttgaagtctgtgtttttctgtacttgagaaagatctcctcatttttaaatttggaaattttaaattagaatttaaagtgactttggtcaagttcagtggtcttttttaagtaatattaataaaattacatatttctggacctcgaaggattcttctgagcatttagaatcatactgcagtttccagactaaacactttagccagagactatgagaagcaggcaatgaggcaaatacaagcatatcgaaattatcttgatcgaaaagaaaatgtggataatgttatgctgaaccgtcttaatttctgtcatgaaacaaaggggaaaacttggcaagtaaagatgagagatgaatttctaatgggggaagaggagttaaaactgaaataactagtgaggcccaactaaggttttaaagcatgaatctaaataccaagatttttttttcatatttggttcctccctattgacttttgattgcaagaccaatggacagcgaccgtctaattctcttctcttatcttccttagcaaaatgttagcatatagctgtctcttgcttcccattctcccttaaatgtaaaaaagttcctcaaccaaaaaattacttcctacatttcatataaatcaagtcaaattatgtctccatacaatcctatatctctgaggagatccttggttctccatggattttaattcagtcaaaatgtgtcacagtccctcagtgcctttatttgtcctgcctctccataaaatctaagctctgccttcccattgaacatttgtctatgaagactttctatatattaatcctattcttcatctttctgaccatacattcctaaaatggctacacatcctgattaatacatttctatgcattatagattacccattttaagaacctcagtgtccaccaatcttcatcacctactggcaatcacctttccacaagcctacattgacatagctatatcatttaccaactactgctcactcctccaagttctgccttgtctacagactaattttcagagtcaaacacccattcttgaggcaaacacgtattaatcaaaaggtcagaacccagtaaattacctggaaactccaatcactgtgaaaaacatgcatgatttttcataaaggtctaattattgctctttttttcaaatgatctgtcacaggctagttctgtgtgccatgctacaatacacttctttctatggcatccacttgagctcagtgaagattcttctattttctcaaatttacattcccctaagatatttggtcagcaaagatgagaaatattaggactctcattaaacattagcactttgccattatctcttaatatttttgtgggcacctattttcattccatcccagaaaaacttctttccctataccattttcccttcacataatttaacaatatctagaatagcacattaatagttgaagatgttctaatgtatgaattattactaaaacaattatttacctatctgatcatataatttattttagaaatcaaaatagacacagagaatagaaaacaaaagaagtaagcattctagaaacacaaaagaattaagaatggaggcagattaaactgtcaaaaagtgtttctttactagaaacactaagcagaatgcttgtcaattctctgacaaatataccactttataagctctggacacctgagaagagaaaatggcaatgactgagggaagttcctccagccaaagctaaatatgacctaagacctgacatatgtcacatacacaatcaacttactgctcaaaaccagtaaacacacatccaatccatcatttctaaggcacttgtacatatttctcaacggttatgtaccttatattctttattccaagactggctttgatgctaatgtttgacttcattctcctgaataaaaatacgtggcactagtacaggactgaggagaggctggggtttctaaactatcaaaaagttagttctgtttaaggataactcagtaaagatttcacaaggcagcattccttagcactacccgaataaaccccacataaacaagctaccaagccacctgaccactcttggcctttgtttcctcatcaataaaattaggataataatgttaactacctcatagtgttgaaaagaaccaatgagttaaaatatgttaagcacttaaatgttgtctggcatgtagcgatattaaagagctaaaaatggtattaataatacctgaatggatgttatttcattgagtaatttagatttatacaaagttgctaaaaagtaatgtaagtgaatagtatatgttttatgctttgttaaattaagaaattatgatatcaacttagagtcttaaatatactgaacttgtagtagtattccaattgaattagtttgaatattataaggttgccattacattttgttggggcttttttcctttttatcccacaggttgacatcatcaacaaatgtaagccaaacaaagcagttactgtaagaaatgctttaaataaacctaaagacattttaaaaaatacatatgcattgataactaggttgtatatataaaaaatgaagcatgttctttctaaattaaaatttagcttggggaggagtgtccgacctttaagaaaaagataaaactcaagaaacaaattgtaggatacttgcccaaccacatataaggacttactgtaaagctgtactaattagtaaaatgtgttactggtatagagatagtccaatcaaccaagaaacagaaaacagagcctataaacaggcccttgcagatacagacccctgacagacaagagctggcacggcaaatcactgaggaaacacaagaacatacagtaaacataactggaaaacatgtttctctatagaaaataatttaaacttttatgtctaaataatatacaaaaatcaactcaagtgaatgatttaagaaaattaaaaagcatgaaccattaaagaaaatctgtatgagaacataaaaattaagatttttatgtttattagaataccctaataaacataggtaaacacgagtttacctataaacaaaccctgtgacacgagtttacctataaacaaacctgcacatgtacccctgaacttaaagttttttttaaaaaaaaaaggaaaatgtgatatacaggccaggcatgctggcttatgcctctaatcccagcactttggaaaaccaaggcagaaggactgcttgaggtaagagtctgagaccagcgtgggcaacacagtaagaccccacctctccaaaaaaattaaaaaattaactgagcatggtggcatgcgcctgtagtcccagctacgcaggaggttgagacaggatgatcccctgagcccaggaggtcaagacaggagtgaaccatgattgtgtcactgcactgcagcctgggcaacagagcaagaccctgcctcaaataaaaaaaaaaaaaagaaaatgtgacatacatacacaatggaatactattctgcattaaaaagaagaaaattctgtcattgtgacatcaatgaacctgaaagacactataccaagtgaaataatccaggcacggaaagacaaatacagcatgttctcactcatgtgggagctaaaacaatgaaactcatagaagcagagagaatggtgactaccaggagatggtgggtggggagatgggagagatgttggtttaaggatataaaatttcagttatacagaatgaataagttcaagagatgtacagtatggtgactatagttaataacaatgtattgtttgcttgaaaattgctaagagaatagattttaagtgttttcatcacaaaaatgtaaggtaattgcatgttaataaacttgatttagccatttcataatgtaaatgtattctaaaataatgttgtacattaatgcacataattgttgtcaattaaaaataagttaaatttttacatgtagaaaataaagctaataatcattttttaaaataatacacacatacatacaaaaagaatgccctaaaagaagtgaaaagacaagctacaagggagaagagatagaattagtatctataatataaagaactcatgcaaacaatagaaaaagaatcatacaaatttttaaaaagaagaaaaataggtataagaaccaccatttcacagaaggaaaagacacatgtaggaaaacacacatatacatgttcacagccttgtttcttgagaagcaagaaagttcacatcaagactactgtaaggtattttttatttactcaggtggcaaaaattaagaagtctgacaataccatatgttaaagagaatatgggtcaacagggatattttatacaatgctggtgggagtgtaaatggctaatatcattttaggaaaacaatttgacaatctcctgcaaagtagaccatttatacatcttatgacacagcgattccaatctcagaatatacctaaaagaatgtcctccaaatgtcaccaagaaacatgtgcaagaatgtttattctagcaccattcacagccacaataaaagggaaacaactcaaatgtccattggtagaagaaaggatagattatactgtggtatagtcacaaatattatatagaagtgaaaaggaacctgtaagttacaattacacacaacatgggtgaatcttaatatcttaatgttgaaaaaaaagcaaattctagcagataaatacagcaggctattaatgagttattgagctacagctaataagttaataattggtattatttgtgaccatctgcaggagtaatattaaaagtttataagtggtaaagctgtattatttatgaaaaaatggaacaataagcacaaagtttaagatagtggttacttctggttaagggaatataggtgtaaggaaatgtgagttttgatgttctaatactttggttaggtcttggactcacaggttatttcttttgatttaaaataacaaacgaatgaatgaatgaaagaaaaaaggagaacacatggaaaaatgactatgaactatgttatgattcaccaattctgtgtgcttaaagtccaattcttttaaatgacaaatgatttagtagtacttctcacactttctgtacatatgaatgacttggagtcttgttaaaatgaatataattattctttaggtctgaagtggagtttgagattctgcattttaagcttgtaggtggtatgaatgctgccagtccaaaaaaatctatgttatctatctagtcatttccaaatatgaggtgctggggaagctaaaaagattgattgagactattcaaggcaacaataaacgtcaagccttgttaatgcaaaagtttaaacaagtaagcatttttattcagacaacttaaatcttagtctttaaaaaaaggaacagttcaggtgtggtagctcacatttgtaatcccagcactttgggaggctaaggcaggcagatcacttgaggttaagagttcaagaacatcctgaccaacatgacgaaaccatgtctgtactaaaaatacacaaattagccaggcacgatggcatacacctataatccatcccagctactggggaggctgaggcacaaaaatcacttgaacctggaaggtggggattgcagtaagctgagatcatgccatgcactccagcctgggcaataaatcaaaactctgtctcaaaaaataagaaaataaaaataaataaattttaaaaaggaaaagaaaaaagcaaaaccacctccattgttttaagactgagcatcagtgattcaagaaattcagagacttgaaggagaaatcaaataaactcaactgaccgctgaataagataacaggtgtcatattttggaatgtttattacaatgctaagaaataattatttgatttctgtctattccaaagagaagcaggtcttgatagaagacaccagaattcagagtttatgttgaaatgaaagacacttctttcctaaattataagaaactgaaataataagaattaagagaagatcgctttggtttcttgaggattaaaataaacagatcgctttaatttcccatttccttggtgttctctacaaaactgcaactagcaattgggacagtgatcactggtggttagaaattttcttgaatagagaaagaaaaaaacaaaattaagagatgactggcaatgacatatgcatccaagaatgcacgcaacatatattaataggtcctactactcgagtaacattagtattattgagaaacagtgaagaaatatatttaaaaatatgtctatctcaattgctattaatttcacatttaataaagataatcaatacacaagtagaaggtgaaaacgggtttgatttattacaatggattcattacgtgaaagatataatatcaaagagaatcagttgaggtagttgtttctactagccttgcctaaagtccatttacagaaatgaaaagcaaagattgcctgcatgtagtgactcacacctgtaatcccaacactttgggaggctgaagcaggtggatcttctgaggtcaggagttcaagatcagcctggccaacatggtgaaagctcgtctctactaaaaacacaaaaattagctgggtgtggcggcacatgcctgtaatcctagctactcgggaggctgaagcatgagaatcgcttgaacccaggaggcggaggttgcagtgaaccaagatgacgccactgcactccatcctgggcaacagtgcaagattctgactcaaaaaaaaaagaaaagaaaagaaaagggaagggaaggggagggcagtggaggggaggggagggcagtggaggggagggaaggggaggggaggggagggaagggatgggaagggagaaagagcaaagactgttgttccttttaagatctacctttggcagggcacggtggctcacgcctgtaatcccagcactttgggaagcccaggcaggcagatcacgaggtcaggagatcgagaccatcctggctaacacagtgaaaccccgtctctactaaaaatacaaaaaattagtctggcgtggtgtcgggcgcctgtagtcccagctatttgggaggctgaggcaggagaatggcgtgaacccgggaggcagagcttgcagtgagccgagattgcaccactgcactccagcctgggcgacaaagcgagactccgtctcaaaaaaaaaaagatctctcttttcagctttcttataacatcatgtctactactggaagaatagagaatctgaagaagattaaactagttaaacatattttttaagaatatttatgaaaaaagtaaaagtcaaatgattagggaaagaaaattttaaaatggagacatactttggaaaaagagtccggtataatatatttagacttagacacattcatccattcaattttctccaaaccagaatctaggtatctttaatagtaccatacggtacagactatagtgtattaagatgatacttacgtttcttattataaaagaacgtctaagtttttagacttttatagtggtgttatcaaccaactaatgtaggtatttcctaatactctcacaaccaaaaaaatggccaatggcaaattaggtgtctggtaactgaaagatcataaagattttactatttcaaagcatttatgctagagtcacttttaagtacagctataaattacaaggagataatttccaatgaaatataaaacagattacaaagctgtatttagctgtctgtggccatttaataagtcaaaacataatgcagcattatcattacgtcaagatgtgacaaaggcccagacttcccacaaaatattcctgtctctatactagaataagacatcatcagaagtacctgaataaaatctcccctcaatgaccagaaaaataaacgaagaaattttagagacctatcttagactttcagcgattaaatgtactcacaccttccatgcattccactcttctatctgttggaggtttatatagcttcatcagtaatatgttctattgctgacatatcaaaaggcttaatatcacacacacagcttcaaatatatatataaatgtccattaagtgtaaaaaatgccttcagattttcattatcatcactgtatccacatcatgctttttcaagcacttcaacattattttacttgactctcacaaagattgtgtaactgaggaaaatatctctattttaaagataaagatcctgagatacaaaagtcaagtgatttgcctataatcatattctatgctgacttctagggtttttttcatctaatatctttaaattctttcatttctgcattctgttactttgttgaaatcattattgtacctgtaatctattaggtcaaatcagcaaatatttatcaatcaacttctatgtgcaaggactcaattaatgtgtaattggcataattaacttatttgtgacatcaacagggataatattaaaattatttaacaactgacacaaaaggtaccaactaaagaaactgaacactgaacaaagtgaaacatacgctctaagttttatcaagggatatcaactgcatgtcagctctgatgtgggcatgaccaatagagtctgatttaatcacaaactacaaatcatttgtagatgtttatttggcctgaaatgctagaagaacatctgaagatttaagagaacatgtagaaaattctggtagcacgtggtccaaaattaacttaaagaaaatgcaaatataaaggaaaaaaacaatctgcttgggtgccaagattcagaaatatgaactcattactaccaaaactagccataatattttaaattattttaatttctttttttgtttgttttttgagatggagtttcgctcttgttgcccaggctggagtgcaatggcaccatctcggctcaccacaacctgcacctcccaggttcaagtgattctactgcctcagcctcccaagtagctgggattacaggcatgcaccaccatgcccagataattttgaatttttagtagagacagggtttctccatgttgctcaggctggtcttgaactcccgacctcaggtgatccagctgcctcggcctcccaaagttctgggattacaggagtgagacaccgtgcccggccaattatttttatttatgcatttatattcaaatatacctaattttaataaaatacataagtggggttttgaacatgtttttagcacaacttttcttttcctttatttcttgggtatctgctcctctcctttcatatttcctctcataaatagttatccatttttataacttagtatgcatcctgctacattcttcttcctttaaaaataaccctactataaggtagatatatacatatgcagatattacttataaatatacatattcaaggatctttgtaattattttttaaaggctgaatattatacacacttttctataccttgctcttctcactcataagaaactcctggaaattctttcagaagatctgagatagctttatttcacatcatttaatgacagcataatagcccatggttgagtttccattatttactagcattaccttgttaatgggattactattttctgcagttttaccactacaataaagttacaacaacctggaaaccaaaaaatacacatgttcttaaatattgctacctatatttctatggaatatattcccaaaaatgagactgccaggttaaagtatttgcaaatcatatgcaaattataattttaataggtttttggtagtcttacaagactgcattttataacaggtagaatatatcacatttccaccagtaacaaatactgttaaggtgcaaaatgggaatatactttcatttttttacatggagatcatcagttatgccagtcccattaatttaaaaaatccatcattttccaactaagttgtcatctttttcagaatttgccaatcatttccactgatctattatgtatgcctaggccatgaccatgttgtttagatgagctgactttgtaatatgttctggtatgtgtaatacaagtccctcctcattgctttttcatatttgcttgcctttcgttaccatttaatcttccaagtagttttaaaataacactgttgacttcaaaaaagaaaaaaaaatctcccaagattctaattggaattgcattatataatttattaactttgaaataatatttttattgttttcccatcctaaaccagtttgtccttctcttaatcagatcctgttttatgcattttaatatctttgttttcatatagttcctgtacctttcttgaaaaacttattaataggcattttgtaatttgtgtttctatggaaaatggaataatattttcccattgggaaaaaaagtctcatagatgcccaaattcctccagagcagagttgttttcatcttatcttttatccaactaccttatcaatttttcttactcatttttctagattttaaaattcaagtttctataatttttagaccatatatcatcagcaagagacacctgacattcttctctacaaatgttaatgttatatcatttaccaactgtatatgataaagcctctaaaataatgttaaataattgtgatggttccttgtttagtttctgttgttaattaaaatgtttttaggatttaacaatttaggccatgtgcagtggctcacgcctgtaatcccagcactttgggtggaggctgaggtggcaggatcacttgaacccaggaggttgaggctgcagtgatccctgatcatgccactgcactccagcctgggtgacaaagtgagatcctgtctcaaaataaaagacaaaaaaaaacccccaaaatttagaataccttttgccatttattgagataaacatgatttttctcctttaatttgatgatgtaataaattaaattggtatatttcctattattgaatcatgcttacattcccacttaaaaatatattttaaaatagctactagtgagttattattttgattcactgttaatattttctaacattttccttagaattttttaatatacttcgtaagtgaaattatacattttttactatataatctttaacagaattagatattaaattatggaatattttgatatttttccatggcctagaatgatttaaattacatcaaaattatgtattccttacgtttaagtgacaacatctggtcaaatttctaatcttttctatgctaagtagcatctgctttctacttcttcttaggtcaatttttatcatttgtatttgactaaaagtccttttatttctcaagggttttaaatttgtcacacagctacattcttatttaacattcttttcatcttccagttttttcttctttttcatttctaattgtgtacttttgtcattctttttcctaaagctttattagtgaattaaaattcatataacataaactcaccattttaactgtattaaagtatataattcagtgacattcgcaaggttgtataaatatcaccaactacctccagaacattctcatcactccaaaaggaaaccctatacccattaagcagtcactccccatttttccttctcccagcccctggcaaccactaatctcctttctgtttccacctatatgcctactctggacacttcatataaatgaaatcacacagtatgtagccttttgagtgtggcctctttcactgagtatgttttcaaggttcatccatgttatagtatgtatcagtacttcattattttttatggctattatattgtatagatatatcatagatgaataatttttattccttcattcagcagttgatggatatgagttgcttccactttttggctactatgaataatgctgccatgaatatttgagtataaattttatgtgaacatatgctatcacttctcttgagtatatacctcagagtggaattgacaggctcattttcttttttgctttatcatcttcacaaggagtttatgtatcacattgatctttccaaagaaccagcctttagatttatttcgggttttactatatggtttttctatttcattactttcatctttctaacaatctcctcatcttctatcttgtattattctttatactaacttcttaacattaggttatctttatcttccctcttccttaataacaaaggcctttaaggccatcaattttcctctgacaactattttagctaattttcattggcttttacaaaaaatatttccttttcattgctttctaggtgatttcctcttcatccaaaagatatctgggaatgttttaatttctatgtagatttttttaaccttttagaaaaactgttaaaatttgatatatgttagcttacagtcagagaaagtgcctgcaaaatctctgctctctaaaactcagttttcttagcagccaagtgcagagatgctcaaaaatatttaaagaatgtcccactgtaattcctattattcacgttttgatttctagatctatcctccaaatctcatcttttttttttcaatatttcatcatgggtttttttatatgcttggatacatttcttgcatttggtcttttcattcactaattcatatttcgacagtgactatgctctcccacaaatcctgagttgttcaaatgagatatatttaatatctgaaattattttctgttctttgaatttccttaagtgctcccaatttttgttttcaaattcagttttcatgttttcgccagtagtcctagttacctggagtgtgtactctgattttcctctctcacttgctatgggtctccttaaatgaattgctatttttcgctaactcactggagctcaggtctggttgccagattatcctaaatggcagaaatatcacaggtggtgaaaagcaaaggtaaacagcctgtcagttccctgcaaaggcacatggacaaagagctctgttgtcctatctctatttctttttagcctccaaagacagagaggactccaccaggacattcagctactttagctttttagcagctagcgacacttcggtacttaaaatggataaatattgatctcctcctacaggagttcacaaacctctaaagcccaagctcttcgtcccaatgtctattgctttctcatatttacccatggactccagcaccattctccagttgcttgcccaacagaaggcagaagtttcaaagcagtgtttctctgcccaaggtgtcatgacagttgtttataggtcacagcagccatttgcttcagaaagccaggcagcttggaattggaagtgaagaagataaccatatatagctactttgttttcaaagtctttaattttaaaaaagcctggggtggagtggggtatgtgggtgtgaggtatgtctggacttcattatacttattcctaagaatcaatagtttcctcagaaagcatattcctgaatatataaaatgacaatatgttcttctgcatgctctttagattgaaatcgtgaaatacactccagctattaatcactttaagtaagctttaatgcaatcccagttttaattattccaggacttaattatcttttgttttgaaaacaacttcaaatcaatttgctgtagtttcagttagaaagacaaattatgactttagccaatcaagtctgccaatgtctaacaagttttataaatatgaaaaagtatgtcagctatttatataggaattacatgtgtcccacatgtggtttacacgatgttaccctctatattgttcacaacccaactaccttttttgctttctagaagagctaagtaattatattatattatcactaatattacagtgtttaactggataagacttctaaaaactcagataattaggtaaaataattaaacctattttttaattgtgtgaaattttatgaacattccttaagaattagaaagctcatataaaaagttcaaaatctcaattgcaatctatgaattacaaagcatagtgtgctttgtttgtccctctatccagataggaatcatataggatatgaaatatgggtttcatccttaaatcagcagataatataattctgtgtactctattcaacacaatatcctgaattgattgtagtagatttgctttaccactgatgggagatacctgacacatttcttttctgaatcatggtaaatgtaattttattggaatttttgccatgatagaatttcattaagtacctaaaaggatagaaaactgtgagcatgtacaaacacgttgggtcttggaaaagtacagggaaagtctataataggtaataattttaacaatgctaaatttgaactccaataagtaaacggatagcctagtaaggaaaaataattttcccaggataagtacaaaaaagcctgatcaacattgaattcctcctgtgtgccagatattaggctaaggactaaagctataaagataaataaagcatggtacctgttgttaaggaactgcagttaagtgtactataattctaaatgttacctttcctaagtgatgaatgtcaaagaatttaagttataagttaaactgcatataaaacatcacactgaatcaaactcactttacaccagatgcacccatttgtgcattataaaactcatcattacacatataagacagaaacagagtaatgcataccccaaatgacagaaacaaccatttatttttggctcttatacactttggtaattcgcttaacaacaaatgttgagactgtaatgtagaatatttgaatcagaagaacctagaattttgttcatttttcccatactgcttttcagctcaaatgacccctttaacacagtattgccttgctctcaatccctttctaaaacaagaaagattattaaaaacatgagtgttcaaaggtatttctctgagggtcagatgtataaaggacagtgagatacaaacaacatagctgttaagaacactaggtcccacaggctatcaaaattacaagaacaacagagtaccaccgatgatgaacttgaggagaaaggtgccatgcactaactgaatgttgataatttttctaactttaaaatacatttttcagtgatgtatccatttgaattatataaaatgattattatactatacttcttaatgcattaaaaataagagaataaagaaaatatcagatattctcataaggaacagtaaagacacataagggatggtatagcaatttcattattctttgactgcattcagatgatacagcttatatttgtaatatagcttaacagtaaacattatcttttgaaaactttttaagtttttagtaccttgtatacaaagggtatatgagtatgtatgtatacatgacagaagtacttggttggaggtcatttaaattatctgcaataaaaattcactttaaaggttactataattccttttaattcatgcatgctgactatactaaatataatccaaagtcatgtacactgactttacctgaactgatttgagactactactctgatagaaatgcatttacactatcagataaaattaaatctttctttcagtatagtgacaaatcaaggaaaagttaaagtacataataaaagtctagactgtattccactcaaagcatagtagaggctgttttaaaattccatgaatatgggaaggaggagacaaaagctaaattccataataaataaaacaaaattaaggtatataatattttacccctcatatccatcacatcctcaagaaagttaacagatgttttcctgtttttgaaaattggacagcaaacaacaatgtagattataaatgttcctagaacagtgatttccaaattgggtggcacacagtaggcattcaataaatggcttaccacacagattgtgctacattgcatatctttgtcatgcacttaaacttactgcctaactctaggttaggactgatgatcatgtttttgtgccaaaagcatagcagtctttgttttcgaaactctcagtgacccatatttaagccagctattggtttctgaaacaaatgttaagggcacaaagaacaaacaaacacaaaagccttccaaagtcataggatttgctaccctttgaatatactgtttctagtctccctcacccctatttctgcatgatacctggttcttggttattcagtcgggtttgatttagttttcctttttgacctctaccttcccagaactttcagtaatacttcctttgtcctgctcctacccatgatttccaaggcctgctttaacatggtacccagctccactgttgcaaatagaactaaatcaggcagcagttagagtctattcattgtacaacctttagacaaattctctatcatcatttttaattctagactgaagagttatattttaaaaagattctatcacagcaaccattgttcctacttacaactctttcaccttgtacccttctctagaaccttctccaaatctatgcctttctgaaataaaattgccattattaatctgggcaagcactgagttaaaatcgtcccagaatagtggtctgatggggtggtgattaagagcttaggttctccagagctgtacttgagtttaatttcccatgtgttttatacttagctgtgtgactttgaacaagatacttaccctttctgagccttcgcatatctttaaaattgggataataaaggtacctgtctcacgggattgtggaattaactgaaaaaatgcagatataaccaatgactgcaacaaagtaagatctcagtaaatgttggctactattggtgttggtggtgtgattagtattcctgtttaatacaaggatagaatgcatttacttttcactgtgcttcccactaataattttgctagtctttttggtactcatggctttagaagagttacagtgattcttcaatatgtatactgggtttcagttaacactaaaaccagcttcccttaagcacatttagaatatcttttccattatttgcatgcattgaagcattcataccaccttttgggtccaacaattgatctaaaattattcttacaatttctcctgattagctagatgtttggtaagctaaaatagcttaccatcatctaacagacagtatattttggctacgaggtgatttataaaatattatatgatcagtaccaggaacatctggagctgtgggtggatgtgaggaaatgagaggattcaggatagtatagcttcctgcagattgctgtttccatctaaggtaatgttagatagctttaagcctttcactaccattcatactagcaaaaaggatgagtcaattaaacagaaactgagagtaaaattttaaattagaactttgaggttatcattaaagatatatcaagtaggtatatagaaattgtatatagttgtttctttcaatatataacaggacaatatttgcaaagtcttttctaacagattctttcctagtcagatttctttgcctaccttatcttccttcctatgtaaatctatctgtgcatggatataatataagatcaaaaactaaatgcagtagttaaaaattaccaattttataagatctgcatggaggtggttcctgattactcaatgtatacctatgttttgcttagagaagagaatcacaaaaccaaatttatcttttatctttgaataaatgtatctatctatagattttatagaaatagaaaaatgtgagttgattcattctgttgttacctgcatcctcaattttaacaactttatgctgcatgaaatgcagagtcaagtttacaaattctattagcaatacaccttcctgagttaagatgagttggcaaagtatttatgtaaactaatagatttattatacttacccactatgaaagattataagtacttaatatcatatatctatactttactagtgtgctatgttagaaagcatgtatcattaaaattaaacttttataaaagactaaaagtggaaagcaaagtcaagtattttacatatactgtttctaggtgtcctaagcatcagtttcagtaacactaccagaagctaaaataacaattcaattgttgaaggaaacaaactcagatgattagaactgaaaatgaccctaaaaatgaaaaatctaaggtgctaaggtggagatccgcatagattatgcaacatgccatagatcatgtaactaattaatggccgcagtagaactagaacaacctctactaacttcacatctgagatttttgacaatgtataacaaagagttgaatttaatatatgagagattgaaaaggtagatattgtccccaagttaaaaatctttggatgtaattacttctacttacttaattttatattcctaagacgacacatttaaaatagcataaaactgtaaaaactcgttagaagtaatgaaaactacaaacaaaatttatgctttatcttaaatcaaaaccatggaaaaggccattttcttttgtctaaaggaagcctgagatttactgaaaatgtgtgtgagtgcgagagagtgtgtatgtgtgtgtggtggtggtaggggtctttgttttgttttgttttgtaaattgttagagattgttctattaatagtttccttttgtaatggtaatctgtgctccaaaatgagggcacactaaaatgaatttctgataatttataaagcagtgaaatacaaatacatttctagaaacttactaatgacagtaagaaaatgggtaccaagagtttcaaaattaaaaatcaaaatctttttaatattatgttgaattagaacatctttttaaaagccaaaagtaattgaaaagagattaaattggtacactcaactctctaaactgtgtgtatatttttcttaaagtgcatatctgtgagctgacagtaaagacaggctggctgctttgtttgactatagttctgtttacctcatactgtcaagaatggattttgacacagtattaatattgctatttttattgatataattagcactgctataaataatttcttgtgctgccatatgtaagtatatcattacaatcagcagtatttagtgcttttcttatatgacaccttgaaaacagactgttggcccaaagaacaaaagtgacctcatgatatgggaatcactgaaaaaaacattgccctgtcaatagagactactgttttgtgtatgacttcactaaacaaactagtttatatttgtttgaaactaaagtttctcaccaatctgctgtttcaatttcacatcacaccatattgtacctaaaacaggcaatctggattcctgttgctactttttcttcccccaaacagctcaggaatgggtttgaaatacaaggcttgaatacataaagcaaaataattaagacacccaaaattcagaatgggtgggtgaaaacaagtacacttgaaaccatttgtgtaactactagtgggtggcccactgtgagtttttgattatatgaaagcaaaatcaaaacatattttatcttgcctctagatcacatcagctgtgacaataacctcatctggaccttgaatagtttgttcataaaacaaagtagggtgactgacccagtgcatattcaacacagagtatgaaggccaaaagaaaatgacaataccattcaaaacaagtttgtggaaattttagactagtatattaaaacctttctttgtctctatcacttgacagatggttagccttcacacagcctagtatctctggcaaagaaatgactgtgtctagccaataacaccccaaattttgacttaaaatgcactgtacacatgcttagacttaccttacaaatatgaatattaataaacttagtcatgcttactttattactataaaaacttgatagatgtcaagatttcatcttctgccgttaaaaataccttcttgaaactcaactatcttaggtggatataaggttccatgaactctgcacttcagatttcattcatttcacaggttggctggtaatcatgcttaaaaaaatacttccaaaataacacttcatcccaaaaatataaaatttatagaaatttaattagcttgtgtttctatgctatccataggaaagttttggtaacaaagtggcttaaacaaaatcaccagggaaccctgaatacactccatgtcaaggaccacaggcaggactggaattatttatccagtattgatatgtctttattcaaaaactgctcatttataaatatatactcacacacacatgcaaacacacatcgatcaaccatccttaccagaaaacaggaaatggtcttactttttaacattcaattagccattcttccattttgctctttaaaaaaaattcaactgaggctgggcacggtggctcacacctgtaatcctagctctttgggaggccaaggcaggcagatcacgaggtcaggagatcaagaccatcgtggccaacatggtgaaaccctgtctctactaaaaataacaaaaaaattagtaggacgtggctgtgcgcgcctgtagtcccagctactcaggagactgaggcaggagaattgcttgaatctgggaggggaggctgcagcgggccaagattgtgccactacactccagcctggcgacagagcaagactccatcaaaaaaaaaaaaaaaaaattcaactgaaacaatgtattccattagttataaagtctgtttcctcctaaatcttcctatttatagttttcagatgctggcaagtccgtatacaaatagccagaggcaatcacaaactgctctaaagtgcattaatatgtacccttcctggaagaggctgattatgttccaaattagcataaatagagatctaatgtaggtataagcgtgacaaaccctccacggcacaggatgggagggctggaggagggaggattgtattaaaaaaagttattccacttaagaactaaacttgtatttggctaacaaagtaagactcaccatgacagatgggaaaaaaaattaaaaaggaaaaactgttatttgagaactatgaactaggttttggaaaggtgagacacccactacttgaagtcacaatctcagcattaaatcatatactcatttaaccaggtaccaactttccttctattagaaacccaggatttttacacctacagactaaatgattaaagtattgctaaaatcttctgtaatgttcctcttgcattacaaataagtctattaaagcagaaaagtgccaatcaaatgcttttgaaaaaatggtttaaataacaaagcattttttgcaggtctctcctctttaatgtcgcctataaactaattacaataaattttcaccttctcttgataaaatcacaactgaaactaggcatggtggcatgcaccttagtcccagctactaggaggctgaggcaggagggcggatcacttgagcccaggagttaaagtacagcctgggcaataaaaggagattcccatctcaaaaaacgaaaaagaaacccagaactgaaaaagatttaggtacttgatttttcagatatgttcctaaaaacaaatcccaaccaaaaattaacagatattctagcttttgttttaccatactttgctaacgggataatactatgtaggaattttatagtaactttcaagacacaagatttttttaatataaagcaacgttttattaatttcaaagacattattaaaatcatgaaaaaaatccctatctgttaaaattaccaactgaaatatatggagaaagtttcatgacaataacaaaaggtacaaataagaaataaactaagatctttctttcctatcactgccaactggtaaacaccttcctccttctcaaacttctgtaggctctttcaaactgtagttcctaagacaagaaagcagctaggttttaaagtttcattaaaaaatctcctcccctaacaatctaaaatgcacaaagtgtgtgtgacattagaatgtaagctccacaagggcaggcaattttctctcttgttcattattacactccaagtgtctagaacaatatgataaatttaaccatccatttcagaaaaatatgattatttcagagactaaagcaaagcccatcaatctctacttccgtattccaaatgtttttgaagaagtctctgcttgccactgattctgtgaagttattcaaaataatatgtaattattttataaattatagatcgcaggaacttagctgtagcttttattgcccttctaaaacaacctaattattcagactggcctttttttctagaaagtccaatttacctaattattcagactagcctttttactagaaagtccaatttgtctaaaaagtcttctgaaaactttcactaatgcaacaaaaatgattcgcttaaaatattttttccttagattttcttcctataccaagtagtcaaattcttattaacaggacaacaagaggaattagatgtttgcgggcctcaaaaactttctgatccaattatagaagaaactggcatcacatcaactggtagttctaaacacccccttccccaattatagccctcacatgaaagtttctctttcctctagtattccatttaatctcgtattttcttttagtagctagtcaatgtacacatgacctatatgtgcattttcttggttttgtagtaatcttaaaacacgggcctagatgggtaagcataaagacttcttcctggaaatggataaaatttgacaatttttaacctgatactttctttagcttgttaaaattaggacctcaccgtgaaagggcatattgctgtggaggctggtaggcagcaaacttgtcacctgatcttcatatgcacaaggcctgtattccactggtctataaaatctgaaatcataaaaccaaaaatatccaattgcccaactcactgagcagctaatatagttctagaaatctcacttttcttcttctcacctgtttacttcaacaccatgtgtccccaaacctaaggccctccaaaattgagctccataaaaatcaaaaccccaatcttgaaaattaagccttgagtactgaacagttacatcagcaattcctcaagggcaatttcaaaagctttcctgggagactactggaaagatggcacagggatatcaccatgcactatgtgtgcaacaactttgatatattctaagaatcacaaagaacaaaggcatgaaaatcaatgtaattttttttctttcactagaaaaatacagattcttcattttaaagcaaaaaagcaaaaagtagccacatcttgactggacaaacttacagttgaccctcagtatccatgggagattggttctgggacctctctaggaaaccaaaatccacagatgctcaagtcccttacataaaatagtgtagtatttgcatttaacctaatcacattctcccacatactttaaatcatctctaggttacttataacacctaatacaagtaaatgccatgtattaataaatcgttgttacactgtattgtttagggaattgtggcaagaaaaaaactatatatattctattccatctattcccccacacccaaaatatttttgatctgcagctggttaaatccacagatgcagaacccaggcacaggaagggctgactgtatgtgaccgggagtggagggggatctatataaatatttccacaaaatagcaaagggtacttgggattgggagcatgaacagaaatgaaaacaaaccattataaatttaaagatgactggttatcacttaaatttagtgtctacagctatttatttataaaatggtaattgtgttttaaaactttcaatggcaacaagttacaacagtaacttcagaatagcgttcacttgaaaacattgggtgaatggcctctataatttttttagctgaaatgtatacaccgccacgcagtgaggaaacttgactttagcacccttttggtatttttaatagaaaaaacagtggagaagattttcacatgtctagaaaggtaacatgttcaacttaggtttggccaatgctgattctgaggacagtactacacccgcaagcttccaaactacttcctgattcattcagattttcattggagagctgtcatcctgctactgacctcattcaacccagttcggagtgagagatcagcggattaccgcgctaggtaccgtagctgtacgccatattgtgtttttcgctaatgtttagtttgtgtgtgtgcctagcatatgtttgtgcaagtgtgtttatcaatagaacttttagaaaatccctgcctcctgcctcttcagcatccttaaaaaggataacagctgggggcggggggtggggggaggacccaaaagccacacagacaggaatacattaaacagtgtacgagagacggcatttgttttaaactttcaagaaccttccaaccatttttatatcaggaatcaaaaagtgttaacatgttttaatgtttccgaagtggcccaaagaagagaaagaaggaaaggtgtgtcttcccttcccaagccccctcctctctagtcgtagaagcgaagcaggcgggggccgggagctccggcgtctggagagacatccagcggctgtggggccaggacacctcctgccccccagttctctgaagacgctccagagaccgcgagagccacggcaagcgggggagggcgaggagggagggggcagaagacaagcgggcgcctctagcagctcctgagccccggctagtccccctcagctcctcttcttggaagcagcggctccaggcgcagggagtagagagaagaaggcagaagacacgtttccagctgcgggacgtcccgcccgccccgccacccttcgaccctcccgcgcctccctcccacctccccgccgggtcgggcgaggcagccgccgggcgctaagaagggcgccgggggagggggcgcgggcggggcggggcggggcggggcgcgggggcgcgcgcgctcatccagctcagggcccgctggctcgccgctctgtaactcgctcccccaaccccaccccgctcccctccttcccagtcccgccgccccccactccaggcgcctcgcagacgcctcatccccctcggcacgcacacactcctccctctctcccgcccgtcccacaacaaattagagtttgtggcattacctcctcgcgctctttaatcttctttcctcaactcctaaacttccccccgcccctacttcttc

SEQ ID NO: 2211 - DNA, 45543 bp, Homo sapiens
  source 1..45543: mol_type = genomic DNA
tttttttgcaaagattgttggaaataatccttctcttgtacctagaaacataggtgcaaatttctgatatctttgttttatctgcattcctgcctttcatgaaagtccctcttgattgtgctgaggctgtggctcagcgaagacactgaataaatacgatagccactgttgcttgttgcttgtccaagtcttcctggcttctgctgcaagagggggatatggagaaggtgggccagggtgtgtggacccgggcagaatctggggaagaagcctgccattcgtctttctttcccacaccaccgaacccactgcccttcccacccccacagcccttttatgaaatcagacaacgtggtaggtggaaaacagcagggcctttcctctgggttttcaaccagaagtgatattccacagttttaactggttactgtgaagtccaagcggccagaattgtgaaaatgtccactgaaacactgcaagcggtgtacttaaagacagtaggccttttagattttgttatatattttttgtagtgctcttcacaagtggaaattttttttttttttttacttttttttaaaagatttttttgtaaagaagggttgtatttagaggccagtagctagagatccaaccagtggacctcttgaagcactaccaggccttaaggccaccatccgagggagactgggaaaactattattcacccaagcctccggaaatgtaatgtaccagcaggcaaaaaacagttcttcatgtagtacaaaatgaaacgaaacaaaaacaaaaacagaaagtaaaaatgaaaccaaaacatttcttaaattctagtgccatagcttttttgtttgtttgttttttgttgttgttttgttttgttcataagaaagagagaaagatactacttatccgtcagacacatgcatcctcatgtggtcgttgaactgctcgatttggtcaaactttgctgggcagacggagcagacgtaagtggtcccctccgtgcaggccaccacgcctggggggccagcgcgggcacctgggggtgtgcctgcagggggggtcccattgctggcactgtgcagggccacgtgtcgctccaggagggtcttgtgagagaacttctttttgcagatgtagcactcgtaggacttctctccccggtggaggcgcatgtgcacgttgagggagctcttctgggtgaagcgcttgttgcagatactacactggtatgccctcactcctgtgtgtgtcaccatgtgcttgataaggtaatcctttaaggagaaggagcgccaacagatgctgcattggtggggcttctcacctgttgatgtaggaagagacagcaagcaggacagagcgagacatagcaagggatagagaatgaaggacaggaaaaacaagacaacaaaaaagaaaaataaaacaattaaaaaataaaatttgattgcttaatggatcatcctcgtttggaaaaatccaggccctcctagcctctcatgtgcagagaaattttgctttatggtgatgccaggacagttttgttttccatttccctgtgccataaaacggctttcttggaaagctaccagatattccccactaaaagtcttcaaggtcactccgtggaaaagggagggctacttttgaagggggtcactttcagtgtcctgattaggggatttagtgtttcccattaacattatcaaacaaatagaagaaataagagagaagaaagatcgttggagacatggggtgctctagaatccttgagaactaaggatattggtcactatagcttggttccttggggtaagtccccacttctagtagtctaagaaatacacctatgtgttgattgtgagtttggaaaatatttgccaacacaggaatacgttattttgaagagctatactttcaagtttatctattttagacagaaatctttctaaaatataacttaagggttaattgcctgttctctattgactgtagtgagctgcagattggcctcatcgggtgtagaggctgagtaggcggtgggcaacatgatgatatcagactcaaatgatcctattcaaatctgggcaccaacacactacactccactctgacaaatcaccaaatgcctctgaggtatacagtcctacttacctcattgtgctggtgttgacataaaatacatatgaaatcactttgcagaccaccaagagcagtgtgggaatacatgcatggtattcttattacaaggatacctcccacccccattaaatgcttccatatgccttttgaactcttgggtcaatttttaaaatagttttcctgcgtcctcctttgctctcagcctgttggcggaaacccttgtttttcctcagtttactgctttggtttggcttagaaaccaaatgatcaagtttgttacaaacagtaaggtaaataataatactcagtgcatgaggtattcttaaagtccatgggtccgtgacatctctttaagatgattacttaaagacttgttttctttgtgctgtttgttctcagctctgctcctgacaggtgagatgaactgcgtgtttggtccatctctaccacctcattcctgactgcccagtgtaggccctcacctcagagaaaaaagtccttccatgatccaaactaaaactgaaagcctctgaaactccttaggataatatttcaacatttggactatgcatcaaggtaagaagtcttttaaaatttgagctaacttccacttaaaatatatgccttgactgtttttcattttttcccattatgaaataggagagctttgatgtattatggtaatagcagcaatgaaaacaatcaccatgtattgagtgcttactatgaagcaaggttggtattaagtgctgactatgtagcagggttggtattaagtgctgtatgttcatgatccattttattaaactttctctcatcaggaatttgttgttattgtgttttcaaacataaacagatatgttttgaagcacactgaccagacagtatgctgcgtaagatcacatggttagaagataattttacttttagattaaaacaggaaaggttagggaagcctcattgctaataatctcaatttgctgaagacttcagtctatgcatagtgtttacattggtaccttttttttttttgaagtaagagattccctaagagagacagtcatgcatgtttttagctgaaacatttctgtcagctgtaaacatgcctggaagtcagctggtctttgctatcctcatgctttcagacgatttatagaggctatgataggctggccaactatcatttaaaacatgtccacctgtcaccttttatgggaagcgtgccttaaattccagatggtattttggctgctaagaagttgaaacttcacctatgttaaaatgctctgctgtttgaaactttcaccttctgtgtgtttttcctcgaggcaaggtcactgatgaagactttattttcacactcttctaatctgtctataaattgattcctcatagttgtcatgtttctctctatagcatatataggtatgttgtttgtgtgcatgtagtattggttctaccattaattatccatgtgaccctgggctttttaagtgttttcatttctctgggtttatttcattttctgtatgtgaagagttggaccaggcagttgcacatggtcctttgtggatttagtggtcctgagtccgtggtggactgcaacccctgaggactctagtcctggccttgtcagtgaatgacccaagggcaacctacttagtcactgaatgcattaacagtctcacattttaaataagacaaagtatcctgttcccttccctgccacagaacaatggtatgttacttaataaagagaaatgtttgcaaagaacttgggagctccttaaaggaaggtgctctctataattattaaggtgctgtgatggtgaagtgtaggtatttcagaaactgtcttactaaatggggtatattttcagattagtgaggtgctcacaactttcatttctgtatgaatttgaaacgcagtcactcagcaggaatgaatgattgtgttttaagaaaattttttttcccactattttcttgcatattacttacagcaatcccaaaatggttttagacattatgcataaaatggatgaggtctgtcgattgttgctctccaagtaaagaaacaaaaagtgaagataaatggtcagagatggttttccaggtttaagcctatggtcaggaatggcaagtctgatttgtcagaaggggacacaaagtaaaaagtggataattgaattataacatcaaggggaaggtcatataagttccttcactttaaatgatccattttgggcctatacagatgtaggagtcagatatgaattccatttccttggctgagtgacttgggcatgtcatttaacctctataagcctcagtttccttatctataacttgagaataatatagtaagtacctgtctcgtgaaggcgttttgaaaattgaagagataaagcacttagtacagagcatgtggtcattttaagaaaaattaaactgttccattcatcacaaaggaaccaaggataaatgaaaccaactgcaaaatgacttgcatggcatatggaagtcaatcctgaatttttaaaaaattatttcagataatcagtaaaacaagtgattatattgcagctatgtaattcagagttaaaggtatcgtctactctctcaattacatatgcgaatggcaagaagtggtatatggataaaatgtcagcacagagcacagacagaggatttcctaggaaacccgtgactgagcactggaggcacagaaaccaaacagcaagggaagaaactgagggggaggcagtgccctttactgccttgccaagggtgttgggcgtggtaaaagtatacgtttttctcaatttttcaatgcctgctcatcaccttcttctcaaggaccagctctgacacttaactctaccatgactgaaaagtgaaaaaaaaaaaaaaaggaagaaagatcctgcttaggttagaagatgcagagggttctgcctgaagctcacaaagttcaagtaaaagccatcctaatgggtaaagacaccccaattttgaataggaacctcttgcactgggggctcagcaagaacccacttattctactgatttttttcccctcattttaaccaaggcttctcctgagctgtgaaaaagacaatgaatgctgttatcaggagatttttcagaagcactgttcctacctgactctcctgttctctctgcctccccatcatctgccctagtacaatgccctcctctttcgtgagtacagtgatgggtcaaaaaaccaagacagggtgcttgatgagacagcaggcagcaaggaaggaggagaaagaggagaaggtgggtagcagaaggtggccactggtgaggaaagcagaaggaacacttgaaagtccaggtcctctgaatggggaacatcaagacacgaccagaaaatggggaaggttccatattaacaatggaagtacattcagatggaatcatatggagcttttactggctgcagagtctagtctccgtcaagagacgtctgtttaaaagggggcccacacggctgggcaccgtggctcacgcctgtaatccctgtaacttgggaggctgaggcaggtggatcacctgaggtcaggaggccgagaccggcctgaccaacatggtgaaaccacatctctactaaaaatacaaaaaattagctgggcatggtggtgggcgcctgtaatcccagctactcaggaggctgaggcaggagaatcacttgaacccgggaggtggaggttgaagtgagcagagatggcaccactgcactccagcctgggcaacagagtgagactccatctcaaaaaaaaaatggggggcccacacacctgagatatcagcggtgtgattgcctgccagcctttctgttcattccctgggatgtgatcctgttgccagcttggactgtgaggctaagagggactgcctattgggaacatgctgcattcacaaaatatctgtggcttcagtgacaactaagatattttagttttaagcagaactttggagagtttcatccatgctacttgacttttcttaaaattttgtgaatagagtggatattaacatccccagaaaatagcatctccaagtagagagttgtactaacatcttgaaggtcatctaagaagtcagtagcacctgagagtataatactagcccaaccagattatcttcctctcccttgttaacaactccttgttctctggattatgctgcaaaatgtatgatgctactataacacatattaatggctttgatagttttacagcattcataattaagtgttttcacataaattatgttattcaattcaaagagcaatcatgtaaagtaagtactacagatctgaaaaactgaggcttaggtcagttacagaacttagccaaagtgactcagccagaaagtggtaatatcatggccttctcactccaagccttatacttgttactttacacccactggcttgatataattaatagtccaagctccatatgaggattaacacattatcttcatatgactattatggcccaatcaccaacattgttatgctactattgttactatgtctatttacactgaattcatggctgaaatagctgaacttctcaaagtaataagcaaaattaccgtatgtgcagaggataccaatgggctaaaaacagtcaccagtgaacgggctgttgataatatgattcagaaaacgccaaaatatttatctcttgtgggtaaaaaaaaaacacgaaagtgtgaacacagatatgtgtacaatatattctatagcaaataaaaaaagagaaaaaacaaagaaatttaaaactcttgctgtgaaaagaatgtatctgtgtataagtcccttgaattaaattctcctggaaagcgtgttcacattttaaaattttcttttatttattttatttcaatagtttttggagatcaggtggttttcggtgaatgtgcacattgaccaaatgaatgggcatgtgaaagtgtgatatacatgtatatatacgtgtgtgaaatgtatgtctctgtgtgtgtgtgtttccgctctcacagagtttacattctaaagggaaggtgtaaagataatacatgatgatatgaataatacaagtcagtcctgctaaataccagaagggatacatttgccatgtgacctatgtaatttggaagactcaacttacctcatatgtgagtgattagtttctgtgatataatttatccactacaaaatcaagctttgatccataattttgatttactttttctaaacagattcttattagtggaattttaaaaaatgttatgtaacaaaagcaacctgatgccattcttctaattacccaggctcacctctctagggaattgattctcaacttcagcatgaaccagggcttgttacacagatttctaggctccattgcctgagtttctgatttaggatgtctggggtgggggtgaagggtgggggaacataatttgcatgctgctagtgtagggatcacactgctccagggttatctttgaatttgccctattgcttgccttccacatccatgttgacaccaaggcttatccttcttgtattctctgtctttccctttcatttccattcctttatttgacttctgcttttttctcttgatgaagggggtagaggggagcactgctttcttccctgacaggatggtttgtattatctttgtttttttctctctaattctgttgctttcaaacatgcccttaactcttagtttcctttctcacaacttttatgaagctgcagtaagtgaatgaaagaaactcctagagataaggaagtcctccgtggtttgtttagcagtggataaagagtggttaggtgagcaattttcttttactgttataaaaattgttaagaaataaaaaaattcttgttatgaagaatattcaagagcaatctaaggagtataaaggagtttcagagtttaaattccaaagaggaaggacacatgtcaagcatgtattattcagagacaggaaatagagcaaagaaactaagtgtctcctgggtagtaggggcgaaaagtaataatgatgaggatttttaatttttctaattaagtaacactttgcctcttctgaaaagctctcacatgcatcatacgtttacatcaaaaggcagaaaaaatcatttttattttaaactcaaagaaatagacagttgtgaaattaactgatttgttgaaggacacacaggcatttagaggaaacaaaactggatccaaatcatctaattacagtacaatcgtctttcatttatgcctctactttaaatttttgggttataatcactatgaaatatgctttacaactaaagcttccttgattcttaaaggtagagcttagctccaaagccaatatgatggactacttctttgtctcaaacagattttttttttttttttttttgatacagagtcctgctatgttgcccggggtggagtgcagtggtgtgatctccgctcactgtaacctctgccttctgggctcaagtgatcttcccatttcagcgtcccaagtagctggaactataggcatgcagcaccatgcctggttaatttttatagtttttgtagagctggggtcttgccaagttgtccaggctggtctcaaactcctcggctcaagtgatccacccacctttacctcccaaagtcctgggattacaggcgtgagccaccatgcctggccccaaacactttctttcatgaatgtggatcattaacatagagcagtacaagattttaattggaatatgaatcttataatttattctcttcaggtttttttttttttttttttttttttttttttttaagagataggtacccaggttggcctcgaaactcctgggctcaagtgatcttcccgcctcagcctcctgagtatctgggactattggtgtgtaccatcacacacaatttatatctgcagttgttgaaagcaactaccatctatattaaactttggagttactgaattgctaagacagttactctgcaggtctattggtttgcatagcagctgtaatggagagaactcaaatttctttttaactttgtcaagctattctttttttttaggactctttttggttagagtatgggtgggaacacagagtccaactctactcttacaagtatccccgtgctttctagaatctttttatactaacatttggactttttgctttgaatttttatcacttccactgggctcttggaaagttttgaggctccatttttttatgttttccctagaaattgaaaagaactttgtttggaaatgcgagctacaatgaacccaggtcttgaattatttccacatgttccggctgtcttgctttttgaaatctagaccaattgttctaaaactttgttaggttaggggatccttcagttagacaatagtcttgaaagactgataggatttccaaactgccactgccaaataattctggaatgaaagggaagagcattacttcttttaaattaggtgcctgattgatatatgcacattattattttcagatggggctatattatacacaccattacaataacattcataatttactgaggatgttcataatttactagaaaactgaagtccacattttaagcataactcagatttataaaatgactctacctatagcttttgcatctgtgtctgagtgcacaaatcctttgctggttttcttatgtccaaatctagttatctcggttaaccacagaatccttcagtgaatccattggagaaatgtatttatacatcacgaagatactttttggtagtacattgaaaattttatgttgcaaatttaaagacttattttattatgtgatctaacagaatgtgtgaattttacatctgataggtctacttgaagagatgtacagaggggagagcagatatgtttatggatccaagaccagcaaagtcaactttggttaaggagatactttcacagatggtccttcctgcacccctcccccatgttccttaatttaatggcttataaatcagctatccaggggaggaaaggatataaactatgtgacagcactctataaatcataagatgctacaaaataaaaacattactatttgattaattcacctaataatggtgatatccataccatatggaaaatttcttgtgatttacctctggttattagtacattcacatttatcccaagtaaacaaagcaactcaccactacccaagtttcttcataaattcagtagtgagtcactctgtttatttggaagtgtgaatactgtgatctttaaaaactgattctcataaaagtacatacattaatttacataatgtcctgacttacattaccctgcaaagaaggcaaagttcatcttaagcaacgttctgtttcagttgtacaattccatgtttgatgccttgcctctatctctgttgctttccttcccttcagtccccaatctaaacttcactgttttatgtcttctctcttggattcctactagctgatctgagaaacaaggttgttttgagaaactaatttgttttcatgtatcagaattcgagtatgtaacttttccctggtaaattatttgtcatttaataagggtattctgaggccaggcacagtggctcatgcctgtaatctcataactttgggaggctgaggcaggcagatggcttgagctcaggagtttgagaccatcttaggcaacatggtaagaccctgtctctacaaaaaataaaaaagttaaatgagcgtggtggcatgtgcctgtagacccagctacttgggaggctgaagtgggaggattgcttcagtccgggaggttgaggctgcagtgagccgagatcatgctactgcactccagcctgggcgacagagtgagaccctgtctcaaaaaaaaaaaaaaaaaaaagaatttcaaatataatgatcatcactgttataggtattcttaggtccaagagaatctaggtgacatcacaatcgcttatgtgctcacttatatggaggcacatccatggaatgcccaattctatgggaattccatatctctgtaccactatggagctatgaaaaaggattggctgagagatcagaagatcttagctctggaatcatagaatccagggatgaaacatgatcttgcccatcttgatgactgaatcctgtgtacaaaatccctaaaaatgttcatccattctctccttgaatgcgtctaattacagaaactcactccatttaaaggcagtctatctgatattagagcagatctgattgttaacaaaatttttcttttattttgtggaaaggatctcctgatagcatccaatcattggtctagttccaccttttggagccaaactatacaaactgaatgtctcctcctcttaaccatcttaataatagctaccacttatagagcacttattatatgcttggaagtactctaaagacttcacatgtattaatttattctcaaaacagcactataaggaaggcgtatcacgattattctcattttatacacaaggaaactgaagtatagacaagttaagtaatttttccaaggcgacaaggtttagtagtagctaagcctgaatttacacccaggccatctggctgggtgtaagagctcaagctcttcctgactacagtatgctgcctctgaaacacaaatacttgaatatggcttatataatgacctgagtcttctcttctgcagtctggacatccctaggacatcccttctccataaagggttcctgtgacggtgtctcttggtggcagggtgctttgttcttatgatgggaggaacacagttggggtttctagaagaggcttgtggtggggtctgtttaaaatctgaaagatgatcccaaaccttcccttctacctgctctcttaccttgccttcccacagccccctcagcccctgctgccaggcctccaggtggggtgacactcacctgtgtgtacgaacatgtgcttgacgtagttctgtttggcggtgaaagtcttgttgcagagagtgcactcataaggctttttttcgccttgcccactggctgtgctgtggcctgcggatgaggccaggggctgtggcgctggcagctgtgcagtaaaggtcgacagaccgggctgggacactgtcacaaactgggtctgctggcctgccaggggctgtggcaggctgaagaggaaaggcttggggccactgcccgcgggctgggtagtgaagagggctggcaggtaggtgttgccagctgtgccaatgacctgcgtgttgctggtcaaggtcagaggcatcctcaggttgctggtgagggtttctgtctggcgtaagtagagctgggtacttggcaatggctgcccgatggacgtgttgaccgaaggctgttgtaggacgctcttgtcggagctgttgctgacagtgataacagtgctgtccatctccacttcattgcttctctccggagaggaagcacctgtttctagctggtttgtctgcggaccaccctcagcgggggcttctgcagcctgctcgggttgggtgggttcagcctggctgtcccgcgccgccccaggcccaaactgctgctccaccgagtcaggctcggtgcctatggaggagctgacgcccgagtcgaagctttcacctttgggctcactctcggtgccctcggcctggtctgtgtcttccgtgcactcctcggattcgttgcgttccaggatctgcaccctttgctgcccgtagtagtcgtaatcgtcctccatctcctgcttgatgtggatgttgcccactagggtctggatgcgcacaggccggggctgcttgcggcagtgcgtggtctcgggggtggtggacaggtagcgctccatctgctgcgagcgctcatggatgcgtgtgatccagctggggtcttccatgtggtggtcgcggggcaggccgagcgcagtctcgtggtggctgaccactgcgccgctgtaaaaagagcgctcgccgctgccattctgcatggagcacgcgtagagtgccgagtagatcctgtccacgctgtgctgtgggtggctctgcaggtagcccgactccgtgtcgctgctctggcctgacgtgcctgactcgggagtgccccgcggcgtgtcctggcccgagtcctggatccccgggaacacatcgcccacgttctgtgacacgatgcgcgtgcactcgtcgatgactgttttgatctgcaggatgctggcggccgtgaggatctgcagagcttccgactgcgagacccgtagcacgccgctgtacatgaagtcaatgagcttttgcactgactgcactgacaccaccgacgggatctcgatgtcgctgtagccaagcagcagtttgtcctggaagaaggggctgccggctgccagcacgcagcggtgtgcgcgcagcatgctcccgtggatgcgcaccgttacgtcacagaagtggccacggttgcgctgctcgttgagggtctcgagcacggaattgctgaagttgtgaaggttgatgctgtgaatgcgctcggtcatccccttgcaactgatgtcacctgcagcatgtcaacgcagacacaaaacagggcatgggtcagatctagctggttgcattcctaacacctaggtttcaggtgagtaatgctcatggctcctagaagcactgcccttacatacgcaagtggggagatggacaggctgcggcatacaagctgtaggtacgatgacctgagggaaaaggaccttgaattttgctccaattccggcctttagtgccgcagccattttgggtatccatattaactccccagagcttcggctgaggtagagtggcctaataaccagatgatttgtttgcctgctattcctacagcttcagcaaagaactgaaaggcaaatggaagacttgttcttatggaacactaaacctccactttatttttatttatgtatttatttactttgccttcactttagacaggcctaagcccagattctttgggaaagtttacatttcccccaacttatcaaagtcccttattttattcatacacagtgaccatattcatagttaacaaataaacccccttcctattaagtcatatggcatattatcaaaacccacaccatgtatgcaaaaattattggaaaattcaacccagactaagatatctaccaaacagtcatgatcatgctttccggatgatggatgggctacagaaagcaatctgctagctaaaggggcactccatggctgctttctgtatctactcattcttcttgtcatctctgacaacctgtttgagcactttctagggtggttgcatgtgatatggaaggttttctgaattttctgaggcttaatgaaggaggaatgttaaaaaggtcagagatggcagttctgacccaggagactacagtacattggtgatcatatttattatgcaaacagggcactttcaagagtgaaagagagcattgttaataattaggccaggatagcaggagtaagccagaagtgggatatatgatctccttgggtaatagggtgctttatgtacttgccacagggaagtattaaacagctcccaggaggaaggcaacagctatgtggaggctgcggatagcctgacccagcgccaccctataacgtaggctgttatggcaagggatactattgataagatttggattcagaatgagaaagaaaacaggtggctacagcagtagatcttagggcttttctatttttctagctcatctctcagatggctctagagaatccccctccaaataattcttcaatcagattccccattcttgcctttacaactgaacaatcagcttgggaaagtgaaataagtgggctttcaaaaccaaatggcccaagcactgattgttggcctggacccaaatctctctgtcttgtgagaagccacctgagaggtaacagcctgcagataggaagaaggcctacctcctcaaactctttccgctctaccttgcgatagaagacttgttcaggaaactctgagttcaatgagcgtttctaccttgcttcactcaatcaccctcacatggtatgagcttaacttaataaatgttcaataatacaatttgcactaatttgtataagagcattctttctcgttctgactctatcaggtctgttatgtgcctaaaatattgtattaggctacagattccatcgtttttacttatataagacaagttctctttgccagattaaagaattaaggtaaatcccctgtaaccatgtgaacacaaaatatggccccaaaagaaggcacaaataacccaggaagggctgttcaggagctcaatcagcagcagaccaaatttcaagttcttgctgagttcgccatacatacataccatgatagtaatcacaagataacattttttaggggttacagttctaactgctttctgtatatgatttcatttaatcttacagcaaccatgggaagtagatgatattattcccattttacagatgaggaaactgaggccagagaaactaagaaacttgctcaagtacacacaggcaattgctggtagactggcatttaaacccaggcagtctggctctagagttcaccctcttaactgcttcattatattgcatagtttgccctttactgaggtctggcccttagggatccacggctctgttgtaaagctgtgtgaaaggctttgtccactactacctccagctacttctatacctatccgtgatttagtgtggcttttatgtttttaggctgtgatgctttgacatagcctcagttgtgtaacttaaaggacttatttttttagatgtcacagtgcaagaagtaagacaactaactggcactatggtttaggattttctatatacaattttactataaccaaggtctctttcatttaagtaaaacaataagcagtaaaactggttgtgtctgtgatcatctctgtgtaggatggatttattacaacatttttttctacacaagtgaaaacactctttaaacatacatttgctcataacattagttacaacaataacactagagatgtcatatatgacagttttctttcagataattctgggaagtagccctatcacaattatcacaataattagtatccatgtagtgtttgactgtgtatacaacttttttacatgtaacatctcatttattccttacaacaatcctatgtgtgttctgaacaggtttttttttgttttgttttgtttgttttttttttttttgacagagtcttgctctgttgcccaggctggagtgcagtggcacaatctcagctcactgcaaccttcaactcctgggtttaagcgattcttgtgcctcagcctctcgagtagctgggattacaggcatgcaccaccacacctggctaatttttgtatttttagtagatgagttttcaccatgttggccaggctggtctcaaactcctgacctcaggtgatctgcccgcctcggcctcccaaagtgctgggattacaggcatgagccactgtgcccagcccttcaggacaagtcttattattgctatttcatataagagaaagtcgaggctctcaaaatgtctaaatgacttgcccaaagttttgcacagtagcacatggcagtgttgggattagaaactatgcctcttaaagctttttccactgcataacagtggatcactgaggaatggaacttgaagtgcccaaagatcgagagttatcttaattctcagcagagaaaaaagaaagacactgaaagtaatgatgaaggttgctttagagataagaaatgaacacagataatcacacacacacacacaattccatgagaaaaatccaaactgtttgaccagattggattgcaaattttgttcatctaaacaatcaagttatctactgaatagtctgagttaagactcttgcgataatattgccaccaacttcattaaaaaccacagagacaaacctaaacctgcacacgtacacaacctgatctgacatgcctggttgaattttatacacacaattcttaaatatctccctgagtacactggccccacactgcagtgaacagccatgaaaagctgaatcgtttttgctgatatgagtacagatgcgaagggggaccctgcctccccattcaagcatgcctcattcctccagcacacaatgctgaggcaattcctttcccaggctttcttttatttttaacactaatacagtgggaaaaagtttctgccacagcaaggcaaagtccaggcttttgtgagcatgtccttttcatccaatgggcattaatgtatagattccaatggaataaatctgaaatactctactgtagaagatttgtcccccattgaaaacaaatcttgattagatggttattcagggagtgtataggaaggaatggtgtgaaaatgctaactctattctttcttagattggcactgaataggcatttgggctattcaagaaaaaaaaaacacacacacacacacccaaaccccaaccctatcaactgtacaaaaccacaaaactttacatagattatgtgatcatgtgtatttggggattcttccccacccaaaataaaaaatgcacagtgttatgaacacaaaactgatggcaaaatgaaatagtgataaaaatagttctctgtgttttaaaataataacttacctcctttttactagagtaaaaatacagagtcagcttgtgatggcattccctcaaaacatggaaggaattgcagtaatgaaagtcatcatgtattctaagagactgttctgcgagagcacaacacagacggggctaaagcaggggtgagtaccgaagggaaaatctgcctgtggggaattggggatagagggcctgactctctgttttgcaggaacgttgctcctgcctgtcccttaagctgcaggggtccagggataggacttagcatgagaataaaaagctgcctgctcacaagagaaaatgagcaagaaaggaaacagcaggcaatacaatctcttttaattaggtgtgaaatccagttctttctcaatcaggagagcaaaaggatatataaaatgagactagtgcaagggtaagatgctacagagggggatggggatttgaagtctctggacttggaaggaaacatcagctctcaaatgaaaaccaatataaatttcggtccagttaataagcctaagtcaagtggcagggccagaaagcccttgagctttcaatttggggcaccagatgaggttagtgggtcttgcacatgaaacagggtgcagcttgccaagttagtcacactaggaaagagccagtcatctctggagaaaggggggatgtattttggtgactgagcccccttattctccaaaccccctgcctggggtaagacttcagttacatgtactttacctcctcatatatgccaagggagtcctgctgaatccctgcactataggaggtatagtagtttcttgctaacaggttccatccacagcaaatgactctgcaccaccccactctctctttctatctcattagtatcatcacagtcttgggaggtggctgggagcactggagaaatcacacatgcaagtggaaggcagcaagcagacaagatctctttctcctatcttggctctatatacctagcatatcccagctgctattacctctgtagtgagactagggagggtcatcagcctatgggagggcgagctgtacagttttacttacccattcttgggtgaaaaggggggtgttttgggccatctcccaataaaggttctcctctatcttccagattgtctaagcccagtgtggaggaaccatcaaggatttcagcacgtttttttagccattggtaacagaattcttcacataaaacatatatcaattgttgaaatttgcagaaatttgacttcgaacttgcagaaatttgactttcaaacatgtttgcaggaatggctacctatgaaagttggggactagctggatgtgcttttttagtcactacttattattttatctagacaaagattaaaaattactaacttgtttacagtatttacaacaccattctatttatgatcccaatactgtaattgggtatgcctttaatattacctgaatttttattcattcatagaacatttctagagaatacttaaaagtatttaaaggtccttggttttatgtttgggttttggggggtatgtatagtttttataaatggacatgtttatacttttataggaataaggtcagtggctttcatcaaaatctcaaaggggtctgtgttttccccaaattaagagctgtggattgagattcaggcatccctctttaaaatacttgtaactactttccataatcaaagcttctaaaactgatgcaaactttgtgattgcattactctgatgcataaggtctgttgaactgatattttccatttacttaagttgagctgatactattttgtatgagaaagcaaacaatcttggccaaaatgagaaaagttacttttcagaagagaaatattttttaaaaagattgaaagggaagagagaaatgtaggtaactactaatattagcagaaatctggattatgacagacatatagtttacaactgttgaagctaactattatttagcaaactttgttttactcagagtaagtcccttttgacagttaagacaaatccacagaagaattagaaaacaccctttaacatcttttgactgttaaaaattagatattgtggtataatttgaataaaaaataaatataaactcaatatacacatctaatcagccaaaaaaatagtttacttgcaagatctatagcacttgtaatggggagactgcctttctttctattttcctccttccctttcttcctttttgctgtcataccacgaagttttactaagtttgaagtatggggaacaaagaggcaaaattgagaactagaaaaacatttgctctgtgattttcaggcccatccccaaatcttgacttatcttccattcctgacttctttttcctctcttcactccaccaaaaaataagagctttatactttatctaaggctgagaatagatttacagtactagtgggattttacaggtccaaaggagaaagtaattccagaaaagtctttttacttggccttagaggtctcacagtctcccttggttagcccaggcctttggcttgcctgattttatgttaagtctgctgttctctctaagaaaggatgagggcatgcctatccatattgtaaaactgtaaatacaactgacttatgaatgaagctgctttgggggtcacttgaattttcaccaattcattagtgaaacatttactgagaataccccagtataaatggaaccataaggatacaaaggatcttaaatctaaatcaatagaagaaatttatccataaggatctttgatattggaaacatatattaatcaatcaacttctcccagacctcagtgctcaggaaaagctgtgttttgcttttctttgtggagcctgtgaatatcataactgatcatgtttccctcttggctctgttcactagggagctcagaataaaaatttaggcccccttttagcaactatgtaggacctcatggtatgcttttctatgtaaaattttcaccagcctcattatattatccattctttattttacctctactctgatttctttttttttgtagttatatagaaatacatttcctacatatttattaacaattgaatattaatttaagctacctcaaatcccttacttatgaggtgagggcataatcaatcaatcaacaagtaattgagcatccactttatgaaaccaattccaaccataagttaaaacttcagtcttgagtattatcacactatatgctttatgaattttttatactttgagcatctgattccaatgaggtaaactgttgaaatttactttacagtacagtttgtgaaaattaagttttactctgtgaataaagaattggatagataattccagacaacattctgaaagacacttacgccgtcattccaaagttgaaatgaaatgagggggagaagacttgctgggactaaggaaaaaagtcaatgaaatctgaggttgatgcctttaaatcctcttatattgtaaaccttttgagacaccttttaggagtttcattttttctctctctaaagcgctttccttacaaatttagctactgccctattgtaaccttttcctttgttcactaaatctggggaacaaaaatacagagatgctacatccgtgggtggtatacaaaaatgaaccaaaggatctacttaaattcacaaatttgtgctgtttgaacttggctttgaatagaccttaaagaaggatctgtatattcaattgtacagttaataagttaggtcttttgttttgcttaagaagcaatcacaaatttaaaaattgagtatatgaaaaccagcatcttcttacttgataatctgttcttgtggtctctacataatcatatacttattttatagaaaaaacagatttataaattcagtgagttcaaagattcagtataactctcaggtatggcatttctttaaagaatatcatcacacactgatgaattatagttaggtaagaaactgattttttgactttgggaaaacttttctctggacttaaacgagtgagaaaacagaactcaatagtgtcattaaaaaaaaaaaaagctttctggcaaaaaatatcattgagttcccaattcatagaacttcctttagtcctctgttgctgtgctgttctgaaactgcttttgaagcaggtcttcaaattcatgctcaaatgttctcttcccttgggtctttctaacaaataaaaaaaagttgcttccaatgagaccgctgtttttcaagagtatctctgtttgttggtaggaggggaatgcaagattttctttttttttttttttttgagacggagtcttgttctgtcccctaggctggagtgcagtggcgcgatctccagctcactgcaacctctgcctcctgggttcaagtgattctcctgcctcagcctcctgagtagctgggattacaagcgtgctaccaaactcggctaatttttttttttttttggtatttttagtagagacggttttcactaagttggtcaggctggtctcgaactccttaccttgtgatctgcccaccttggcctcccaaagtgctgggattacaggcgtgagccactgtgcccggccaatttctctatggacttgagccatgatagataagttcactgaggagtaaagaccttctatcccaaagcaacagggaaaagccaaggaaaaaagtaaatctgttttgttggatgactggttaaaatggaagcactgagatgatttgtgtgggctaggttaagagagtagctgaaattcatctgcgcacctagggtatagaaccaggcacgggaaatcattaaaaaaaagaataggacctaagttcctttttggctcatactgagatgaagaataagtgctgtcagatagaactcaaaaccttgggaggttctggtaaataagtaaagtagaaggcatactttataattattttaatcacaagtaggcattttatctttatgatattctttatatagtcttttgtataatatttattatattatttacatattgtcaaaaaagacattgagctatagaagtctcctatagctatagctaacattcaaattatctgatttcacttcactgatttggttggatttgattttctctaaaataaaatctctgtgctaatccaaaaggttggccattttgctttcctgtgtgtggattacattcatttttacttctcttctgctgaattttccgcagttctgaagttattgtggtttctctcctcaccaattcttatcatccccatgaaccttattcaaactttttccttttctgtgaagccttctgtgattactagagttcacttttcttggtttccactggttggtgaggtaataaactaagacattcatttttggcttgttctcactgaattagaaaactttcttaatgagaaggtatctcccctttcctccacctgtaggaatgaatggccaggtttttgtatactttataggctcctttgcctcagggagttgtggtttcagagcccattaagccctaaagaataaaccataaaacaaagagttttctttcctaatgtctgttctctaaaatgaattattaacccagaatgggtaaggagagtgaggctgattgatgctttggagttagagaattggatagcattactggagagaaaaacaatccactttccctcaaatgcagaaggtagcaaggtctctacttgcatacagctccagttggggtaattgcttggcacacttctggaggctggacataaaaaggcaccactttgagaggaacagtgatcatctgggggctgggccaatggtcaacagcaaggaccactgtggagggcatctgtaaacccagctagtgcagtagtgctggcagtcagaaggacgaggctcaatggcatctttgtggggtggtcaagcaatgtcaatgttggagaccatcatggactaaggacttagatttaatgagtcttgtaccaatctagggatgagaagggagccccaaaacttgtctgtatttcttgcgaatttggtgacaggggcctcaggtttaattttctttagaaaaatacgggaatttttttgtacctgaatgttgaggagtgttggggaagttcacctgaacttcctatacatgtagcacctaagttagttcttaccaatatattattgtttcttttttcatttgtgtctgtcttatctctctaagactcaaagcctcccaaaggctagtatcttgtcttgttataaccacaactacaatgacaactacaaatatgtaactggatccctcattgtgcccagcatgtttctttataatgtgtgggttctatgtgagtgcttgtttggtcagctcttcgctacacttcacaaacaagtgggaacctcagggcgcacatttactctgagatatgtctatgtgatatggtcctgacagggcttttttgcccctgaagttctgtgtaatgctcttcttcttgtcctttatttccctacctacccacagttctattttcaatagaatttaaagtccaagcaattgttttatgtgttcactgagttgcccacaaactctgctcattcatttatgatttctgatacatgccatgctgtctctgtctccctgattccatttccccagagagacagctcactgggtccccctgtcaacagaggattcagtggaacccaaagctaagccatactttgtaataaaaaataagaagagatgaccaatctatgatgtgatagaaaaatgatcaggccaaactccgatcacttttgcctatgttagggaagctaacctgcttggtaacagatgttacagaaatatctatcaatcagcattgataacagggtatttatatgtacattaacagtagtgtcaaggattgtttagaatattttctcttggtggccactgggtgtcctcatttacaaagtaaatatgcaatatttagtgaaggtcactggagagaataaaagacactagttttctctttggcccttcacatactggggataaatttattgctgaactcacaagcaggttatatattagtacagtttaaaaaccttcaggtcaaactgttaaaagtttataaccaagagtaacttattcagggtccagacatgaattttaaaggctgtttcctcaacagaggggactgtgatcagctattagaatgatcccttattcatttgaaaattggcatgggattttgactatctgccgagagagccagcagagaggagcagagaaggtcttaatttattcttgaaagaaaagagaacaccaaatatctctatgggatatttgttagattctgtttttatctcaccttttctgaaaactaattaaaaataataatgagaagataaaatatgtcctttgcctaggaaacctgaaataatgtgaaaaacattacaatgagctgggtcagtatactgattatcaatcatttcacatttgaagacaaagaattaaactattcctttatggacctgttatcccacctgtaaaacaaaggtgtgtatgcttcacagggatgttgtagggacaaatagaatatgaggcacacaaggttcctaggaagagaaactgtacatgagatagatttagggcattactagtattctaattgaggctgagtcacagttgtatatgacttgttcctgctggaagacagtagtcaaggccagagctcacacagccaacaaatatgttctgatttgctgctctcagacactgagtctgacacactgctcagcaatcacttactgctccctaaagtggtattttgcatttctaggattgtcattgtctctaaatttatacttatatacatcgctgatgaggttcttcccttgcaaaaagaaatttcagccttcctccaattcaagatacaggcctactattgaatacataacagtacatggccttcaaatgtcatgcctagccaattagctaatcctttcccaaaataaacttcactgtaatattttttttttcactagcatacatccccagcttaattactattctctggcatgttatttcagtacataaattatcaatatgattttgtgtcaaaaccaacaatttgaccaggcatgttggctcacacctgcaatcccagcactttgggaggctgaggtaggtggatcacttgagtttaggagtttgagaccagcctagccaacatggtgaaacctcgtctcttctaaaaatacaaaattagctgggcatggtggcgcatgcctataattcgagctactcaggaggctaaggcaggagaataatttgaaccctggaggcggaggttgcagtgagctgagatcatgccactgcactccagcctaggcaacagagtgagactctgtctcaaacaaacaaacaaacatcccccaacaatttatgcaaacaacatcagggaagctaggaagctctatgagctattctctgccgttcagatatgttcgattgtcttactagctgagcttaacagccttttctgtttttaaaggaccaccatgcatgcctctagtacagcaatctctaacacttaatcaacagttacgtctacagcaatacacaatagccaggtcactttcaccctgagattatactaaaggctcacaatatgctcagagtgtatggaaaagtgtctcatttcttctaaagatccttaaattccttgcttttatagtattatccaactgattaattagtagattcatttttcaactactgtagccccaaagatacatatcggcagagccctcctgattgtattttacccttggccttttctccttttagtttcctcagtttgcacctgtaatttcacttttagaacttctctaggctcggtggctaaacaccacacagcacaggctttatctgatgtgccggcgcctggtgtggtctaagacacactggtgttttgttcttgaagtacaggattgatgttctgaaacctaggctctaacacaaaggagatcattagctcattttaagtgtctcttttcttccctcccagcctcctcctacccaccccaatacttccttagtcctaagcactggcagcagatggcaaccatattccaaagctgagtatacataaaatagtgccatggagaacagagtggcttcaaagttagcctttctattcaagtgggatggcggggacttctggaggagtgaactcatctctcattcatttaatcctctattcattcagccaggaatttgttttcctacacatccatctactgtccagccagttgagggagggtgggcatgaagcatctctcttgagggcccttccagcaggagggcactaagatttctatgccaagctcttgtttccctgggccagctctgcctgctgctgatcaaatcatgccattcctgtaagaggagcttgggaacacagtgtgtagggggtggatttctcaagaactatctccttgctagactgacagtcacatgctgtattccctagacaaagattagacccaggaaaaagatgaaacaaggaggaggatgtggggttgcagaaaactgtgcaggatgttacagtaacgggaggtgggagtgggaaaacctttcctttttgttgtttcaaggtttgctagagcttttgcctaatcatctgtttgagcatcttgaaaataagtatctatttccatggtatctatcaaaaacaggcaccagattatactacaaagttgacctgccatattgctattagaattaaaacatgtagcagcttacattcaaaagaaagcttttctgtttccccagcatgaaaagcagagggtatttgtgatacactttgttttgtaggtctgctgaatgaaaaaaataatcgggtaaaaaattagtacctatattttcacaaatgggcataatgcttacaaatgcactacatcattattttagcttcattctccccacaacattcatttattcattcaacaaacatttgctgagcacctactcctaatttgtgtaagcactttgctgggtgctagggattcagcagtggacaaggtaaacaagattccgccctcctgaattctgtcacctggccaaaataaacatttaacaagtacgctgctagaattttacttgagaaaaaggaataattcatcttacctagtatttcttctgaatctttcttaaacatatttcttgaaggtccagactcctttaactaagaagttctatcttaaatctctctctttccattgttatattcattcctttcttggttacaatgtggagagttcagattgcaactgctatcatttctggggggaatgggggtgggactgtaaccctgagaatccttgcttttcaaactacacatatattttctctgtaaatattgtaccatctaatttgcgtctttggattttgttgattagccatcaacatgtgatttaaggaatactgcatatgagatgcagaaatcatgactcagtaagttattattttaaagctctattttgggatttatacagacttgtgtacagtctagtttggctttcaatctaatctgcaactattactaggaggcttttagatcaagttccatacccatgtgtctctggaattctacagtgagaagcaaaagtgctcaggagttaagagaagcagacgtccgaaattatctccatgcattaccaaaaaccgtgggcaccacggcacggggaaaacttaccaggtacaatgagccagtgactgttactgaatttcttaagattacacttttcccaactactgcagactgcttcagaatagaagaaggtaagtaagcagggtgattacaagcaatcctcctcggaagtgaaactcactcttctaagtttacctctgttttgaattatttcagacaactctcatgccatcaagccgacggactttcaaaaaaataaaagatgcatttctttacttgtaagtatttgtctttgcaaagggctctctgatatggtagcacagaagtttgcacattctaaggatctgatgttttgccctcttcgggtatcccggctggaaggagctacggtgaaagggcacctaaggtgaatggacagattgtagatgggtgcacacaggaaaatgtacagctcctacaatgtattctgaggtaagagagcacacaagtccattccctataatttgaaaatctctcttctttttttattttttagagacaggatctcactctgtcacccagggtggaatgcagtgggatgatcatggctcactgaagccttaacttcctgggctcaggtgatcctcccacctcaaattcccaagtagctggactacaagtgcacaccactatgccccgctaactgttttgtagagatggggtttcactatgttgctgaggctggtctcaaactcctgggctcaagtgataaatccacactggcctcccaaagtgttgggattacaggcgtgagccaccatgcccagcgtgaaaatctcttattgactagaatgcacttgaagacaaaaaggaacttaacaggttaacactagaatgtaatgctataatattaataacactctaacccttccctataccaagaagacaacattcagagagatttgaaacttctttcagccccagtttccttatctgtaaatggggtgttttgtaataagattatgcatattagtcctctttcatttttaggaaaaaaaaacatacaaatgggggaataaaagaaggcaaagagataatggagaaacttcccagtctattcaggcctgaatccaagaagggacaagaagaagggcactggcttttcctcgaagtgaaggatgtaactgtcttacacacaatctcctcccatagatctagggcttttcagcctcagtcgttctcagggggaaaggatggggacctgcaacaactttcacttaggctgcatcaattttagttcatattaataattttcaagcacttaaaactgtagccgacactcaaattcacggagcgctggctgtttttctggtgctgctttaagggctttacatgtagtgttccatcgaatccttctaataaccctatgagatgcatactatttttattctcattatgcaattatgcacatgaggaaatggaaacatagggaggttaattaaaggcacataaaatgcattcataggctgaagttcatgttaaaaagagcaaataagtagaccatgggggtgagaaaatattttctgaatattggaaaacaacacatagccccagtcttagtccattagcaacatgttcaagaaatagctttagcagtctgttatcatacctgcccccaccctgaaggcatatcggagggacccgagaggacatcaggagccattctgcattgggatgttcacagggacctctcctcattgcttctaagttcactcttgggtgccaggtttgagggtgcagattctgattaggatatgtcctggggaagtggctttttccttctgttagttctctgaccctaatgtaacaaaatctttaaacctgtgtcccagaacaacacgcaggaaagaatatgaacctctaaaagaaaggcccagtaatggtaccagtagagtccaaggcctccaggtcaagaactcctgctctggagcagggctggaagtgggggcacgctttgcctgtatcactgcccagtgaaaccaggcctgctttgcagtgcctgttagcatgtcaacccaggattacttaggccacttcaggaatcccaggatctagtcacccatctgggacctttaggtcaggaagaaaatggaatgggctagatttatgaaaattggaaaaaatccagtcaggtgtacctataaagacctacagtatttccctgagaaaatgacatgtatcctttaccctggggttaacttctaaaagttttagtttagaatttgcatgtgtcttttccattagacacagagttatcttttgtagttcaaacttatatgcacctttctttcattgtctcctttacatctaaatacctggttaagatatgaggcaaagagataatcagtgattatatagggaagaacgtgattacagtaaaaaattgaaggacaaagttaattcagttactgctttttgaaattctttgtagtattctacatgccacaccaagcttttttaaaaattctgtactctttggtctaatatcttggtataaaactgataacataaccaagctaaaactagtgaggataaataagtaggaggaaactcatttttagaattggagaggaaaggaaaaaactcctcaaggtcaattttgacatcaactataaattcatttggccttgtgaaattataaagactcatgttcaacattgttccatgtggttgtttatataattttcagtagtgacaaaataatctccttatttagttttacaggtaatttaatagtagaacaaagtatcgtttgattcagttggttccagatcaccatcctacagtagaagtatatcagatacttttgtgtacaggtgggattggcctttggaatgtcttggaccatcacagaaagcagcatactttaagtaaacaaattgaaaccctccctacaaataatgaatttgaggatgtcccatgacaatgaaggtggccttgagaacaacacataggtttgttattagtaattacagagctacctgaattgggcatatcatgaaagaagtacacagaacatggcttttaaagaattatgctttgtcatttcaaaaacaattgtttttaaaaattgttttaaaaattgttaagatgatttaaatgttcaaagtgtatgacacctatcctctgcttagtgttcagaggttactgagggtaaggaactgagttaatatttgtgaagtaataatacttgtaaaacattatttctcataaaaaataatagaaagcaatgttgagaagaagtagagaaagaaccagtataatataattactgcctcactgggcttgggtagtgccttcaaattcctttcacatatatttaccattccaattgccctgtgaaatggaagatctaattccttctcactttgcctatttaattgcagagtctcccttaacactggtttttctcagtctataatgggctaggaactcttgtatcataaaaatattcattactccacttttgagttacccattcattatttctttttaaaacattaaacttgtactttgtaatagttgctttcccatttatcctatgtttgctcctgaacccctctttatggtcttttttgtgacacatctgattctgttttcttgacaacaatcaggaggctagtaatcccaaaacctaaggtaatcttttcctaggtctctccctcgttggtgtctgtggcacctgatactgactgctgatccttcctctccctgatggtctctctgcactatcctggtttttctcctatcccttagaactctcttttcttttcctctatttattcattcttcattctctttcttatcactcatgtaaatatttcccaaggttttgctttccttttttctctcaacaaagacttctttgaagtttactcccatatttatggcttatagtgctcttggccaaagtgtttgctagtcctaatctcacgcattcctgctgtgccccaggaccctgtttgtaactcagtgttagttgtctccactgggaacacctgtggtagctcatactcggcactatataaaatggaattcaatttgattcctttaaatgcttttcatctttacttgataccttggagttatctttgataactgcctttgttgtaactaacactcagctcccagagctgtctaccctcatccacaaaatctgttgcacctggatcctccccattcctcctattaccgcccccttcaggtcaccaatagtgtgaaatactgacagtgctgtctggaccctctccttcctccagttgctccttctcacatccaggctgccaaattagatcttctcaaaatcttgctcatggtaggccctacttaacacccttccacagctctgcaacagaggtgcaaacccctcatacctagtcctgatgcctcatttccagtctttcaaaagagctcaaatggagccatgtctaataaacctacctagatattactgttaactggattaaaatatactttacaaactttctaaattctcagatactggtgatgtgaggatacatattgttttaagattcttggtggtggggtctgtttttctccacctttgtgtcctcatggaactcactgtagtgacaggcacaaaagatatattctatacatacttgctgagtgagtgaatcaatgctccggtgggtctctgtgtatggggacatatctttaaccacgctgcatggaagttgtttgtgaatgttatttgatcttctctacaagactctaagtctctgagcctagggctccagtttataaaactgcgtcctgcacaatacttagcctgtggtcctccacattgaaagcatccactatattgatggatgaatagtcctgactcctttctgttcagagaacattaagtttgtccagaagcagacttagtaacaagcagcataaatggtgggagaaagggcagggttctgtttctgactctgtcattcattatgctgggaaactttcgttataacacttgtgttatttgggcctcagttttctcatgtgtacaataatgggtatagaccaggtaacctttaatcttgcactgctgataaaaagttagaactggcacacattcctcagagagaacaaatgattcagaggcagaagaaaagcaaaaaagaaagcaaaaaaaaaaaaagggattctgctgatgaagtaataaggtatgtgattatggtacctagtgtgaggtgactggtggaaagatccgacttgaaatttccttaaagcaagaagtccttaaagaatcctcatgcttgctctcaatcaatcctaaatgatccaactctaagggcagtagtgcatgtggcctcttttattttaagtaaggatgtgagaagtcttgacagatatggagaagcactaattttatataatgaaatctgccatgaacagaggaagcacacatgaaactgtcactagcagctgtagataagaattaaagatgtattcctgcatgggatgagatggcaagatgaagaacagaaccgtgaaaatcagcattgggccctaacaattacatgtggataatcatatctatgcactgtttgggagagcaatatgacacagtgtaacttgagccaatgggcattgagaccagacttgccaagggacctgggaggattttataagaggacagactgttagagtcgggaagggccacaaatccatgacaaagttccagcatgacacctgtaggtgactctggctccatgaatgaacttttctcaacaattagttattctgagccaggtgtggtggctcatgcctgtaatcccagcactttgggaggccgaggcagacggattgcttgagctcaggattcgagaccagcctgggcaacatgatcaaatctcacctctaaaatacaaacaaacaaaaaaccccccaaaaaactagctggctgtggtggcacaagtctatgttcccagctactcaggaggctgggtgggaggattgcttgagcccaggaggcagaggtggcagtgagctgagattgcactgctgtactccagcctgggcaacagagccagaccctgtttaaacaaaaaagaaaaataaaaagaaaatttattttgtgatttactgatcaaaatcatcactaggtccttcagaatactttctttttttttcctgagatgcagtcttgctctgtcactaggctagagtgcagtggtgcaatctcggctcactgcaacctccgcctcctgggttcaagcgattctcctacctcagcctcccaagtagctgggactagaggcacgtgccaccatgcccagctaatttttctatttttagtagagacagggtttcaccatttggccaggatggtctcgatctcttgacctcatgatctggccgccttggtctcccaaagtgcggggattacaggcgtgagccactgcgccttgccccctcagaatactttcttactttgactggctgtgtggaaggaagggttcttttgcctattagaaaataagtagatgtcttgctttattatatatttggaaagcaaatgtctctgaaatggatataggattcagctcagctgaattataacaatagacaatgttacccaaatacaaatcttcccatgattaaaatgaggcaaagtataagaaggcctcagtgtcataactgaactgttctgttttctgaaaactctgcgctctgtttgtgcctctatggttttgcttctttctattccttctgcctggaatgccattacttctgccttctactttacaaatgcccactcctttatgatccagtttaatttcatttttggtgtggagctctttccacttcaagaggctctttcctcgggggctctgtagcattttgtgcatactggaacactttaattctgcatttatatttaccccgttatgttccaaagtgtggggatggggtcttattcctatcttcgtccctaatcttagctgaggacttggtgcagaatgagggatctgataacatttgatcaatgactgaattaatgactaaatgaatgaatgaataagaacgactaccagaaattactgcattaagtgactatggaagaaacccagttaaattggtgttgtagggaaataataagttttataaaaagagggccaatttaaaaaatagaggtagattaagatacaaagtttcaagacctgtgcttttttaaaataagtgtgtccccaaatgcacaaagtggaaactctaggaaattagagcaaataaaaaaaacgaactggccttccaatgtataagtgctggactaagcactaaaatctctaaataaagggtataaaaggtaacgaaaaaattccaaagagattatatatcaattaactaagaggcagaaaggtgactttttaaaacgggaaagactatctttaatgacaggaaatccacatttaacagatgaggggcttacttggcaatgaaatgacagaaaaacagtttaaatgaaaagataaatatataattccttacagaacatagaataaagcagaatgcagaacactgggggcaacgagagcacttagttgtaccaaagacactctattactgcttaactgatacggaatttattagaaaattaataacaagccattggatagtaactgtctgtggttgttattccattccattttggctatattttctctgcaaattagtgtgaccctaaaatgttttcaggattgtccaacttgtcctaaattccataaataaactctttcagaggatgctgttttttgccatgtctctattacggttcttcacagatggaccatttttgtccttccaaagtctaagaataactctttcagttatcaagacataccaaaatccagttcagctgctcctgtgggattccagttagtttagacacatctgctgagatacatgcatttgaatccaaatgaagcttttgtttgattatacattttgaacatttatggaggttttctggggccaaaatgtttttcattttttggcacaccaaacagagatcttcagttataaacactgccttctgagcacctccaacagaaatccaatcttttcatgtgaacaggtgcctcaggaagtttttggaaggttttacactgaatcagctttccgattggaaactttctgaacatgcagtcaaatttgccaaagagaccttcaaacttgcttgagcagttttcactcatacagacatacattcacacatacagacagcccaagtaaaagcaaatcagagccctgtaaaactgaagtatttttcttaaaggttaaatatcatatgcaaccaaactgaacaaaaagaaatacacaacaggagacagaatgaacggatagcacgaggttcttcattgagcgtgtctgccttaaagccttacctagagtttaagctatacatcctttcagtaaagttttttatttcatctggtttcaaatatatactcaagcattcgcatttttaaacacggcaccatagagtattgctactaacgcctttcaatcacaaacccgttcaaacagttattttgaaacactgccttctctaacacaaatgggtaaaccagatttaaatgtaaaggaagaaaaaaaattactctttaagtcaggggttctttagcaaagccctcatcttacctgattccctataacttttactttccagtttgaatacagcatagactaaaaagttgttatagagtaaaataactttttaagccttaagcctataagtttttacagagtaaaatcactcccccagtgggcatgcctgcaattcaaggggaaatctgctttcaagttgttctaatggccccgaaccagatgctctaagatggccagaaacctttgtctacacccacttagcagatttctggctcgttatcagggactaaaaggtttattcacagaaatgaataatttccttcgaaatatcccttaccctatttacatgcttgcatattccttccattttgttttccccctacagctttactaagggaattaattatctggaagaacaggaacatacagtaagtacatctgagttacaggatgagacacagtatgtcatctattaggcctggctaagaccagcagctgatgctaaatgggaaggaacatgcaccaaatgttttttaatcacaaagttagtaattaattgctctttaaaatacattttatgcttctttctgtctgtgtacatgaaatgcacatttattacatgccaaaaattacaacattatggtttaaatgtgactggcacggaagtccggaaatcagagttaatgttcccacagcaactttaattctgtccgtgtgcacatgtagagctataatagtcttccgttccaggataatacgtatagatggttttgggagggaagctaaagacccatatcctcaactgtagttacaggaaaaaaatcaaaggataaaagctgtgctcctttccacatacgtggataaaaacaatgtccccacacccagtgttgtgtaatcagggaatgaaagaatctgctgtgatgccagcactcaaggggacagtttctgttgctgtgggaacctgaactttgcatttcctgactttggggtaattaaaatgtcagccttaatgtggcattaatggagtttgccataaaaatcttctgttttgttctctaaaaaattgcttaaaagttcaaaatgagccaagtgtactaaaaattttaatcacacagacttgggcgggtgaagcaaatggttgggagggggaggccaaggaaggtggatggcaagagttggaaaaggaagagcccattggcctctgtgagtgtccagccccagcagaatgatgctacctacggagctaaagttaaacccacccacacaacagtttggaaatgtgtaaaggttcaatgaaaaataaataaaaactgttcatgcgtaagtgcatcttggcaaagacacaaaaaatgagacagtctgatgaggccggtataaaacatgggaaggtaagtcaccatggatatcagcttccaacaaaagaaagacatcagaataggtggatctacagcagaagtagggaggacggccacagggaggaaaatcacttctttcaatgggagccttatttgggggaaaacaaaatggaagaaatatgcaagtaaaagttctggtcgcgtctatcacatgtatatgactgtgatgtgctacagcttgatagctgtcaagaaaggtttttcatatggagagcttcgtctgctttactgacttggtttagtcctgcttaagcatttaaagggagcacttggctcagctcatactcagcttgcttagtgagtaactgctctatcaaacacctagggtgttttttacccttcagattccataactcatcttaatgccttccattatcaccatgtgaatttgcttaccattagatttttagcaatggtgaagaggtggtaagctagggggtaatgggggaatattgctaaaaggaaattgtgttagtaggcgcactgcaaagcaacatacattttagcagcaatattaacctcatcatctcacaaaagaaagcatatctcaactatatttcttcttgttttgaataccactgggatcttttgccgaatttgaagaggctcaggaggttaaacagccaactgagaatttagggggtcagacttgtcatctttgctgtaaaacacagcctgtgtccttcatatgcaaaaaagatggtggcttacccacccatgtcagttcatatgcagagctgacttttcttttgtggcgatgctttatccatcatgttttacaacccagtcaccaatatgagtagttgcacattttcaagatgcctgttcagagccaggaatgccgtctttgggctcagaacagagaattccaataagaaatgctctcacaatgagagcaaatccataaacacccctcggtacccaaatgagttaaccacaagcgagtcttccatctacctgggtgtcaattttctcagttttctcatctgtaaattgggaaggatcatactgacaggatatgggcattaaatcatgactaagaataattttgctaaacacatgacaaataaaaaggtgctataaaaattcaagcacttgtgaaagcttggaacaacacacactggtggaatgtttctgaagttaaagagactaacaagtcaagggcactatttttaaatgccccaaatctgttagttctaaataggaactgaatattttaccttaaagaaattaggcttttaaattaatctatggtaagaatgacatttgaaagtaaaaaaaaaaaaatcctcttgaatgcaagaagagcatccaaaaattttaacagcttaaaataaacctttttcctgtcttctctcaagcaatctccaaatggacagatttctgtgaatctttcctaaaaacaattttcttctaagtgtaggctcaaatcaggacaaactacaatccaaatatatttggagaaaagtataatcaatttaaacaacaggttggaacagagaagacttacacatcttaatggcaaaatcaaagtgactgtctaaaaacagctggagatcaggtttctcctcctggtttgtttttccaactgagctcacatccactggcttccccagggccaccaaggagatgtatggtgacaccatactcacgctgttcctgaaacttacttcatgccaatgctaaggcctggccagaggatgcttatgataaagcacaataagtgaagcccaatgctttttctattcacaaaacattcatttttgctgtaacagaagatttctagcctaaggcaattctatgtaatccatacccataaggtgtggcagaaagctgggtaatgaagacctgcatgtagaaactccaggcccttcaccacaggaacgggctattttcctggtgggaagggacagtgtgcacatgcctatgggcactgtgccactctactttccaattctttctgtcattactattacactgaagattgccaggcaagaaggtccaaggatgtgactattaggacggtcctcagaacacagtccctgcttctgccccctggtttctctatagaagcctcaacttcgactgttcaaatcacataggccacagagatttgtctcacgttacttcccttttcattttctagtgacggctagaatatggtcttagcccaaccttaaatagaacaagctctcttcaccccaatcctgccgccagctcatttccctctctttagagactatcatgatgaagcaagtagagaatggaatctcctggaccattgtctcttgccttctttgcagaattttacatttgttctgtcagaaaaataacaataaaagatttagaatctcatttcctaataatttttgtctttgtggacaaaattttatttttgaaataaaactttgcaggtcttatgttactcattttaaagaagaatatgccagttatttgcatgttaccagacatcctttatggagatcagttcagaagagttgttgggtatgttaagactaaaaggaatattcttttggattcgactccaaagttatttcattcctttccattgtcaacacacatgtttctttttctctgaagtattgggttacatttcagaaaaagaaaaaaatctcctaaacgtgatttatcaacttgcttaaaatagaattagaagaagtgactcccagattagtgggaagatggcaaaaataaacagcaaagaagtgatttcaatagcgacgatctcattaagctgcccatttccaaatttagcccttaggcagtttttttaattaaaaaatatttttaacctggattctcattggctgtgtgaagtctgggtggcttctgaattcttggaagccattctcttttcttctgtaaatttatgctatcctttaaccacttcaaaataaattaaaaactggaaagacagaaattcagccaagctacatgagactccaataactaatgcaaatctgacttgtgttatgtaatttcaaaatggatgtttccttgtgtctaactggccttctgaggtccacatttggttgttcaatttagtaattgtggaagtgccattatccagatcaagaataaatggataccagcaacaaaacttcattttctgggttagtgttatgaaaagaacgtgttttatgtaattaatcagccctttaaggccaaatggcatgtcacctggcttttaaatacactctagctttgcaaacttatagatattggctgaatgaaaatggtggcacattacttttggctgctttagaagaccaaatgcaaagagctcgctctgaaagtagaaaagccagaacccagggtagaagcactactccaagcactgcaaagacaccatcaccttagtggtgtactcacaatcagatgacccggtgtgagcgtgagagtttgtcagtgaatgtgttgagtggatgagggctgggtctggagacaaaacagcttcaaagttcaggcagggaaggcccggcttggcgctggatccacccggctgagtaatctcattctcctcagatgccttctggttttcagctgtcttgggtttcttcctgaaaataaacaaagggccctttgaaggaactgactgcatatttgggaaaaggcatttttagaatctgttaaagataacttgattttttttttctgaagggggatgggagggagtccagtatgtcccttgttttaaaacaagctgattcttgttttttttccctccagtaatggcctaactgggaacacatgaaagcatatgggccaagcaaacagcaccacatttggactctgttggctgcataaaaagaccctgtcccagaactttagacagcttgagctacgtatggctgacattatccaagaaagcatccctcttccccccttaggagttttaacatggtctggaaaaatactagtggaagttttaccgttctagcatttgtcaggaagcttagagacaggactcgtggagtaatgggaggagcactggactgggagtcaggagacttgagctaccgtactagctgtgcctctaacttgctgtgtggccttgggcacctcacttcacctctctgggcttcagtttcctcatctgtaaaataaagggcttggattagaaggccttaaaggttccttccaactttaaatttctactcatggactacattaaggaacattcaactttcctgctcttattaagattttattttaaataaaatttcaaatcacaatttaaatttgcagcctgtacggatgagggggtagtgatgggaggtttctgttagagtagcaagtgaaaagtgaaaagaagagcttagattctagtagctaaagagggaaggtgtcatgcagagatttttctactccaactctttactcatcctacgcctaagatttttgatttggtgcatcgtcctggagtttagggtgtgattgtgtgtttgggacatgaggaagagaagggtgaagggaattagaaagtaattgttactaattgttatatggggtcaggaataggaagtaaaacagcacagctatcagtcagctcaggtctcctctccccaggacaatgcaactgatatgaaattaacaaatacttagcttatactacacagaccctagaccacagccaaactggtttattagtaatagttcctgaacatttctccaattcccttggatttgtgtctttttctatcattatgtggacatgaccagaaaaagcatttattttatttgtagaagactatgtgtggtacagaatttgttgtaagtagatttgtttccatgtttcccttgtttctgtgagcatggtaatgtacttgttatgcagaatattttgtatttaaatttgttgtgctgggtagttaaatctgccctcgcagaatatggtgttatgattagtatgctgtgttttcagtccaacaggttgtgaaataaaatctgtttcttcagagggcaggaggcagagatggcatggcaaagattagaatagaggtgaggctttcagacatctttttcagtatggaggaagccaatacaagagaagcaacaaattataagaccttatcaattgatttttgaatggtgactatgggagtaacccccaaatcttgagtgtctacatggaccctgaaggagctggtattctgattttcagtttaaagatgtagccaagatcaaagttgctaaagcccaactcctttattaaaaccaatgctttctctaaggtccatatctctatcactgttgtctaccaccaggttggaaacctcagggtcactatacaccttcctctgccttaaagccaattcatcagtaagttcttacagttctgcttccttcatattttttctcacatctgtgtttccattccaatttcactgcaatcacctactgctttttatctagctgattgtttactaactggctctccaacctctttcactcctctagtcctgtttctttgcattcactaaatctaagatgactacattagcctgacactcaaggtcagttccgtatctcttctaacttttctcatgtgtcctgtatattggccatactgtaccctcagatttcttgaatatcctccagaacatcctgggaatctacattctgggctctacatctttgctcaagttttctcttactttgaatatcccatatttcatctctgccctgttgaaatcatacttattatccttcatacttattaaatggtgtcttcatcttataactgtcttgattcctctctgccaggtaggacttcactccccacagtgaattcctccctaggtctttctccgaaatgcctaagctcttttttttcttaatcttatttcactcactcaattttatttcaataatggctatttatgtgcatatccctcttgtgagactgtaagctctctgaaggtaaggaaatgtcttagttattttagtattcctagtgttcacctattcttttcttcttccttctctcctgtcattcattcatttacatattcattttacaaatatttatgatgtacccatgatgtgccaacatgggctaaagaataaaacaggactggttccttccctcccagagtttactgccttgtctatactattaagcaatgtagcttagacaaagctgtcattcaataattgattgtggacagaatgaaatgaagctgaaattaaagtgtattttaagaacggtcatagtctgaatcccaattaagtttcctactttttatgcagcaaggtagcaaaactacctgactggctgcttttgctttaagtctgtgaggggtatttaataagagcaggactattttgctcagtaaggctaggctggccctcatgattcatttaaatatagggtcaaaacagtaatgacatatgtcacctagcagaaaaaagtgtttatttttgatattcatagacagggcctaggatactttcagatgtgtgcttcagaaaattaagaaagctttctttcaaacataaggacatagcaaaaccaccaatatattactcttttatttttaacactgcaaaaattatattgttcttcatatcaatgcccttgtttccttccctagattcgctcttgtttcctacctgacatcttgtatcacaccctcctgttgcctcagtgatcactttgggagaatattgatagcacagaggcattggagctacctctataaacaggaaatgttagcaactcaacctttttggctcacccccttatttgtcttatatcactttacttacccttataccactgggctgtttcccaac

SEQ ID NO: 2212 - DNA, 286107 bp, Homo sapiens
  source 1..286107: mol_type = genomic DNA
tttttttgcaaagattgttggaaataatccttctcttgtacctagaaacataggtgcaaatttctgatatctttgttttatctgcattcctgcctttcatgaaagtccctcttgattgtgctgaggctgtggctcagcgaagacactgaataaatacgatagccactgttgcttgttgcttgtccaagtcttcctggcttctgctgcaagagggggatatggagaaggtgggccagggtgtgtggacccgggcagaatctggggaagaagcctgccattcgtctttctttcccacaccaccgaacccactgcccttcccacccccacagcccttttatgaaatcagacaacgtggtaggtggaaaacagcagggcctttcctctgggttttcaaccagaagtgatattccacagttttaactggttactgtgaagtccaagcggccagaattgtgaaaatgtccactgaaacactgcaagcggtgtacttaaagacagtaggccttttagattttgttatatattttttgtagtgctcttcacaagtggaaattttttttttttttttacttttttttaaaagatttttttgtaaagaagggttgtatttagaggccagtagctagagatccaaccagtggacctcttgaagcactaccaggccttaaggccaccatccgagggagactgggaaaactattattcacccaagcctccggaaatgtaatgtaccagcaggcaaaaaacagttcttcatgtagtacaaaatgaaacgaaacaaaaacaaaaacagaaagtaaaaatgaaaccaaaacatttcttaaattctagtgccatagcttttttgtttgtttgttttttgttgttgttttgttttgttcataagaaagagagaaagatactacttatccgtcagacacatgcatcctcatgtggtcgttgaactgctcgatttggtcaaactttgctgggcagacggagcagacgtaagtggtcccctccgtgcaggccaccacgcctggggggccagcgcgggcacctgggggtgtgcctgcagggggggtcccattgctggcactgtgcagggccacgtgtcgctccaggagggtcttgtgagagaacttctttttgcagatgtagcactcgtaggacttctctccccggtggaggcgcatgtgcacgttgagggagctcttctgggtgaagcgcttgttgcagatactacactggtatgccctcactcctgtgtgtgtcaccatgtgcttgataaggtaatcctttaaggagaaggagcgccaacagatgctgcattggtggggcttctcacctgttgatgtaggaagagacagcaagcaggacagagcgagacatagcaagggatagagaatgaaggacaggaaaaacaagacaacaaaaaagaaaaataaaacaattaaaaaataaaatttgattgcttaatggatcatcctcgtttggaaaaatccaggccctcctagcctctcatgtgcagagaaattttgctttatggtgatgccaggacagttttgttttccatttccctgtgccataaaacggctttcttggaaagctaccagatattccccactaaaagtcttcaaggtcactccgtggaaaagggagggctacttttgaagggggtcactttcagtgtcctgattaggggatttagtgtttcccattaacattatcaaacaaatagaagaaataagagagaagaaagatcgttggagacatggggtgctctagaatccttgagaactaaggatattggtcactatagcttggttccttggggtaagtccccacttctagtagtctaagaaatacacctatgtgttgattgtgagtttggaaaatatttgccaacacaggaatacgttattttgaagagctatactttcaagtttatctattttagacagaaatctttctaaaatataacttaagggttaattgcctgttctctattgactgtagtgagctgcagattggcctcatcgggtgtagaggctgagtaggcggtgggcaacatgatgatatcagactcaaatgatcctattcaaatctgggcaccaacacactacactccactctgacaaatcaccaaatgcctctgaggtatacagtcctacttacctcattgtgctggtgttgacataaaatacatatgaaatcactttgcagaccaccaagagcagtgtgggaatacatgcatggtattcttattacaaggatacctcccacccccattaaatgcttccatatgccttttgaactcttgggtcaatttttaaaatagttttcctgcgtcctcctttgctctcagcctgttggcggaaacccttgtttttcctcagtttactgctttggtttggcttagaaaccaaatgatcaagtttgttacaaacagtaaggtaaataataatactcagtgcatgaggtattcttaaagtccatgggtccgtgacatctctttaagatgattacttaaagacttgttttctttgtgctgtttgttctcagctctgctcctgacaggtgagatgaactgcgtgtttggtccatctctaccacctcattcctgactgcccagtgtaggccctcacctcagagaaaaaagtccttccatgatccaaactaaaactgaaagcctctgaaactccttaggataatatttcaacatttggactatgcatcaaggtaagaagtcttttaaaatttgagctaacttccacttaaaatatatgccttgactgtttttcattttttcccattatgaaataggagagctttgatgtattatggtaatagcagcaatgaaaacaatcaccatgtattgagtgcttactatgaagcaaggttggtattaagtgctgactatgtagcagggttggtattaagtgctgtatgttcatgatccattttattaaactttctctcatcaggaatttgttgttattgtgttttcaaacataaacagatatgttttgaagcacactgaccagacagtatgctgcgtaagatcacatggttagaagataattttacttttagattaaaacaggaaaggttagggaagcctcattgctaataatctcaatttgctgaagacttcagtctatgcatagtgtttacattggtaccttttttttttttgaagtaagagattccctaagagagacagtcatgcatgtttttagctgaaacatttctgtcagctgtaaacatgcctggaagtcagctggtctttgctatcctcatgctttcagacgatttatagaggctatgataggctggccaactatcatttaaaacatgtccacctgtcaccttttatgggaagcgtgccttaaattccagatggtattttggctgctaagaagttgaaacttcacctatgttaaaatgctctgctgtttgaaactttcaccttctgtgtgtttttcctcgaggcaaggtcactgatgaagactttattttcacactcttctaatctgtctataaattgattcctcatagttgtcatgtttctctctatagcatatataggtatgttgtttgtgtgcatgtagtattggttctaccattaattatccatgtgaccctgggctttttaagtgttttcatttctctgggtttatttcattttctgtatgtgaagagttggaccaggcagttgcacatggtcctttgtggatttagtggtcctgagtccgtggtggactgcaacccctgaggactctagtcctggccttgtcagtgaatgacccaagggcaacctacttagtcactgaatgcattaacagtctcacattttaaataagacaaagtatcctgttcccttccctgccacagaacaatggtatgttacttaataaagagaaatgtttgcaaagaacttgggagctccttaaaggaaggtgctctctataattattaaggtgctgtgatggtgaagtgtaggtatttcagaaactgtcttactaaatggggtatattttcagattagtgaggtgctcacaactttcatttctgtatgaatttgaaacgcagtcactcagcaggaatgaatgattgtgttttaagaaaattttttttcccactattttcttgcatattacttacagcaatcccaaaatggttttagacattatgcataaaatggatgaggtctgtcgattgttgctctccaagtaaagaaacaaaaagtgaagataaatggtcagagatggttttccaggtttaagcctatggtcaggaatggcaagtctgatttgtcagaaggggacacaaagtaaaaagtggataattgaattataacatcaaggggaaggtcatataagttccttcactttaaatgatccattttgggcctatacagatgtaggagtcagatatgaattccatttccttggctgagtgacttgggcatgtcatttaacctctataagcctcagtttccttatctataacttgagaataatatagtaagtacctgtctcgtgaaggcgttttgaaaattgaagagataaagcacttagtacagagcatgtggtcattttaagaaaaattaaactgttccattcatcacaaaggaaccaaggataaatgaaaccaactgcaaaatgacttgcatggcatatggaagtcaatcctgaatttttaaaaaattatttcagataatcagtaaaacaagtgattatattgcagctatgtaattcagagttaaaggtatcgtctactctctcaattacatatgcgaatggcaagaagtggtatatggataaaatgtcagcacagagcacagacagaggatttcctaggaaacccgtgactgagcactggaggcacagaaaccaaacagcaagggaagaaactgagggggaggcagtgccctttactgccttgccaagggtgttgggcgtggtaaaagtatacgtttttctcaatttttcaatgcctgctcatcaccttcttctcaaggaccagctctgacacttaactctaccatgactgaaaagtgaaaaaaaaaaaaaaaggaagaaagatcctgcttaggttagaagatgcagagggttctgcctgaagctcacaaagttcaagtaaaagccatcctaatgggtaaagacaccccaattttgaataggaacctcttgcactgggggctcagcaagaacccacttattctactgatttttttcccctcattttaaccaaggcttctcctgagctgtgaaaaagacaatgaatgctgttatcaggagatttttcagaagcactgttcctacctgactctcctgttctctctgcctccccatcatctgccctagtacaatgccctcctctttcgtgagtacagtgatgggtcaaaaaaccaagacagggtgcttgatgagacagcaggcagcaaggaaggaggagaaagaggagaaggtgggtagcagaaggtggccactggtgaggaaagcagaaggaacacttgaaagtccaggtcctctgaatggggaacatcaagacacgaccagaaaatggggaaggttccatattaacaatggaagtacattcagatggaatcatatggagcttttactggctgcagagtctagtctccgtcaagagacgtctgtttaaaagggggcccacacggctgggcaccgtggctcacgcctgtaatccctgtaacttgggaggctgaggcaggtggatcacctgaggtcaggaggccgagaccggcctgaccaacatggtgaaaccacatctctactaaaaatacaaaaaattagctgggcatggtggtgggcgcctgtaatcccagctactcaggaggctgaggcaggagaatcacttgaacccgggaggtggaggttgaagtgagcagagatggcaccactgcactccagcctgggcaacagagtgagactccatctcaaaaaaaaaatggggggcccacacacctgagatatcagcggtgtgattgcctgccagcctttctgttcattccctgggatgtgatcctgttgccagcttggactgtgaggctaagagggactgcctattgggaacatgctgcattcacaaaatatctgtggcttcagtgacaactaagatattttagttttaagcagaactttggagagtttcatccatgctacttgacttttcttaaaattttgtgaatagagtggatattaacatccccagaaaatagcatctccaagtagagagttgtactaacatcttgaaggtcatctaagaagtcagtagcacctgagagtataatactagcccaaccagattatcttcctctcccttgttaacaactccttgttctctggattatgctgcaaaatgtatgatgctactataacacatattaatggctttgatagttttacagcattcataattaagtgttttcacataaattatgttattcaattcaaagagcaatcatgtaaagtaagtactacagatctgaaaaactgaggcttaggtcagttacagaacttagccaaagtgactcagccagaaagtggtaatatcatggccttctcactccaagccttatacttgttactttacacccactggcttgatataattaatagtccaagctccatatgaggattaacacattatcttcatatgactattatggcccaatcaccaacattgttatgctactattgttactatgtctatttacactgaattcatggctgaaatagctgaacttctcaaagtaataagcaaaattaccgtatgtgcagaggataccaatgggctaaaaacagtcaccagtgaacgggctgttgataatatgattcagaaaacgccaaaatatttatctcttgtgggtaaaaaaaaaacacgaaagtgtgaacacagatatgtgtacaatatattctatagcaaataaaaaaagagaaaaaacaaagaaatttaaaactcttgctgtgaaaagaatgtatctgtgtataagtcccttgaattaaattctcctggaaagcgtgttcacattttaaaattttcttttatttattttatttcaatagtttttggagatcaggtggttttcggtgaatgtgcacattgaccaaatgaatgggcatgtgaaagtgtgatatacatgtatatatacgtgtgtgaaatgtatgtctctgtgtgtgtgtgtttccgctctcacagagtttacattctaaagggaaggtgtaaagataatacatgatgatatgaataatacaagtcagtcctgctaaataccagaagggatacatttgccatgtgacctatgtaatttggaagactcaacttacctcatatgtgagtgattagtttctgtgatataatttatccactacaaaatcaagctttgatccataattttgatttactttttctaaacagattcttattagtggaattttaaaaaatgttatgtaacaaaagcaacctgatgccattcttctaattacccaggctcacctctctagggaattgattctcaacttcagcatgaaccagggcttgttacacagatttctaggctccattgcctgagtttctgatttaggatgtctggggtgggggtgaagggtgggggaacataatttgcatgctgctagtgtagggatcacactgctccagggttatctttgaatttgccctattgcttgccttccacatccatgttgacaccaaggcttatccttcttgtattctctgtctttccctttcatttccattcctttatttgacttctgcttttttctcttgatgaagggggtagaggggagcactgctttcttccctgacaggatggtttgtattatctttgtttttttctctctaattctgttgctttcaaacatgcccttaactcttagtttcctttctcacaacttttatgaagctgcagtaagtgaatgaaagaaactcctagagataaggaagtcctccgtggtttgtttagcagtggataaagagtggttaggtgagcaattttcttttactgttataaaaattgttaagaaataaaaaaattcttgttatgaagaatattcaagagcaatctaaggagtataaaggagtttcagagtttaaattccaaagaggaaggacacatgtcaagcatgtattattcagagacaggaaatagagcaaagaaactaagtgtctcctgggtagtaggggcgaaaagtaataatgatgaggatttttaatttttctaattaagtaacactttgcctcttctgaaaagctctcacatgcatcatacgtttacatcaaaaggcagaaaaaatcatttttattttaaactcaaagaaatagacagttgtgaaattaactgatttgttgaaggacacacaggcatttagaggaaacaaaactggatccaaatcatctaattacagtacaatcgtctttcatttatgcctctactttaaatttttgggttataatcactatgaaatatgctttacaactaaagcttccttgattcttaaaggtagagcttagctccaaagccaatatgatggactacttctttgtctcaaacagattttttttttttttttttttgatacagagtcctgctatgttgcccggggtggagtgcagtggtgtgatctccgctcactgtaacctctgccttctgggctcaagtgatcttcccatttcagcgtcccaagtagctggaactataggcatgcagcaccatgcctggttaatttttatagtttttgtagagctggggtcttgccaagttgtccaggctggtctcaaactcctcggctcaagtgatccacccacctttacctcccaaagtcctgggattacaggcgtgagccaccatgcctggccccaaacactttctttcatgaatgtggatcattaacatagagcagtacaagattttaattggaatatgaatcttataatttattctcttcaggtttttttttttttttttttttttttttttttttaagagataggtacccaggttggcctcgaaactcctgggctcaagtgatcttcccgcctcagcctcctgagtatctgggactattggtgtgtaccatcacacacaatttatatctgcagttgttgaaagcaactaccatctatattaaactttggagttactgaattgctaagacagttactctgcaggtctattggtttgcatagcagctgtaatggagagaactcaaatttctttttaactttgtcaagctattctttttttttaggactctttttggttagagtatgggtgggaacacagagtccaactctactcttacaagtatccccgtgctttctagaatctttttatactaacatttggactttttgctttgaatttttatcacttccactgggctcttggaaagttttgaggctccatttttttatgttttccctagaaattgaaaagaactttgtttggaaatgcgagctacaatgaacccaggtcttgaattatttccacatgttccggctgtcttgctttttgaaatctagaccaattgttctaaaactttgttaggttaggggatccttcagttagacaatagtcttgaaagactgataggatttccaaactgccactgccaaataattctggaatgaaagggaagagcattacttcttttaaattaggtgcctgattgatatatgcacattattattttcagatggggctatattatacacaccattacaataacattcataatttactgaggatgttcataatttactagaaaactgaagtccacattttaagcataactcagatttataaaatgactctacctatagcttttgcatctgtgtctgagtgcacaaatcctttgctggttttcttatgtccaaatctagttatctcggttaaccacagaatccttcagtgaatccattggagaaatgtatttatacatcacgaagatactttttggtagtacattgaaaattttatgttgcaaatttaaagacttattttattatgtgatctaacagaatgtgtgaattttacatctgataggtctacttgaagagatgtacagaggggagagcagatatgtttatggatccaagaccagcaaagtcaactttggttaaggagatactttcacagatggtccttcctgcacccctcccccatgttccttaatttaatggcttataaatcagctatccaggggaggaaaggatataaactatgtgacagcactctataaatcataagatgctacaaaataaaaacattactatttgattaattcacctaataatggtgatatccataccatatggaaaatttcttgtgatttacctctggttattagtacattcacatttatcccaagtaaacaaagcaactcaccactacccaagtttcttcataaattcagtagtgagtcactctgtttatttggaagtgtgaatactgtgatctttaaaaactgattctcataaaagtacatacattaatttacataatgtcctgacttacattaccctgcaaagaaggcaaagttcatcttaagcaacgttctgtttcagttgtacaattccatgtttgatgccttgcctctatctctgttgctttccttcccttcagtccccaatctaaacttcactgttttatgtcttctctcttggattcctactagctgatctgagaaacaaggttgttttgagaaactaatttgttttcatgtatcagaattcgagtatgtaacttttccctggtaaattatttgtcatttaataagggtattctgaggccaggcacagtggctcatgcctgtaatctcataactttgggaggctgaggcaggcagatggcttgagctcaggagtttgagaccatcttaggcaacatggtaagaccctgtctctacaaaaaataaaaaagttaaatgagcgtggtggcatgtgcctgtagacccagctacttgggaggctgaagtgggaggattgcttcagtccgggaggttgaggctgcagtgagccgagatcatgctactgcactccagcctgggcgacagagtgagaccctgtctcaaaaaaaaaaaaaaaaaaaagaatttcaaatataatgatcatcactgttataggtattcttaggtccaagagaatctaggtgacatcacaatcgcttatgtgctcacttatatggaggcacatccatggaatgcccaattctatgggaattccatatctctgtaccactatggagctatgaaaaaggattggctgagagatcagaagatcttagctctggaatcatagaatccagggatgaaacatgatcttgcccatcttgatgactgaatcctgtgtacaaaatccctaaaaatgttcatccattctctccttgaatgcgtctaattacagaaactcactccatttaaaggcagtctatctgatattagagcagatctgattgttaacaaaatttttcttttattttgtggaaaggatctcctgatagcatccaatcattggtctagttccaccttttggagccaaactatacaaactgaatgtctcctcctcttaaccatcttaataatagctaccacttatagagcacttattatatgcttggaagtactctaaagacttcacatgtattaatttattctcaaaacagcactataaggaaggcgtatcacgattattctcattttatacacaaggaaactgaagtatagacaagttaagtaatttttccaaggcgacaaggtttagtagtagctaagcctgaatttacacccaggccatctggctgggtgtaagagctcaagctcttcctgactacagtatgctgcctctgaaacacaaatacttgaatatggcttatataatgacctgagtcttctcttctgcagtctggacatccctaggacatcccttctccataaagggttcctgtgacggtgtctcttggtggcagggtgctttgttcttatgatgggaggaacacagttggggtttctagaagaggcttgtggtggggtctgtttaaaatctgaaagatgatcccaaaccttcccttctacctgctctcttaccttgccttcccacagccccctcagcccctgctgccaggcctccaggtggggtgacactcacctgtgtgtacgaacatgtgcttgacgtagttctgtttggcggtgaaagtcttgttgcagagagtgcactcataaggctttttttcgccttgcccactggctgtgctgtggcctgcggatgaggccaggggctgtggcgctggcagctgtgcagtaaaggtcgacagaccgggctgggacactgtcacaaactgggtctgctggcctgccaggggctgtggcaggctgaagaggaaaggcttggggccactgcccgcgggctgggtagtgaagagggctggcaggtaggtgttgccagctgtgccaatgacctgcgtgttgctggtcaaggtcagaggcatcctcaggttgctggtgagggtttctgtctggcgtaagtagagctgggtacttggcaatggctgcccgatggacgtgttgaccgaaggctgttgtaggacgctcttgtcggagctgttgctgacagtgataacagtgctgtccatctccacttcattgcttctctccggagaggaagcacctgtttctagctggtttgtctgcggaccaccctcagcgggggcttctgcagcctgctcgggttgggtgggttcagcctggctgtcccgcgccgccccaggcccaaactgctgctccaccgagtcaggctcggtgcctatggaggagctgacgcccgagtcgaagctttcacctttgggctcactctcggtgccctcggcctggtctgtgtcttccgtgcactcctcggattcgttgcgttccaggatctgcaccctttgctgcccgtagtagtcgtaatcgtcctccatctcctgcttgatgtggatgttgcccactagggtctggatgcgcacaggccggggctgcttgcggcagtgcgtggtctcgggggtggtggacaggtagcgctccatctgctgcgagcgctcatggatgcgtgtgatccagctggggtcttccatgtggtggtcgcggggcaggccgagcgcagtctcgtggtggctgaccactgcgccgctgtaaaaagagcgctcgccgctgccattctgcatggagcacgcgtagagtgccgagtagatcctgtccacgctgtgctgtgggtggctctgcaggtagcccgactccgtgtcgctgctctggcctgacgtgcctgactcgggagtgccccgcggcgtgtcctggcccgagtcctggatccccgggaacacatcgcccacgttctgtgacacgatgcgcgtgcactcgtcgatgactgttttgatctgcaggatgctggcggccgtgaggatctgcagagcttccgactgcgagacccgtagcacgccgctgtacatgaagtcaatgagcttttgcactgactgcactgacaccaccgacgggatctcgatgtcgctgtagccaagcagcagtttgtcctggaagaaggggctgccggctgccagcacgcagcggtgtgcgcgcagcatgctcccgtggatgcgcaccgttacgtcacagaagtggccacggttgcgctgctcgttgagggtctcgagcacggaattgctgaagttgtgaaggttgatgctgtgaatgcgctcggtcatccccttgcaactgatgtcacctgcagcatgtcaacgcagacacaaaacagggcatgggtcagatctagctggttgcattcctaacacctaggtttcaggtgagtaatgctcatggctcctagaagcactgcccttacatacgcaagtggggagatggacaggctgcggcatacaagctgtaggtacgatgacctgagggaaaaggaccttgaattttgctccaattccggcctttagtgccgcagccattttgggtatccatattaactccccagagcttcggctgaggtagagtggcctaataaccagatgatttgtttgcctgctattcctacagcttcagcaaagaactgaaaggcaaatggaagacttgttcttatggaacactaaacctccactttatttttatttatgtatttatttactttgccttcactttagacaggcctaagcccagattctttgggaaagtttacatttcccccaacttatcaaagtcccttattttattcatacacagtgaccatattcatagttaacaaataaacccccttcctattaagtcatatggcatattatcaaaacccacaccatgtatgcaaaaattattggaaaattcaacccagactaagatatctaccaaacagtcatgatcatgctttccggatgatggatgggctacagaaagcaatctgctagctaaaggggcactccatggctgctttctgtatctactcattcttcttgtcatctctgacaacctgtttgagcactttctagggtggttgcatgtgatatggaaggttttctgaattttctgaggcttaatgaaggaggaatgttaaaaaggtcagagatggcagttctgacccaggagactacagtacattggtgatcatatttattatgcaaacagggcactttcaagagtgaaagagagcattgttaataattaggccaggatagcaggagtaagccagaagtgggatatatgatctccttgggtaatagggtgctttatgtacttgccacagggaagtattaaacagctcccaggaggaaggcaacagctatgtggaggctgcggatagcctgacccagcgccaccctataacgtaggctgttatggcaagggatactattgataagatttggattcagaatgagaaagaaaacaggtggctacagcagtagatcttagggcttttctatttttctagctcatctctcagatggctctagagaatccccctccaaataattcttcaatcagattccccattcttgcctttacaactgaacaatcagcttgggaaagtgaaataagtgggctttcaaaaccaaatggcccaagcactgattgttggcctggacccaaatctctctgtcttgtgagaagccacctgagaggtaacagcctgcagataggaagaaggcctacctcctcaaactctttccgctctaccttgcgatagaagacttgttcaggaaactctgagttcaatgagcgtttctaccttgcttcactcaatcaccctcacatggtatgagcttaacttaataaatgttcaataatacaatttgcactaatttgtataagagcattctttctcgttctgactctatcaggtctgttatgtgcctaaaatattgtattaggctacagattccatcgtttttacttatataagacaagttctctttgccagattaaagaattaaggtaaatcccctgtaaccatgtgaacacaaaatatggccccaaaagaaggcacaaataacccaggaagggctgttcaggagctcaatcagcagcagaccaaatttcaagttcttgctgagttcgccatacatacataccatgatagtaatcacaagataacattttttaggggttacagttctaactgctttctgtatatgatttcatttaatcttacagcaaccatgggaagtagatgatattattcccattttacagatgaggaaactgaggccagagaaactaagaaacttgctcaagtacacacaggcaattgctggtagactggcatttaaacccaggcagtctggctctagagttcaccctcttaactgcttcattatattgcatagtttgccctttactgaggtctggcccttagggatccacggctctgttgtaaagctgtgtgaaaggctttgtccactactacctccagctacttctatacctatccgtgatttagtgtggcttttatgtttttaggctgtgatgctttgacatagcctcagttgtgtaacttaaaggacttatttttttagatgtcacagtgcaagaagtaagacaactaactggcactatggtttaggattttctatatacaattttactataaccaaggtctctttcatttaagtaaaacaataagcagtaaaactggttgtgtctgtgatcatctctgtgtaggatggatttattacaacatttttttctacacaagtgaaaacactctttaaacatacatttgctcataacattagttacaacaataacactagagatgtcatatatgacagttttctttcagataattctgggaagtagccctatcacaattatcacaataattagtatccatgtagtgtttgactgtgtatacaacttttttacatgtaacatctcatttattccttacaacaatcctatgtgtgttctgaacaggtttttttttgttttgttttgtttgttttttttttttttgacagagtcttgctctgttgcccaggctggagtgcagtggcacaatctcagctcactgcaaccttcaactcctgggtttaagcgattcttgtgcctcagcctctcgagtagctgggattacaggcatgcaccaccacacctggctaatttttgtatttttagtagatgagttttcaccatgttggccaggctggtctcaaactcctgacctcaggtgatctgcccgcctcggcctcccaaagtgctgggattacaggcatgagccactgtgcccagcccttcaggacaagtcttattattgctatttcatataagagaaagtcgaggctctcaaaatgtctaaatgacttgcccaaagttttgcacagtagcacatggcagtgttgggattagaaactatgcctcttaaagctttttccactgcataacagtggatcactgaggaatggaacttgaagtgcccaaagatcgagagttatcttaattctcagcagagaaaaaagaaagacactgaaagtaatgatgaaggttgctttagagataagaaatgaacacagataatcacacacacacacacaattccatgagaaaaatccaaactgtttgaccagattggattgcaaattttgttcatctaaacaatcaagttatctactgaatagtctgagttaagactcttgcgataatattgccaccaacttcattaaaaaccacagagacaaacctaaacctgcacacgtacacaacctgatctgacatgcctggttgaattttatacacacaattcttaaatatctccctgagtacactggccccacactgcagtgaacagccatgaaaagctgaatcgtttttgctgatatgagtacagatgcgaagggggaccctgcctccccattcaagcatgcctcattcctccagcacacaatgctgaggcaattcctttcccaggctttcttttatttttaacactaatacagtgggaaaaagtttctgccacagcaaggcaaagtccaggcttttgtgagcatgtccttttcatccaatgggcattaatgtatagattccaatggaataaatctgaaatactctactgtagaagatttgtcccccattgaaaacaaatcttgattagatggttattcagggagtgtataggaaggaatggtgtgaaaatgctaactctattctttcttagattggcactgaataggcatttgggctattcaagaaaaaaaaaacacacacacacacacccaaaccccaaccctatcaactgtacaaaaccacaaaactttacatagattatgtgatcatgtgtatttggggattcttccccacccaaaataaaaaatgcacagtgttatgaacacaaaactgatggcaaaatgaaatagtgataaaaatagttctctgtgttttaaaataataacttacctcctttttactagagtaaaaatacagagtcagcttgtgatggcattccctcaaaacatggaaggaattgcagtaatgaaagtcatcatgtattctaagagactgttctgcgagagcacaacacagacggggctaaagcaggggtgagtaccgaagggaaaatctgcctgtggggaattggggatagagggcctgactctctgttttgcaggaacgttgctcctgcctgtcccttaagctgcaggggtccagggataggacttagcatgagaataaaaagctgcctgctcacaagagaaaatgagcaagaaaggaaacagcaggcaatacaatctcttttaattaggtgtgaaatccagttctttctcaatcaggagagcaaaaggatatataaaatgagactagtgcaagggtaagatgctacagagggggatggggatttgaagtctctggacttggaaggaaacatcagctctcaaatgaaaaccaatataaatttcggtccagttaataagcctaagtcaagtggcagggccagaaagcccttgagctttcaatttggggcaccagatgaggttagtgggtcttgcacatgaaacagggtgcagcttgccaagttagtcacactaggaaagagccagtcatctctggagaaaggggggatgtattttggtgactgagcccccttattctccaaaccccctgcctggggtaagacttcagttacatgtactttacctcctcatatatgccaagggagtcctgctgaatccctgcactataggaggtatagtagtttcttgctaacaggttccatccacagcaaatgactctgcaccaccccactctctctttctatctcattagtatcatcacagtcttgggaggtggctgggagcactggagaaatcacacatgcaagtggaaggcagcaagcagacaagatctctttctcctatcttggctctatatacctagcatatcccagctgctattacctctgtagtgagactagggagggtcatcagcctatgggagggcgagctgtacagttttacttacccattcttgggtgaaaaggggggtgttttgggccatctcccaataaaggttctcctctatcttccagattgtctaagcccagtgtggaggaaccatcaaggatttcagcacgtttttttagccattggtaacagaattcttcacataaaacatatatcaattgttgaaatttgcagaaatttgacttcgaacttgcagaaatttgactttcaaacatgtttgcaggaatggctacctatgaaagttggggactagctggatgtgcttttttagtcactacttattattttatctagacaaagattaaaaattactaacttgtttacagtatttacaacaccattctatttatgatcccaatactgtaattgggtatgcctttaatattacctgaatttttattcattcatagaacatttctagagaatacttaaaagtatttaaaggtccttggttttatgtttgggttttggggggtatgtatagtttttataaatggacatgtttatacttttataggaataaggtcagtggctttcatcaaaatctcaaaggggtctgtgttttccccaaattaagagctgtggattgagattcaggcatccctctttaaaatacttgtaactactttccataatcaaagcttctaaaactgatgcaaactttgtgattgcattactctgatgcataaggtctgttgaactgatattttccatttacttaagttgagctgatactattttgtatgagaaagcaaacaatcttggccaaaatgagaaaagttacttttcagaagagaaatattttttaaaaagattgaaagggaagagagaaatgtaggtaactactaatattagcagaaatctggattatgacagacatatagtttacaactgttgaagctaactattatttagcaaactttgttttactcagagtaagtcccttttgacagttaagacaaatccacagaagaattagaaaacaccctttaacatcttttgactgttaaaaattagatattgtggtataatttgaataaaaaataaatataaactcaatatacacatctaatcagccaaaaaaatagtttacttgcaagatctatagcacttgtaatggggagactgcctttctttctattttcctccttccctttcttcctttttgctgtcataccacgaagttttactaagtttgaagtatggggaacaaagaggcaaaattgagaactagaaaaacatttgctctgtgattttcaggcccatccccaaatcttgacttatcttccattcctgacttctttttcctctcttcactccaccaaaaaataagagctttatactttatctaaggctgagaatagatttacagtactagtgggattttacaggtccaaaggagaaagtaattccagaaaagtctttttacttggccttagaggtctcacagtctcccttggttagcccaggcctttggcttgcctgattttatgttaagtctgctgttctctctaagaaaggatgagggcatgcctatccatattgtaaaactgtaaatacaactgacttatgaatgaagctgctttgggggtcacttgaattttcaccaattcattagtgaaacatttactgagaataccccagtataaatggaaccataaggatacaaaggatcttaaatctaaatcaatagaagaaatttatccataaggatctttgatattggaaacatatattaatcaatcaacttctcccagacctcagtgctcaggaaaagctgtgttttgcttttctttgtggagcctgtgaatatcataactgatcatgtttccctcttggctctgttcactagggagctcagaataaaaatttaggcccccttttagcaactatgtaggacctcatggtatgcttttctatgtaaaattttcaccagcctcattatattatccattctttattttacctctactctgatttctttttttttgtagttatatagaaatacatttcctacatatttattaacaattgaatattaatttaagctacctcaaatcccttacttatgaggtgagggcataatcaatcaatcaacaagtaattgagcatccactttatgaaaccaattccaaccataagttaaaacttcagtcttgagtattatcacactatatgctttatgaattttttatactttgagcatctgattccaatgaggtaaactgttgaaatttactttacagtacagtttgtgaaaattaagttttactctgtgaataaagaattggatagataattccagacaacattctgaaagacacttacgccgtcattccaaagttgaaatgaaatgagggggagaagacttgctgggactaaggaaaaaagtcaatgaaatctgaggttgatgcctttaaatcctcttatattgtaaaccttttgagacaccttttaggagtttcattttttctctctctaaagcgctttccttacaaatttagctactgccctattgtaaccttttcctttgttcactaaatctggggaacaaaaatacagagatgctacatccgtgggtggtatacaaaaatgaaccaaaggatctacttaaattcacaaatttgtgctgtttgaacttggctttgaatagaccttaaagaaggatctgtatattcaattgtacagttaataagttaggtcttttgttttgcttaagaagcaatcacaaatttaaaaattgagtatatgaaaaccagcatcttcttacttgataatctgttcttgtggtctctacataatcatatacttattttatagaaaaaacagatttataaattcagtgagttcaaagattcagtataactctcaggtatggcatttctttaaagaatatcatcacacactgatgaattatagttaggtaagaaactgattttttgactttgggaaaacttttctctggacttaaacgagtgagaaaacagaactcaatagtgtcattaaaaaaaaaaaaagctttctggcaaaaaatatcattgagttcccaattcatagaacttcctttagtcctctgttgctgtgctgttctgaaactgcttttgaagcaggtcttcaaattcatgctcaaatgttctcttcccttgggtctttctaacaaataaaaaaaagttgcttccaatgagaccgctgtttttcaagagtatctctgtttgttggtaggaggggaatgcaagattttctttttttttttttttttgagacggagtcttgttctgtcccctaggctggagtgcagtggcgcgatctccagctcactgcaacctctgcctcctgggttcaagtgattctcctgcctcagcctcctgagtagctgggattacaagcgtgctaccaaactcggctaatttttttttttttttggtatttttagtagagacggttttcactaagttggtcaggctggtctcgaactccttaccttgtgatctgcccaccttggcctcccaaagtgctgggattacaggcgtgagccactgtgcccggccaatttctctatggacttgagccatgatagataagttcactgaggagtaaagaccttctatcccaaagcaacagggaaaagccaaggaaaaaagtaaatctgttttgttggatgactggttaaaatggaagcactgagatgatttgtgtgggctaggttaagagagtagctgaaattcatctgcgcacctagggtatagaaccaggcacgggaaatcattaaaaaaaagaataggacctaagttcctttttggctcatactgagatgaagaataagtgctgtcagatagaactcaaaaccttgggaggttctggtaaataagtaaagtagaaggcatactttataattattttaatcacaagtaggcattttatctttatgatattctttatatagtcttttgtataatatttattatattatttacatattgtcaaaaaagacattgagctatagaagtctcctatagctatagctaacattcaaattatctgatttcacttcactgatttggttggatttgattttctctaaaataaaatctctgtgctaatccaaaaggttggccattttgctttcctgtgtgtggattacattcatttttacttctcttctgctgaattttccgcagttctgaagttattgtggtttctctcctcaccaattcttatcatccccatgaaccttattcaaactttttccttttctgtgaagccttctgtgattactagagttcacttttcttggtttccactggttggtgaggtaataaactaagacattcatttttggcttgttctcactgaattagaaaactttcttaatgagaaggtatctcccctttcctccacctgtaggaatgaatggccaggtttttgtatactttataggctcctttgcctcagggagttgtggtttcagagcccattaagccctaaagaataaaccataaaacaaagagttttctttcctaatgtctgttctctaaaatgaattattaacccagaatgggtaaggagagtgaggctgattgatgctttggagttagagaattggatagcattactggagagaaaaacaatccactttccctcaaatgcagaaggtagcaaggtctctacttgcatacagctccagttggggtaattgcttggcacacttctggaggctggacataaaaaggcaccactttgagaggaacagtgatcatctgggggctgggccaatggtcaacagcaaggaccactgtggagggcatctgtaaacccagctagtgcagtagtgctggcagtcagaaggacgaggctcaatggcatctttgtggggtggtcaagcaatgtcaatgttggagaccatcatggactaaggacttagatttaatgagtcttgtaccaatctagggatgagaagggagccccaaaacttgtctgtatttcttgcgaatttggtgacaggggcctcaggtttaattttctttagaaaaatacgggaatttttttgtacctgaatgttgaggagtgttggggaagttcacctgaacttcctatacatgtagcacctaagttagttcttaccaatatattattgtttcttttttcatttgtgtctgtcttatctctctaagactcaaagcctcccaaaggctagtatcttgtcttgttataaccacaactacaatgacaactacaaatatgtaactggatccctcattgtgcccagcatgtttctttataatgtgtgggttctatgtgagtgcttgtttggtcagctcttcgctacacttcacaaacaagtgggaacctcagggcgcacatttactctgagatatgtctatgtgatatggtcctgacagggcttttttgcccctgaagttctgtgtaatgctcttcttcttgtcctttatttccctacctacccacagttctattttcaatagaatttaaagtccaagcaattgttttatgtgttcactgagttgcccacaaactctgctcattcatttatgatttctgatacatgccatgctgtctctgtctccctgattccatttccccagagagacagctcactgggtccccctgtcaacagaggattcagtggaacccaaagctaagccatactttgtaataaaaaataagaagagatgaccaatctatgatgtgatagaaaaatgatcaggccaaactccgatcacttttgcctatgttagggaagctaacctgcttggtaacagatgttacagaaatatctatcaatcagcattgataacagggtatttatatgtacattaacagtagtgtcaaggattgtttagaatattttctcttggtggccactgggtgtcctcatttacaaagtaaatatgcaatatttagtgaaggtcactggagagaataaaagacactagttttctctttggcccttcacatactggggataaatttattgctgaactcacaagcaggttatatattagtacagtttaaaaaccttcaggtcaaactgttaaaagtttataaccaagagtaacttattcagggtccagacatgaattttaaaggctgtttcctcaacagaggggactgtgatcagctattagaatgatcccttattcatttgaaaattggcatgggattttgactatctgccgagagagccagcagagaggagcagagaaggtcttaatttattcttgaaagaaaagagaacaccaaatatctctatgggatatttgttagattctgtttttatctcaccttttctgaaaactaattaaaaataataatgagaagataaaatatgtcctttgcctaggaaacctgaaataatgtgaaaaacattacaatgagctgggtcagtatactgattatcaatcatttcacatttgaagacaaagaattaaactattcctttatggacctgttatcccacctgtaaaacaaaggtgtgtatgcttcacagggatgttgtagggacaaatagaatatgaggcacacaaggttcctaggaagagaaactgtacatgagatagatttagggcattactagtattctaattgaggctgagtcacagttgtatatgacttgttcctgctggaagacagtagtcaaggccagagctcacacagccaacaaatatgttctgatttgctgctctcagacactgagtctgacacactgctcagcaatcacttactgctccctaaagtggtattttgcatttctaggattgtcattgtctctaaatttatacttatatacatcgctgatgaggttcttcccttgcaaaaagaaatttcagccttcctccaattcaagatacaggcctactattgaatacataacagtacatggccttcaaatgtcatgcctagccaattagctaatcctttcccaaaataaacttcactgtaatattttttttttcactagcatacatccccagcttaattactattctctggcatgttatttcagtacataaattatcaatatgattttgtgtcaaaaccaacaatttgaccaggcatgttggctcacacctgcaatcccagcactttgggaggctgaggtaggtggatcacttgagtttaggagtttgagaccagcctagccaacatggtgaaacctcgtctcttctaaaaatacaaaattagctgggcatggtggcgcatgcctataattcgagctactcaggaggctaaggcaggagaataatttgaaccctggaggcggaggttgcagtgagctgagatcatgccactgcactccagcctaggcaacagagtgagactctgtctcaaacaaacaaacaaacatcccccaacaatttatgcaaacaacatcagggaagctaggaagctctatgagctattctctgccgttcagatatgttcgattgtcttactagctgagcttaacagccttttctgtttttaaaggaccaccatgcatgcctctagtacagcaatctctaacacttaatcaacagttacgtctacagcaatacacaatagccaggtcactttcaccctgagattatactaaaggctcacaatatgctcagagtgtatggaaaagtgtctcatttcttctaaagatccttaaattccttgcttttatagtattatccaactgattaattagtagattcatttttcaactactgtagccccaaagatacatatcggcagagccctcctgattgtattttacccttggccttttctccttttagtttcctcagtttgcacctgtaatttcacttttagaacttctctaggctcggtggctaaacaccacacagcacaggctttatctgatgtgccggcgcctggtgtggtctaagacacactggtgttttgttcttgaagtacaggattgatgttctgaaacctaggctctaacacaaaggagatcattagctcattttaagtgtctcttttcttccctcccagcctcctcctacccaccccaatacttccttagtcctaagcactggcagcagatggcaaccatattccaaagctgagtatacataaaatagtgccatggagaacagagtggcttcaaagttagcctttctattcaagtgggatggcggggacttctggaggagtgaactcatctctcattcatttaatcctctattcattcagccaggaatttgttttcctacacatccatctactgtccagccagttgagggagggtgggcatgaagcatctctcttgagggcccttccagcaggagggcactaagatttctatgccaagctcttgtttccctgggccagctctgcctgctgctgatcaaatcatgccattcctgtaagaggagcttgggaacacagtgtgtagggggtggatttctcaagaactatctccttgctagactgacagtcacatgctgtattccctagacaaagattagacccaggaaaaagatgaaacaaggaggaggatgtggggttgcagaaaactgtgcaggatgttacagtaacgggaggtgggagtgggaaaacctttcctttttgttgtttcaaggtttgctagagcttttgcctaatcatctgtttgagcatcttgaaaataagtatctatttccatggtatctatcaaaaacaggcaccagattatactacaaagttgacctgccatattgctattagaattaaaacatgtagcagcttacattcaaaagaaagcttttctgtttccccagcatgaaaagcagagggtatttgtgatacactttgttttgtaggtctgctgaatgaaaaaaataatcgggtaaaaaattagtacctatattttcacaaatgggcataatgcttacaaatgcactacatcattattttagcttcattctccccacaacattcatttattcattcaacaaacatttgctgagcacctactcctaatttgtgtaagcactttgctgggtgctagggattcagcagtggacaaggtaaacaagattccgccctcctgaattctgtcacctggccaaaataaacatttaacaagtacgctgctagaattttacttgagaaaaaggaataattcatcttacctagtatttcttctgaatctttcttaaacatatttcttgaaggtccagactcctttaactaagaagttctatcttaaatctctctctttccattgttatattcattcctttcttggttacaatgtggagagttcagattgcaactgctatcatttctggggggaatgggggtgggactgtaaccctgagaatccttgcttttcaaactacacatatattttctctgtaaatattgtaccatctaatttgcgtctttggattttgttgattagccatcaacatgtgatttaaggaatactgcatatgagatgcagaaatcatgactcagtaagttattattttaaagctctattttgggatttatacagacttgtgtacagtctagtttggctttcaatctaatctgcaactattactaggaggcttttagatcaagttccatacccatgtgtctctggaattctacagtgagaagcaaaagtgctcaggagttaagagaagcagacgtccgaaattatctccatgcattaccaaaaaccgtgggcaccacggcacggggaaaacttaccaggtacaatgagccagtgactgttactgaatttcttaagattacacttttcccaactactgcagactgcttcagaatagaagaaggtaagtaagcagggtgattacaagcaatcctcctcggaagtgaaactcactcttctaagtttacctctgttttgaattatttcagacaactctcatgccatcaagccgacggactttcaaaaaaataaaagatgcatttctttacttgtaagtatttgtctttgcaaagggctctctgatatggtagcacagaagtttgcacattctaaggatctgatgttttgccctcttcgggtatcccggctggaaggagctacggtgaaagggcacctaaggtgaatggacagattgtagatgggtgcacacaggaaaatgtacagctcctacaatgtattctgaggtaagagagcacacaagtccattccctataatttgaaaatctctcttctttttttattttttagagacaggatctcactctgtcacccagggtggaatgcagtgggatgatcatggctcactgaagccttaacttcctgggctcaggtgatcctcccacctcaaattcccaagtagctggactacaagtgcacaccactatgccccgctaactgttttgtagagatggggtttcactatgttgctgaggctggtctcaaactcctgggctcaagtgataaatccacactggcctcccaaagtgttgggattacaggcgtgagccaccatgcccagcgtgaaaatctcttattgactagaatgcacttgaagacaaaaaggaacttaacaggttaacactagaatgtaatgctataatattaataacactctaacccttccctataccaagaagacaacattcagagagatttgaaacttctttcagccccagtttccttatctgtaaatggggtgttttgtaataagattatgcatattagtcctctttcatttttaggaaaaaaaaacatacaaatgggggaataaaagaaggcaaagagataatggagaaacttcccagtctattcaggcctgaatccaagaagggacaagaagaagggcactggcttttcctcgaagtgaaggatgtaactgtcttacacacaatctcctcccatagatctagggcttttcagcctcagtcgttctcagggggaaaggatggggacctgcaacaactttcacttaggctgcatcaattttagttcatattaataattttcaagcacttaaaactgtagccgacactcaaattcacggagcgctggctgtttttctggtgctgctttaagggctttacatgtagtgttccatcgaatccttctaataaccctatgagatgcatactatttttattctcattatgcaattatgcacatgaggaaatggaaacatagggaggttaattaaaggcacataaaatgcattcataggctgaagttcatgttaaaaagagcaaataagtagaccatgggggtgagaaaatattttctgaatattggaaaacaacacatagccccagtcttagtccattagcaacatgttcaagaaatagctttagcagtctgttatcatacctgcccccaccctgaaggcatatcggagggacccgagaggacatcaggagccattctgcattgggatgttcacagggacctctcctcattgcttctaagttcactcttgggtgccaggtttgagggtgcagattctgattaggatatgtcctggggaagtggctttttccttctgttagttctctgaccctaatgtaacaaaatctttaaacctgtgtcccagaacaacacgcaggaaagaatatgaacctctaaaagaaaggcccagtaatggtaccagtagagtccaaggcctccaggtcaagaactcctgctctggagcagggctggaagtgggggcacgctttgcctgtatcactgcccagtgaaaccaggcctgctttgcagtgcctgttagcatgtcaacccaggattacttaggccacttcaggaatcccaggatctagtcacccatctgggacctttaggtcaggaagaaaatggaatgggctagatttatgaaaattggaaaaaatccagtcaggtgtacctataaagacctacagtatttccctgagaaaatgacatgtatcctttaccctggggttaacttctaaaagttttagtttagaatttgcatgtgtcttttccattagacacagagttatcttttgtagttcaaacttatatgcacctttctttcattgtctcctttacatctaaatacctggttaagatatgaggcaaagagataatcagtgattatatagggaagaacgtgattacagtaaaaaattgaaggacaaagttaattcagttactgctttttgaaattctttgtagtattctacatgccacaccaagcttttttaaaaattctgtactctttggtctaatatcttggtataaaactgataacataaccaagctaaaactagtgaggataaataagtaggaggaaactcatttttagaattggagaggaaaggaaaaaactcctcaaggtcaattttgacatcaactataaattcatttggccttgtgaaattataaagactcatgttcaacattgttccatgtggttgtttatataattttcagtagtgacaaaataatctccttatttagttttacaggtaatttaatagtagaacaaagtatcgtttgattcagttggttccagatcaccatcctacagtagaagtatatcagatacttttgtgtacaggtgggattggcctttggaatgtcttggaccatcacagaaagcagcatactttaagtaaacaaattgaaaccctccctacaaataatgaatttgaggatgtcccatgacaatgaaggtggccttgagaacaacacataggtttgttattagtaattacagagctacctgaattgggcatatcatgaaagaagtacacagaacatggcttttaaagaattatgctttgtcatttcaaaaacaattgtttttaaaaattgttttaaaaattgttaagatgatttaaatgttcaaagtgtatgacacctatcctctgcttagtgttcagaggttactgagggtaaggaactgagttaatatttgtgaagtaataatacttgtaaaacattatttctcataaaaaataatagaaagcaatgttgagaagaagtagagaaagaaccagtataatataattactgcctcactgggcttgggtagtgccttcaaattcctttcacatatatttaccattccaattgccctgtgaaatggaagatctaattccttctcactttgcctatttaattgcagagtctcccttaacactggtttttctcagtctataatgggctaggaactcttgtatcataaaaatattcattactccacttttgagttacccattcattatttctttttaaaacattaaacttgtactttgtaatagttgctttcccatttatcctatgtttgctcctgaacccctctttatggtcttttttgtgacacatctgattctgttttcttgacaacaatcaggaggctagtaatcccaaaacctaaggtaatcttttcctaggtctctccctcgttggtgtctgtggcacctgatactgactgctgatccttcctctccctgatggtctctctgcactatcctggtttttctcctatcccttagaactctcttttcttttcctctatttattcattcttcattctctttcttatcactcatgtaaatatttcccaaggttttgctttccttttttctctcaacaaagacttctttgaagtttactcccatatttatggcttatagtgctcttggccaaagtgtttgctagtcctaatctcacgcattcctgctgtgccccaggaccctgtttgtaactcagtgttagttgtctccactgggaacacctgtggtagctcatactcggcactatataaaatggaattcaatttgattcctttaaatgcttttcatctttacttgataccttggagttatctttgataactgcctttgttgtaactaacactcagctcccagagctgtctaccctcatccacaaaatctgttgcacctggatcctccccattcctcctattaccgcccccttcaggtcaccaatagtgtgaaatactgacagtgctgtctggaccctctccttcctccagttgctccttctcacatccaggctgccaaattagatcttctcaaaatcttgctcatggtaggccctacttaacacccttccacagctctgcaacagaggtgcaaacccctcatacctagtcctgatgcctcatttccagtctttcaaaagagctcaaatggagccatgtctaataaacctacctagatattactgttaactggattaaaatatactttacaaactttctaaattctcagatactggtgatgtgaggatacatattgttttaagattcttggtggtggggtctgtttttctccacctttgtgtcctcatggaactcactgtagtgacaggcacaaaagatatattctatacatacttgctgagtgagtgaatcaatgctccggtgggtctctgtgtatggggacatatctttaaccacgctgcatggaagttgtttgtgaatgttatttgatcttctctacaagactctaagtctctgagcctagggctccagtttataaaactgcgtcctgcacaatacttagcctgtggtcctccacattgaaagcatccactatattgatggatgaatagtcctgactcctttctgttcagagaacattaagtttgtccagaagcagacttagtaacaagcagcataaatggtgggagaaagggcagggttctgtttctgactctgtcattcattatgctgggaaactttcgttataacacttgtgttatttgggcctcagttttctcatgtgtacaataatgggtatagaccaggtaacctttaatcttgcactgctgataaaaagttagaactggcacacattcctcagagagaacaaatgattcagaggcagaagaaaagcaaaaaagaaagcaaaaaaaaaaaaagggattctgctgatgaagtaataaggtatgtgattatggtacctagtgtgaggtgactggtggaaagatccgacttgaaatttccttaaagcaagaagtccttaaagaatcctcatgcttgctctcaatcaatcctaaatgatccaactctaagggcagtagtgcatgtggcctcttttattttaagtaaggatgtgagaagtcttgacagatatggagaagcactaattttatataatgaaatctgccatgaacagaggaagcacacatgaaactgtcactagcagctgtagataagaattaaagatgtattcctgcatgggatgagatggcaagatgaagaacagaaccgtgaaaatcagcattgggccctaacaattacatgtggataatcatatctatgcactgtttgggagagcaatatgacacagtgtaacttgagccaatgggcattgagaccagacttgccaagggacctgggaggattttataagaggacagactgttagagtcgggaagggccacaaatccatgacaaagttccagcatgacacctgtaggtgactctggctccatgaatgaacttttctcaacaattagttattctgagccaggtgtggtggctcatgcctgtaatcccagcactttgggaggccgaggcagacggattgcttgagctcaggattcgagaccagcctgggcaacatgatcaaatctcacctctaaaatacaaacaaacaaaaaaccccccaaaaaactagctggctgtggtggcacaagtctatgttcccagctactcaggaggctgggtgggaggattgcttgagcccaggaggcagaggtggcagtgagctgagattgcactgctgtactccagcctgggcaacagagccagaccctgtttaaacaaaaaagaaaaataaaaagaaaatttattttgtgatttactgatcaaaatcatcactaggtccttcagaatactttctttttttttcctgagatgcagtcttgctctgtcactaggctagagtgcagtggtgcaatctcggctcactgcaacctccgcctcctgggttcaagcgattctcctacctcagcctcccaagtagctgggactagaggcacgtgccaccatgcccagctaatttttctatttttagtagagacagggtttcaccatttggccaggatggtctcgatctcttgacctcatgatctggccgccttggtctcccaaagtgcggggattacaggcgtgagccactgcgccttgccccctcagaatactttcttactttgactggctgtgtggaaggaagggttcttttgcctattagaaaataagtagatgtcttgctttattatatatttggaaagcaaatgtctctgaaatggatataggattcagctcagctgaattataacaatagacaatgttacccaaatacaaatcttcccatgattaaaatgaggcaaagtataagaaggcctcagtgtcataactgaactgttctgttttctgaaaactctgcgctctgtttgtgcctctatggttttgcttctttctattccttctgcctggaatgccattacttctgccttctactttacaaatgcccactcctttatgatccagtttaatttcatttttggtgtggagctctttccacttcaagaggctctttcctcgggggctctgtagcattttgtgcatactggaacactttaattctgcatttatatttaccccgttatgttccaaagtgtggggatggggtcttattcctatcttcgtccctaatcttagctgaggacttggtgcagaatgagggatctgataacatttgatcaatgactgaattaatgactaaatgaatgaatgaataagaacgactaccagaaattactgcattaagtgactatggaagaaacccagttaaattggtgttgtagggaaataataagttttataaaaagagggccaatttaaaaaatagaggtagattaagatacaaagtttcaagacctgtgcttttttaaaataagtgtgtccccaaatgcacaaagtggaaactctaggaaattagagcaaataaaaaaaacgaactggccttccaatgtataagtgctggactaagcactaaaatctctaaataaagggtataaaaggtaacgaaaaaattccaaagagattatatatcaattaactaagaggcagaaaggtgactttttaaaacgggaaagactatctttaatgacaggaaatccacatttaacagatgaggggcttacttggcaatgaaatgacagaaaaacagtttaaatgaaaagataaatatataattccttacagaacatagaataaagcagaatgcagaacactgggggcaacgagagcacttagttgtaccaaagacactctattactgcttaactgatacggaatttattagaaaattaataacaagccattggatagtaactgtctgtggttgttattccattccattttggctatattttctctgcaaattagtgtgaccctaaaatgttttcaggattgtccaacttgtcctaaattccataaataaactctttcagaggatgctgttttttgccatgtctctattacggttcttcacagatggaccatttttgtccttccaaagtctaagaataactctttcagttatcaagacataccaaaatccagttcagctgctcctgtgggattccagttagtttagacacatctgctgagatacatgcatttgaatccaaatgaagcttttgtttgattatacattttgaacatttatggaggttttctggggccaaaatgtttttcattttttggcacaccaaacagagatcttcagttataaacactgccttctgagcacctccaacagaaatccaatcttttcatgtgaacaggtgcctcaggaagtttttggaaggttttacactgaatcagctttccgattggaaactttctgaacatgcagtcaaatttgccaaagagaccttcaaacttgcttgagcagttttcactcatacagacatacattcacacatacagacagcccaagtaaaagcaaatcagagccctgtaaaactgaagtatttttcttaaaggttaaatatcatatgcaaccaaactgaacaaaaagaaatacacaacaggagacagaatgaacggatagcacgaggttcttcattgagcgtgtctgccttaaagccttacctagagtttaagctatacatcctttcagtaaagttttttatttcatctggtttcaaatatatactcaagcattcgcatttttaaacacggcaccatagagtattgctactaacgcctttcaatcacaaacccgttcaaacagttattttgaaacactgccttctctaacacaaatgggtaaaccagatttaaatgtaaaggaagaaaaaaaattactctttaagtcaggggttctttagcaaagccctcatcttacctgattccctataacttttactttccagtttgaatacagcatagactaaaaagttgttatagagtaaaataactttttaagccttaagcctataagtttttacagagtaaaatcactcccccagtgggcatgcctgcaattcaaggggaaatctgctttcaagttgttctaatggccccgaaccagatgctctaagatggccagaaacctttgtctacacccacttagcagatttctggctcgttatcagggactaaaaggtttattcacagaaatgaataatttccttcgaaatatcccttaccctatttacatgcttgcatattccttccattttgttttccccctacagctttactaagggaattaattatctggaagaacaggaacatacagtaagtacatctgagttacaggatgagacacagtatgtcatctattaggcctggctaagaccagcagctgatgctaaatgggaaggaacatgcaccaaatgttttttaatcacaaagttagtaattaattgctctttaaaatacattttatgcttctttctgtctgtgtacatgaaatgcacatttattacatgccaaaaattacaacattatggtttaaatgtgactggcacggaagtccggaaatcagagttaatgttcccacagcaactttaattctgtccgtgtgcacatgtagagctataatagtcttccgttccaggataatacgtatagatggttttgggagggaagctaaagacccatatcctcaactgtagttacaggaaaaaaatcaaaggataaaagctgtgctcctttccacatacgtggataaaaacaatgtccccacacccagtgttgtgtaatcagggaatgaaagaatctgctgtgatgccagcactcaaggggacagtttctgttgctgtgggaacctgaactttgcatttcctgactttggggtaattaaaatgtcagccttaatgtggcattaatggagtttgccataaaaatcttctgttttgttctctaaaaaattgcttaaaagttcaaaatgagccaagtgtactaaaaattttaatcacacagacttgggcgggtgaagcaaatggttgggagggggaggccaaggaaggtggatggcaagagttggaaaaggaagagcccattggcctctgtgagtgtccagccccagcagaatgatgctacctacggagctaaagttaaacccacccacacaacagtttggaaatgtgtaaaggttcaatgaaaaataaataaaaactgttcatgcgtaagtgcatcttggcaaagacacaaaaaatgagacagtctgatgaggccggtataaaacatgggaaggtaagtcaccatggatatcagcttccaacaaaagaaagacatcagaataggtggatctacagcagaagtagggaggacggccacagggaggaaaatcacttctttcaatgggagccttatttgggggaaaacaaaatggaagaaatatgcaagtaaaagttctggtcgcgtctatcacatgtatatgactgtgatgtgctacagcttgatagctgtcaagaaaggtttttcatatggagagcttcgtctgctttactgacttggtttagtcctgcttaagcatttaaagggagcacttggctcagctcatactcagcttgcttagtgagtaactgctctatcaaacacctagggtgttttttacccttcagattccataactcatcttaatgccttccattatcaccatgtgaatttgcttaccattagatttttagcaatggtgaagaggtggtaagctagggggtaatgggggaatattgctaaaaggaaattgtgttagtaggcgcactgcaaagcaacatacattttagcagcaatattaacctcatcatctcacaaaagaaagcatatctcaactatatttcttcttgttttgaataccactgggatcttttgccgaatttgaagaggctcaggaggttaaacagccaactgagaatttagggggtcagacttgtcatctttgctgtaaaacacagcctgtgtccttcatatgcaaaaaagatggtggcttacccacccatgtcagttcatatgcagagctgacttttcttttgtggcgatgctttatccatcatgttttacaacccagtcaccaatatgagtagttgcacattttcaagatgcctgttcagagccaggaatgccgtctttgggctcagaacagagaattccaataagaaatgctctcacaatgagagcaaatccataaacacccctcggtacccaaatgagttaaccacaagcgagtcttccatctacctgggtgtcaattttctcagttttctcatctgtaaattgggaaggatcatactgacaggatatgggcattaaatcatgactaagaataattttgctaaacacatgacaaataaaaaggtgctataaaaattcaagcacttgtgaaagcttggaacaacacacactggtggaatgtttctgaagttaaagagactaacaagtcaagggcactatttttaaatgccccaaatctgttagttctaaataggaactgaatattttaccttaaagaaattaggcttttaaattaatctatggtaagaatgacatttgaaagtaaaaaaaaaaaaatcctcttgaatgcaagaagagcatccaaaaattttaacagcttaaaataaacctttttcctgtcttctctcaagcaatctccaaatggacagatttctgtgaatctttcctaaaaacaattttcttctaagtgtaggctcaaatcaggacaaactacaatccaaatatatttggagaaaagtataatcaatttaaacaacaggttggaacagagaagacttacacatcttaatggcaaaatcaaagtgactgtctaaaaacagctggagatcaggtttctcctcctggtttgtttttccaactgagctcacatccactggcttccccagggccaccaaggagatgtatggtgacaccatactcacgctgttcctgaaacttacttcatgccaatgctaaggcctggccagaggatgcttatgataaagcacaataagtgaagcccaatgctttttctattcacaaaacattcatttttgctgtaacagaagatttctagcctaaggcaattctatgtaatccatacccataaggtgtggcagaaagctgggtaatgaagacctgcatgtagaaactccaggcccttcaccacaggaacgggctattttcctggtgggaagggacagtgtgcacatgcctatgggcactgtgccactctactttccaattctttctgtcattactattacactgaagattgccaggcaagaaggtccaaggatgtgactattaggacggtcctcagaacacagtccctgcttctgccccctggtttctctatagaagcctcaacttcgactgttcaaatcacataggccacagagatttgtctcacgttacttcccttttcattttctagtgacggctagaatatggtcttagcccaaccttaaatagaacaagctctcttcaccccaatcctgccgccagctcatttccctctctttagagactatcatgatgaagcaagtagagaatggaatctcctggaccattgtctcttgccttctttgcagaattttacatttgttctgtcagaaaaataacaataaaagatttagaatctcatttcctaataatttttgtctttgtggacaaaattttatttttgaaataaaactttgcaggtcttatgttactcattttaaagaagaatatgccagttatttgcatgttaccagacatcctttatggagatcagttcagaagagttgttgggtatgttaagactaaaaggaatattcttttggattcgactccaaagttatttcattcctttccattgtcaacacacatgtttctttttctctgaagtattgggttacatttcagaaaaagaaaaaaatctcctaaacgtgatttatcaacttgcttaaaatagaattagaagaagtgactcccagattagtgggaagatggcaaaaataaacagcaaagaagtgatttcaatagcgacgatctcattaagctgcccatttccaaatttagcccttaggcagtttttttaattaaaaaatatttttaacctggattctcattggctgtgtgaagtctgggtggcttctgaattcttggaagccattctcttttcttctgtaaatttatgctatcctttaaccacttcaaaataaattaaaaactggaaagacagaaattcagccaagctacatgagactccaataactaatgcaaatctgacttgtgttatgtaatttcaaaatggatgtttccttgtgtctaactggccttctgaggtccacatttggttgttcaatttagtaattgtggaagtgccattatccagatcaagaataaatggataccagcaacaaaacttcattttctgggttagtgttatgaaaagaacgtgttttatgtaattaatcagccctttaaggccaaatggcatgtcacctggcttttaaatacactctagctttgcaaacttatagatattggctgaatgaaaatggtggcacattacttttggctgctttagaagaccaaatgcaaagagctcgctctgaaagtagaaaagccagaacccagggtagaagcactactccaagcactgcaaagacaccatcaccttagtggtgtactcacaatcagatgacccggtgtgagcgtgagagtttgtcagtgaatgtgttgagtggatgagggctgggtctggagacaaaacagcttcaaagttcaggcagggaaggcccggcttggcgctggatccacccggctgagtaatctcattctcctcagatgccttctggttttcagctgtcttgggtttcttcctgaaaataaacaaagggccctttgaaggaactgactgcatatttgggaaaaggcatttttagaatctgttaaagataacttgattttttttttctgaagggggatgggagggagtccagtatgtcccttgttttaaaacaagctgattcttgttttttttccctccagtaatggcctaactgggaacacatgaaagcatatgggccaagcaaacagcaccacatttggactctgttggctgcataaaaagaccctgtcccagaactttagacagcttgagctacgtatggctgacattatccaagaaagcatccctcttccccccttaggagttttaacatggtctggaaaaatactagtggaagttttaccgttctagcatttgtcaggaagcttagagacaggactcgtggagtaatgggaggagcactggactgggagtcaggagacttgagctaccgtactagctgtgcctctaacttgctgtgtggccttgggcacctcacttcacctctctgggcttcagtttcctcatctgtaaaataaagggcttggattagaaggccttaaaggttccttccaactttaaatttctactcatggactacattaaggaacattcaactttcctgctcttattaagattttattttaaataaaatttcaaatcacaatttaaatttgcagcctgtacggatgagggggtagtgatgggaggtttctgttagagtagcaagtgaaaagtgaaaagaagagcttagattctagtagctaaagagggaaggtgtcatgcagagatttttctactccaactctttactcatcctacgcctaagatttttgatttggtgcatcgtcctggagtttagggtgtgattgtgtgtttgggacatgaggaagagaagggtgaagggaattagaaagtaattgttactaattgttatatggggtcaggaataggaagtaaaacagcacagctatcagtcagctcaggtctcctctccccaggacaatgcaactgatatgaaattaacaaatacttagcttatactacacagaccctagaccacagccaaactggtttattagtaatagttcctgaacatttctccaattcccttggatttgtgtctttttctatcattatgtggacatgaccagaaaaagcatttattttatttgtagaagactatgtgtggtacagaatttgttgtaagtagatttgtttccatgtttcccttgtttctgtgagcatggtaatgtacttgttatgcagaatattttgtatttaaatttgttgtgctgggtagttaaatctgccctcgcagaatatggtgttatgattagtatgctgtgttttcagtccaacaggttgtgaaataaaatctgtttcttcagagggcaggaggcagagatggcatggcaaagattagaatagaggtgaggctttcagacatctttttcagtatggaggaagccaatacaagagaagcaacaaattataagaccttatcaattgatttttgaatggtgactatgggagtaacccccaaatcttgagtgtctacatggaccctgaaggagctggtattctgattttcagtttaaagatgtagccaagatcaaagttgctaaagcccaactcctttattaaaaccaatgctttctctaaggtccatatctctatcactgttgtctaccaccaggttggaaacctcagggtcactatacaccttcctctgccttaaagccaattcatcagtaagttcttacagttctgcttccttcatattttttctcacatctgtgtttccattccaatttcactgcaatcacctactgctttttatctagctgattgtttactaactggctctccaacctctttcactcctctagtcctgtttctttgcattcactaaatctaagatgactacattagcctgacactcaaggtcagttccgtatctcttctaacttttctcatgtgtcctgtatattggccatactgtaccctcagatttcttgaatatcctccagaacatcctgggaatctacattctgggctctacatctttgctcaagttttctcttactttgaatatcccatatttcatctctgccctgttgaaatcatacttattatccttcatacttattaaatggtgtcttcatcttataactgtcttgattcctctctgccaggtaggacttcactccccacagtgaattcctccctaggtctttctccgaaatgcctaagctcttttttttcttaatcttatttcactcactcaattttatttcaataatggctatttatgtgcatatccctcttgtgagactgtaagctctctgaaggtaaggaaatgtcttagttattttagtattcctagtgttcacctattcttttcttcttccttctctcctgtcattcattcatttacatattcattttacaaatatttatgatgtacccatgatgtgccaacatgggctaaagaataaaacaggactggttccttccctcccagagtttactgccttgtctatactattaagcaatgtagcttagacaaagctgtcattcaataattgattgtggacagaatgaaatgaagctgaaattaaagtgtattttaagaacggtcatagtctgaatcccaattaagtttcctactttttatgcagcaaggtagcaaaactacctgactggctgcttttgctttaagtctgtgaggggtatttaataagagcaggactattttgctcagtaaggctaggctggccctcatgattcatttaaatatagggtcaaaacagtaatgacatatgtcacctagcagaaaaaagtgtttatttttgatattcatagacagggcctaggatactttcagatgtgtgcttcagaaaattaagaaagctttctttcaaacataaggacatagcaaaaccaccaatatattactcttttatttttaacactgcaaaaattatattgttcttcatatcaatgcccttgtttccttccctagattcgctcttgtttcctacctgacatcttgtatcacaccctcctgttgcctcagtgatcactttgggagaatattgatagcacagaggcattggagctacctctataaacaggaaatgttagcaactcaacctttttggctcacccccttatttgtcttatatcactttacttacccttataccactgggctgtttcccaactgtccagataatagagaactgctcaccatcctcagaagcaattcatgtcctgtctcaccctctctaatggttcttcggactcctttttccggagctgagaaaccctaaaacatagcacccgtttacgtctagacatgcacaggtgctgtgaattgaccccatttttgcagttcatagtttattaaggaggaaagaataagccctgtcataattagttgaaaatacattttgaggctgtataaaaagaattataaacatggcacatctgagggcaagtcttttcaagcctctgtggcgatgcactattccctggagcctttagagggcagcagcacactggctgactccagcggatttcagagaggcgaactcccgaccagaaccttcctcctggtcaccatgccaaaggttgatttgccaggctctggcctctcagtctctttcttttcagttctcattctctctctctctctctctctctctctcattctctctctctctctctcattttctctctctctctctctccaaccccttcctcctctctctctgttaaaattatacactctgatgaagtcgcccctcaaccggaaaatgaaagctccaatgaaaaagttagacaagccaacaacaacaaagaaagaaaccagggaaaaaggaaaagggggctggtgacagggaaggacttaagaataagaaaagggcagatgtttcgcaaatatatgcaaagcaaaactgggtgtaccctgaacacttccacagagaaacagaccaatcattgtgcacttcctcccgccacactggtggagctctgcattcaaaaaaagaaaaaaaaaaaaggcaaaaaagcgtggccgcaggcacccgcctttcaacggtcagttctgacattctgactgaacatctctcaattgtccaaggagaacaaaaacattttcatctcctcactgcaaacatttctgttatgagaaaaggctgcttcaagaattgggagtgtgttttaaggagactggcggccgagttagccagcagagccttctggtttttaactctcattgtgctggccccagcaagaagttttaggctgaaacatagcagtgagtaaggctgtggaggatgttggctctttcctaactagaccatattgtatgtggaaagaaatatgcattaaaacatattgatgatatggtaggtattaagcatgttaaatgcatggaaattaaccagatcggcggcatttgatgtatatatttcacactcttttgcacatattgcacacatacagtgatggcaatgctttctgcaacatatggaaaaataaatattttatctgtgtgagctcttagcagtctccagggtgttgagagtgctctcttctttcaccctatcccaattttctctcttcactgggctcccaccctctcttgcacgttaatgtgccttttacttatcagcttggtcttttcctatctggtaagtaatgtgcctgttacttatcagataggaaaaaattagttggaacctcctattggctcatgataatttagaccagtgatgcctcccccaatcttactggagtcgtaacaatttccctactcttttccccaacaatacattaaataggcttagtatctgggcaggagagaaagggtaggtggtaacaaaccaccccaataagggtggtagcggaactgcgctccactacctattagctgtatgtcctgggtagattactccgcatctctgagcctcattttcctcatctgtaaaatgggaataataatacctaccgcttagggttattgtgaggaacaaatgagataagccatgtaaagtgatttgccttgtgctggcacatggtaagagctcaataatggtagttcctctcatagggattgttagttctgtgatattcatcatgttagctttaagaagacatttccgggcaaggggtggtagctcatgcctgtaatcccagtactttgggaagtcgaggcgggcggatcacgaggtcaagtgatcgagacaatcctggccaacatggtgaaatcctgtctctaccaaaaattcaaaaattagctgggcatggtggtgcatgcctgtagtcccagctactcaggaggctgaggcaggagaattgcttgaacccgggagtgcagaggttgcagtgagccgagatggcgccactgcactgcagcctggagcaagaaaaaaacaaaagaaaaagaagacatttcccttcatttcagtaatctgtttagatatctagattttgggtaggggcaaatggattgttattgtagcaaaggcagaaacaatgttaggaccagcaatctcttcctcaacatttgatcttgctgtatacttcctgacatctcctttctgctcacatgtttgtcattgctgtggctacactacaccatgagctccttgaagctgagggttgagcaagctgcacttagcctatagaagcccatcaagcctggacactatggtctattcattgagaccaacctatgggactctggcttatcgtgttttcttgcaatttatcatttctctacctggtctgatgtcctcacatcaatttaagatattttagtgattaaacacattttattttctcaatcttattttttttaaccttggcagggctgatttataatttttttttcagtataatttcctcttaactgtatcagtcaggatcctggcaaaaatagatggcacatgcaaagtttttagctaaagaggatttaatgaaaaaactgtatttggagctgcagatgaggttaagggacctcaagagagatagcaccaggtactagcaatagtagagactgccaggtactagcagtagtggaaagctttaaaccatttaaactgaaggggcaagtaaaatggtgatgaattctgagtccagtcagaattggagttgggaaggagggctgaactaacacatttcctgacctctctcttcccccactttcacatctcctgctgatgtctccttttggccaaattcaaagggaagcccaaggacaagagagcctgggtaatgtagtccagaaggccagtcttctgggtcacacatcagggcaaaagaatggttctggggtttttttgggggtagaatggggtggcaagactaatcaacatatgtgttcttctctcttatactttcaattatactttctggaaggaaagacagaacaaaataaaataggttctgtcttagcttccatgtacctattatgtcgaattgccattcacagagcaagaaaagagaatgctgctcagccgagcagggatttttgtttgttttgcttgctgccatattcctagttcctagaacagtgtctggcacatagtaaatggtcagcaaattttaaatgactgagtaaatatactcacctctgccgtgacagactttatatatatatcatctcattgacttatcacaataatctggttaagtaggcagggccactgagcattattgtgcaggtggtatggggggggtgggtaggtattaaaatttaatatgtgcctccccaacccacttccaagccttgtgactaggcccgaagcattgtcaacccaccagaagagatatacttctgtaaatgattcacattttaattttttatcctctttattgatttttgcacctagcaagtttctgttttattattattatttctcttttatgcattggaaagccaagtttctgaatagcaaagactgcaaagattataacccagtctgtccattctctagggcccatgagaagtaaaagcaggcactggcattctgcacagatgaaatacttcctacgacaggaatacatgctcacttgtggacttctctgtaatctgtaggcaacatcagctcctgatttctaggtctggatctgggttctctgtagcacaggaaggtaagagtgataagaactcttttccctcttaaaggatatagaaacttttaaacccatctgcatcatagtaaggctgtgttatctgtatcagcatagttactctgtgatgaagaaaaactcagaaaactatccagatgtgggaatttctcgggtattccttgcacttgaacttaaggatgaatgaaggtatatacaagtaagttccttgtgtgggtgtggactgaagaaactatgtttgatcttctgtcatgtctttagtccccagtaactcagtcctattagtactatagaacacattcccctccgggaaaggcaggcctgtctatcacctacacagcagcccccatcaactatgattcagttgactggaagcattaaaggtaaaaaagcaacacaaaataaagcaaaactctggcttcatccctttaggtttgatttataccagaatagctaaagacatagaaatatgaatgtaaatatcctacctgaagcctaagagggatgttagtctcccaggtttagcgttttccagtaacatagaagtctgtaaaacaccatcccattacctgcctcataacatataggaaaacttgtgaatataacaactagttattgttttaaaatgtgtaattaagttactttgcatgcagaacttctaaataattcaaatgactggcttttctattggaaaatagcatatattcatctgttatttcagcaatgattaatgaatacttgatatcaaactttcatcagtattttcccataggtatcatatcccctaccccaaattatttctgtacttttccttgcaaggtctctacttctcctacataaatgccttgcatggcgggaactaaatcaactacacagacccatacatccagagagcagaggtgagctggatacaagtggcttagagatgtggtggaaggaggccagagctccaagggaagggcagcaaggagacaacagcatgggttgcagctcagacaacaggtaaataaaaccaagcaaagctgctggtcacagatttgaccagggtggcaagaaatgacaagctaccatgagattcaacagtggcacggaaggatgatgagaagcaaacagattaggagaagctgccaccaccgtacatagaggcacagatgaccaagcagaacagcaccagtccctgcaaggtgtgctcagatacagctcagcacagccatctggccaggagggaatgataatgcacatggtgtgcactgcagccgggaagttgagaaccgctgtgggcacctcaggactgagtctggttaccctgctgatccaagaaatgaagccatctaaaattttgcctgctttcacaattttctgtgtgtgtgtgtgtgtattaaacaaagtgaactaagaagccttttattggagacataatgtactcacagtagtttcaaaatcaatggtgtcactcttcaggtaaattactccaaggcttgggcctagtgcagatgttcattggggcagggagcagagagcggctgcatctagatcagacaaaaaacaaaaataaggttgttaaatgaacaggtgatggtgatggcaattatttattttgataggaaagaactttgggacttgagtgagaggttggttgtttggttctacatctttgcaccagagaatggcgaggtacggaagggagaatggagaggatgttgtccaggctccattttcagtgctttcacctaactgcctgtgcagcctgggacatcaacagtaccctgtcagtgcgggcggagctgattttgtggttctgacttagaagctgagttgtgggtgacagtgggggaaggaagtagaaacagtgtccttcaaccttcccacagttgattcttctagtatccttttcttttttttttcatttattatatttatttattttttattcacacataaaaattgtatatatttatggtataaaacatgttttgatacatgtatacattgtggaatggctaaatcaaactaattaaaatatgcattaccggctgggtgtgctggctcacacctgtaatcccagcactttgggaggccgaggtgtgaggatcacgaggtcaggagatcgagaccatcccagccaacacagtgaaaccccgtctctactaaaatgcaaaaaaattagccaggcgtgatggcgcacgcctgtagtcccagctactcaggaggctgaggcaggggaatcgcttgaacccgggaggcggaggttgcagtgagccgagattgcaccactgcactccagcctggcaacagagcaagagtccatctcaaaaaaaaaaaaaaaaaaaaaagaattacctcatgtatttatcactttttcatggtgagaacacgtaaaacctactctcagtaattttcaatatatactacattcttattaacgatagtcatgaggatgtacagtacatctctggagttattcctcctgtctaaccgaaattttgtgtcctttgactgatgtctcctcagcgtctggcagccaccattctaatttttgcttctataaattaagcttttatagattccccatataagtgaggtcacgtggtatttgtttttctgtgcctggcttttctagtacaaaaaaaagcctattttttccccatatatcatggatgacctctagattcatccatgttcttgcaaatgacaagatttccttctttttgaaggctgaatagtgttccattgtgtacttttaccacatttctgatattcttgatttcatttcagtctctctctttattgcttagttcttaatgtattctagtgacacccattgatctgggcatgttctgagcattccctctgtccttcactgcaaaggctccattttcttccataggctctaaccctgaggacaccgaattaccctattttttcccctatacctcagtctgctattctgccttcttcactggcttattttctttcttctgttctctaaatgtagacattcctctagatcctctcctcaggctttgtctaccccagtcctccctgacctcaacaatcacttctccatggagagcatccacattgctatctttagttctagcttttctacagagctgcacacccacattctaaataacagctggttattggttcattcgttcctttgtccattcattcagtgtttatatagcatctatgaggcacctggatgaatacaacagggtctctaactttgagaagttcacatcgccatcaaatactacacaggcttttctaattcagaaagtttagaacttaattcattgtctttcctttaaaatctgttccttctctagacgtcccatttcctgccattggtattctcttcatccagttacgtgggcctacagctggggagtcatcttcaattcttccgttttttttttcttcctatatccaattagctacccaatcctgtagattctactctgattgtgattcctgaatcaatacctgttttctataccagcccctatttctccctttgctacctactgtgaggacatctatgaaaagctcctgactggtttcacttttccagtttttctttacctcttgtccatccttcacacaaacattacattaatttttctaaagtgcccttctaaacatatcacttctttgcttacagtcctccttgcttattggattaaattcaaacttctcagtttggtattcaaagctgctacaatgtagcccaatctagtttctcactcttatctctacactccattctacgctccagcaaagtcctactctttcctaccatgttcatggtatttcttcctttctttcaatgtctacatgtagcttcttcaagggccatccaaatgccacctcatttatgaagcatttcacaaaggagagtgcccttcttaaatattattagcacattctgtactactccctttgcatattctaccaattagaatggttatttgtgtaatttgtcttccttcttcataagccctttgaaagctgagacaatttttactctgagtaccctatagtgggccatgacttcttgcacgttaagtttgcactaggctgataatctgctgaactgaatttaaaaagaataaaccctcttgccttgagtcatagaaacggggactaaattgaaaagacctaaaagctcatctgcttcaaccccctcatttttcagacgaagagatgaagggaactgacttgctcaaggtcgcatccttgttagtggctgggcaaggataacagacataaaaggccacagactaatatttatcagtgcttacttggcaccaataggcccaacagatcatcagtaatgacaagaccagagagagggaggttggggtgtgtaacctgcaaaaatatattgtgttccaaaatataacaaatttgcttcatttatttgcttcaacaaaccgaactaataaatatgttttatagttaaatgttgtctaaaaaatgagggtggatttaaaaaacaaggaagcaaagttttctaacattaccagcagaaataattatgacaatactgtcaacaccactggggaggaggtgcggatggttaatgggtacaaaaaatagaaagaatgaatacgacctactatttgatagcacaacagagtgactatagtcaataataacttaatcgtacattttaaaataactaaaagagggtaattggattgtttgtaacacaaaagataaatgcttaagaggatatatgccccgttctccatgatgggattatttcacacggcatgcctatatcaaaacatctcatgtaccccagaaatatatacacctactatgtacccacaaaaattaaaaacaaataaaatgttaaaaataccactggggtgataaactcaggctgaaaataagaataaagaaatttctcatgctttggaaaagctgtgtgttcagctggagttcttggtgaaaacatgcagtaattccgtggttaaattcattactttgtagaaacaaactattggcaatctgctattatgccacattaacacttctttttccacctagcttagcctagtactcattctctaggtttgtttaaatgtttacttgtttttctttccttatattactaatttacttgtagaaatgcatagacaattgcctctgagtctgttcaaattttcttgccttgttcttctcttgtagtagaggaaacattagttgtttctcttctctatccttatcctcaaacagaatcattttctctcacccaaagatgaaaagcccaacaaaacatgctgtggggataatagtgtttacctaggtgaggaaaacagacttttccagggaatctcagtaattattacttggccagaaaagctcagctcttaaatgttagctccaatactacaagacctcatctgcatctcccaggtgagcgcttgactcactgttactcaccagaggaaaaccttggtaggtagcattaatcaaactctttttggccagtatggtggagccatgctacgcattgagacatccattaaatagcatcaccccagcagccacacaaacagcaaaatgggctcaagagctcttcattgttctttctaacccatcataaggctggacagattattgacacttcaccagatagaacttacttctccttttgccccctggcaactacattaaaatcataaaggaaatcactcatcaatagtacattgcagtgaaaaattatctggcaaatttacaaatcctttgtgtaattatataaatgtacattttaaatatatctaaaatctgatttacattgtgcattttataattaatacaaccatagtatgtctgtcctttaattaaatccttctttctcagtcccacatcctgctgctataatcttactttcatttttggcaaagtgtcacctagctccatcttctttccccttttgccttagtacacacctgagcgtctattaatcagaaccactgcatggtgtgtcatgttttattgcttaaagggtggttacactctaaaaaagattcggtgagaatgacttcatggggtttcacatttattctcttttaatgactttcatatccagtgtactcggtttttaagtcaaaagataattttgaggggctgctgatgccacaaattctccctagaacctgaaaatccagctgttgtctctgcttcttacatcatcactgtaataaagaatctgctcttggaacccagctggcaagtttcttgatggtgtcagaggcgaacagacagtaggtcacttctctacagcccgtttcattgttggcgtttctgcagatctgtcttggaagcccttagagagcagagctgttatgaaatacactgccacatatcaatgtaaggaactttctgcagatgtctactttgagtatggcctgtcccagtcctaggaaatcacaccacatcgttctaaaattatagatggggggttcatgattaaagtttacaagaaaggtaatagtaacaataacagctagcatttattggatgtctaaattttatcagggactgcaccaggcatttttataaatgagtatgttcttgtttaaccctcatagcaatgctatggtgtatgttttagtatacccattttacagataaggaaaagtgagacttaatgggcttacgtaacaggtcgaagtttagaaagctactggatagtgaggccagaatccaaacccagatctctctgagtctaaatctgtactcttttcactatataacaactgttccaatgcagcatggacacgggacacatttctagttcccgctgtgatcacagtacaaggaagatgcttatttccacgatggttcagagccactggaaagatctgggagcacagactccaggagaaggaactatttcagaaactgccaataagtatagtcccttccctcctcctttctaattgcagatgagaatgtcctctaacagtcttctcaaactctaatgaacaaacgaatcacccagggcttctgattcagcatgtctggggtggagcttgtgatcctgcatttctgagaagctcccaggtgatgctgatgctactggtctgggaccacaggtcttatttctgacactctcctttctactagggttgtttttgaaggagcagttcaagccaaataacttggctaacagttcacacagccagccgactggcttctgattctaggccagtttgtcaggtcatcaggcattacacagaattcaaggagttcttagcatagagcacactgtcaaaaaattgtttttagatccccaagggttttcccctctctctggaaattcaaaatgataatgtctctaacatgtaaagttcctatttttttacattattgttatttttaacaataattatctggtaataattcaaataacaccttccctctgagaaattcaatgagctttactaaccttaattgtctaacagcaattcccaggtgaagataaagctgtctcaaagatcatagtaaatttaaaattgttccacttccctcgtttctttgccccaaatgtagtggtgagttagtggggacgggttactaattggcaaaggcccactatcataatttgaggcacagcaaatttcataaaaaggatacatctaagaaatatttagcagagaggtcattgtggggaatacaatgttagaaaaaaaagagttagaaagtgtaagataagaaaagagaaagcaaaatcaggactagctgatgacctccgatgagacatttaacctctaggtggctcagcttttctatctgcaaaaagaggaggttggttttatgatttttaaggtcccttaaaactctaatagtcccctgagaaggaagatgtgggaattaagtagctcatcaacctgttaaaccattaaacatgttaaggaagtctatttgacttttaactttttagctaattacccgaaacaaattcccaagtctacgtcaccagccccacctctctggaaagtggtgagaaaaccatttaatgaataaggcaccaaagacatcacggccagataaactaatcaggaacaccatcgtcagcttactgatgctgtgataactattttactttttaggttttagttccttaattaaccactagttaatacccatgtccataagaaacacctctgatggcttgaagacccctgggatggccctgccaacacaaggtggaatcacaatcccactgtttgtcacattaaatctatgttaattttctccatagagacctcttgattcctctttgacagttcataaactctgttaatataagttgcacatcccatgccatgagcgttagcattatcagatacagttgattcttgtttaaaataagagatcttttggatcagagtacatgtaaacacacacacccacacacccacacacacaatcatgaatttctggtattaatgaatctggcctggtgatgggaacccctctattatgtcaccggatactggaaccttcttatccagaaagcctgccacaggtcatgttaataagatcgttttaaactttgtaatgagaattctaacatgagcatgatttatgacacagcattttatttggtattatcagagtttcctataccttacctcttacagtgagtatgtgttctgaattaaccattatagtttgtggtaaatggaaaaaaaggtacagagaaacatcacagtggcattactccagataacacactctgtcactgttcccaaagtgaacatcatttccctcttcctgctcccatcacttcaatagtaactttggctattactgactaaatgcttaccgtgtggcaggcattgagccttttcacagataactttattttcttacaattactctttgaagttgggaattatattcccattttatagacgaaggaggtgaaactgatactcaggaaaggtacagttattggtcatcagtcatgaaggcagagggtagcaaagcagagttaagggccaggttctaaccacatgttctagagcttaacctataccaggctcacaatcaccaaaccactgatctgccttcattccactcctcttcatttgtgatccccaccattggcttaggctagattcttcttcatggctctctcatgtcttcttgaatatttcttgaaatttctcaaaaccttctacacttgatttatgttttccctccctgtattaataatttaatccaaaaactcattaacacttcttttcaacagactttatcaccccttttcttagctctcatactccttctaaattactcttttgaggcctcacatttgacatcagatgttccacacccagctattgaactcactttcccagaagcccaaggaacctattgttttcagctggttcattagtaggccccagttggccttaccagatgtatttgtccagtttgatcttgccccatgatcaaccatttcaacactgtcctcagtaaccatgcagatttccttccttttctaactttctatgtgcagtgcctccttttacattcatcaactgtgaatctgtatcaccattctccatttgctcccactctcagaacaaaaggctacacatgcatgctacctggacctatgctcctgcccactgtttccaggtacaacctatggcagtttttcttagtttgttctcctttatgaagtcccattctctttttcagttgatgagctagcatcctagtttaataaaaggatctacaccatgcagtgtggtaagcttattagctctcatctcctctaatatctctgaattttcattattttatttcctcaggatatatcttttcccatgttcccttcgtatcttgaaggttattctctctacttctctttatcttcctttggtttcatcagggatactttctctgtagctgatagcatatcaatttctaatagtactagattaatcatcaccacataccttttttttttttgtcccgcattcaactcctgcccttcaaaaatcttttcagatggtgtatcttaaagtgtgtttcatactggaacttcaagatgcatctcaaaaaaagttcctcagtcaagtaagtttaggaaacactgaaaactatatattctattttcaaactcgcaagtgtacacaggatattaaggtgctggaagcctaatctttgtccaggcttaccggattacagactcccccatccccctttttaatggaacacttatttaacctcagaatatgcttcgggaaaagatgctttaagggattcccctggttccaaactcttaagcctgggctcggaaattcactgactccctatcaaatgagtcctctcagatttcctttccattaatactccacatggtctaaactggttaacttatagggtgtcagaaagactaagcacatttctatctctgagctactgtatataccagtttggctgcttggaatacctttatcacctttcaaaaaattatataggacttttttctccttcagggtccatatataaaaatgtatcctttatgaaattttcccttgtgaagactgctttagcccataatgttttctgccactttttaagtacttcaataaatggttatggtttactgcctgtttgctatattattagcgagggtgtacatcctcttgggtaggaaccttgttttatacactacagagaccccagctttttgagcacagtaggatgttataaccatgtcatcggttaatataaacagaaatggatggcattaagacatgatggtttaaaacccaatttctgtagctattggaatagtttaagatgctaacagcccaggtgaaatgttccatcacaatattgggaagaaacactacccgccatcactgccattgccctgaaaatgataccatgtgtgtctaaggatgtggataaaggctagatacagaagagcaaaggcagctccgttcttaggtgaaagtaagaatttgcattagttaacaccaaatggcgataagattaaaataatctaggaacatcaagtgatccatgaaaggaatcactggaatataccaatggtaaaattaccattcataatcattaaatcatggtaacttgatgaaaagaaaaaggatattttcctacttaaggaagtcagggtaagtattgtctgaggttccactgtgtgctattgtgcctggtatacagaatgtgtagcaactatttacagaatctgctactgccttctagtcacattccaaattctatctctttgaatcagtctggagacacaatacattggtgaattcaaggcagcttggcaacgactggcacaacataaaaccccaaataatgaattccatctttcccataaagctcttttattgacacaacatacaacagcgcagggcaggttgtctcgggctagtgtgtaataactagatgttaaggggccctgagtttttcagattagatgttatctgaagttgggactcagcaggttccctaacagtgaatttttagtgggcctacgactagaagtttggtctcttgatgcttagtcagggagttttattatgtgagagagaaaagtatagctttctttcttaaaactgcagcaatttcatattttagcagaagagaaagtgcattttattagagtataacctgtggagtattttgctaccttcctggatataaagcggtatacaaacaaaaaatttaataaaaagctattttataaataagaatgtttacttgtgtttaccttaaaataggtatagcttgtattatttaacatgtgaaatagaaggataatggtaaaatttcataaatataaaattctgtgtccgtcttcagttaaaattcgtaacagtgtatcagagtgttggttattagtagtaatcaataataagtattttttaaattggaatttttattgcaggagattattgggtgggtgaagctaaatggcctagatgttttcctgtcatgtcaatacttaagaattgtctttctgggcaatttacacatgtgagagtgaaaatgaagggtggcctgcctattgggtgtgtaacaggccaccggggcaagactgctattttctgagagccatgggcagtttctgcaataaagtatctgagtttcttctttttgtagtaaaaataaatagtttacttttatgttctgggtgaagcctgagatctctggatctctttgctggatttcactcttggtgggggcagggagatactattggcaatgctttatatatattgacctagacatgttaaagattatgtggtactttcatgaacactctaaaaatgagttctccctatcatgagttgcatagatgaggagattgaggtggatggggtgaagaggaaggaaagggcagtttaagcgggctagctaatgagtagtagaacttaatctaaaaccaagattttcagcagaaaatgctttttttccccaaaaaatgccatggttgtcaacaagctttgtagcaaatctggggcagagcactagatggagaatcagaagatctgccttgtcttcctggatctggtaagaaccagccgtgtgaccatggccaagtcactaacttttgtgagtcttattgttctcacttataaagtcatgagcaaggaatcaatgaatggcataatacttgtaagctgtaaaatctctctcttgtaaaatggtattgacaataatgtatgctttgcctatcttataaagttgtgaggctaaaataagctgatccatgtggaagtgctttgtatagtgtggagtactgaatcaatgttgtctggaagatttaggaaagggtcccgaatgtgtgtgggaactgacagccagtccacttccattcaggttttaggagaagctataataaagcactggcagcagctcaaatcccactccatcctctcctctcccagcacgctgcagagaatcacttgaggaaagttacttgagtgggtgagccaaatgctcaagttccaacctttctgagtagaagccacagtgaatcctgagccacaacacaggtgacaatcactgttcctccaggtgtgtctgaaacactgggggaccctagggaaggaggtcagacgtcactgctcctgaggacccgttttctcctgtacacagctccagcccacatgatttcacctggcagccccaagagacaaaaaggatccagaattagcaggagcctcctctcctgataacctaagtgctctgattgaaaggcagagggtatcaggagaatggctgtaccgagtcggcattgatttctccagcctttgtctgtgtctggtttctgtctcgtttggaggtggttactgttactacaagcagcatgaatcatgtctctgttaaaaaacagagcttcaattgtcttacataacccctggtaactgaacgtctaataatagcaagccatttccaggtagggaatctgtctacctcccagacacacacacacacacacacacacacacacacacactactcccaatgcttcacagcacagtgagacagacagggaggagacagaaggagaaaggggacagcacaattgaatttttttgtgttttaaaatatattgaataatcatgcatcatgggatctgataaccaatatacttagctgagctagtttaataaactgtagaaaacaagaattcttctttaaagtatttgaaagtatcccaatccataccagacagacaccttctctaacactcttatactgcataaaaaccccaaacccccaaaacagagtggggtgaaaatttcactggattgtctgctagcttgtaccaactagcttcaactttcaaaggattttttttgtcctcttttttgtttgaccagagagtgatattccaaaggttcttggccgagatcatttcataaaattccagagagtgaaaggcaactgaaaacatggctgcagtgttccaccatgcagactatgtaatgtcaggcacttttgcccgagccactttctttgacggagatgactttccatctgaggacttacatttttcccatgagtacactctctggcttgtaatacatgatgaggtctttttatacttgatccccactcagctacccattaaggtggctactgaaataaaaaaaaataataggagaggctgaaaaatgatttttgaaaaatcacaaaggtaggattttctttaaactaccaatttgtttgagaacaaatacaaatgctggataggaagtttaaaagtttatggggaataataatataaatgtataacatatatacgtccatttcctcactgcttcaccttgcccatgctaggaaaaatcacttaaaggctgtattttttgagtgtgcattctcagagtgaagtagctgtacatatcatgtaaattggactggggaaggacttcgcagaaaattacagatggcaatcacatcctgccagtcatttggtctagaaccagagaagaaaaactttcttttctcttttgattgttcagtaacatgaaacagtggactagactagttcaaaccaaagaatgttttagggcacacccactttgaggaccagcacctggctatgctacatgctcttcaattgtttaggcatataaaaaggagtgatgagatggttatatgtcaaaatggctgttctccctccaaacaggatttgattggcttatttgcttttggagtactctccaaatccataaacaaaggagtattgaattgaagaagcaaacaggagaaagaaaaaggctaaaaaggaaaagagagaagaagaggaaggaaaaatactaatttctcagtattcctatctgcaaatctggctggatttgataacaaaactcctactactgttctctaatggtctttgctgcatgccatatggacatggcttctaaaggggatgaattctaggttttcctcacaaatatccaagcacagaacagcagggatcttgacgactaaatcatcctaactcacgacgaggatcacagaggtggaacatggctgttgggactagattcttctgcttatttcatgtgctttgtgaattaaattgttcgtagagttggaaagctggtggactaaatgttttaataaaaacagccatgagacacaacagttttcttcacaaaggctttcccccctagctactgtgaatatattgctgaatggttctgacttctggaagggcaggaggtttgcctcttctctttgcctcaaaaaccaggcttattctatgcatctgggagatgattatacttacccgaaatttcaggatactatgtcagacagttccttcacagtggtgtgtctggcacctaagcaaggacttggtgggccagacacatttaaaatgtaaaagtggatgattatattattttgcattgtaacaatgagagtatttctggattgtagctgacgtgtagatcatcataaccatatgtggcacaacaaaccacacaacattgcatcagaagcttgtagttaatatttttaaatgattgattattttgaaatagagaaatggtggatgcttttttcgacctctttaaataaccacttattgaatgtctattgtcagtgatggactctttcttcacagaagggagctgggctatgccagactctcaccatgttctttctcctctaacactgaacaaaatatcagtaaaacaccaagtacagctggttttgaacctagtaagaaatcagtctgtagtaatgggccatattggtaataattggaactggtgatatcgatagcagtgggaataactgacttacaaaggcacagcagttcaggaacgtctcagggactcagagtgggtaaatgcgtaaatctgctctcacctatttatatgctccaacaaatatctggaactctagaaacttcaagagtctaatatgatcaggccacgtttataggtattataggattcatataaaataaggaggcatacatgttgatctagtgagcgtctccatatttgtacaacactcaggatatgtctgagaacacattttaatttttagaatcagctatagaatctggcagttattataaagcaaacttcacttcaaaaaaattaactgagaagccagatgataatccagatatacaaaacaacattggtgggataagtcaaataattctctaaaatgattatggagaaactgaagaaatgaagggcacctatttatcatatgtgggtccccagccacgtttgtaatctgttgtgtgaccttgggcaagtcatgaaacttctctcgagtctcatttttctcatatataatgtgggagtgttagattagatggtttttaagattctttccagtaataacatttgatgattctaaagtaagaagagatgaaagagtaattcctctttcctcttgttttggtaaatacttgctttctcctgctccgtgcctatgcagtttgcagtgagtattaggtttctggactcaagaagtcaaatagtaaatactgaagctatttttccttgtacacatggacaaatcataggggaataatccttcctttctttgtatatcagtgtctcttctcaaatcagacttatgcctaaggtaatcacgatcattctggtactaataaagatttttcctcatccttcccacaaggccctcacccatgctcatgaaagcttatgtgattgggttatttctatatttatgtcttggctattttttctctttcaacttgtttatgaagtccctggtaagcataaagctgcaaaaacaaaaacaaacaaataaaacaaaacagctctgtttgaataatttacttcagttgaagcagtataagaaaacatcctaacgccgaggggaagaaaacaggtcataaaaataccctggtatcttagaaaagactaaataaaagcttatatcaataatagtttcatatgttattgtctttcattttcaaagagaatggtacatattggctttatagtctggtgtacagacgtggctatttttccccatagctctcaggtcagtgcatcctcaaagccaagaaggcccagagcctgccgagctagctttacataaacaaaggagctacacagaaaacccaatacccggagcttatatcatatcctgactaggcactctggttacccatgactcgctcttttccatctgtgccctgattctctgctggtttaattcccttcacctagaatgccctcagtttgcctccttttactgctcagaattccctctggacacaactcacgactagcataagccccatttccaagaagcagcttagtttgacccaacttagtttgacccagcgaaaattttcatggatagcaagtgaaaattagtccttgtgataactggagtcactgaaaccaggtatctaggaagcactcagagaataccagagaaaaactttcaagggttgcagtgtcctcataggaggaaaaaaaaaatcctagctttaagaacaagcccaatatagaagctgtggtatgtaagagaaaagttgtagccatgtacgggaggaattgtgttaaaacagtctgactttttttttccaataaaggagaagagatcctctgtttcttaaaagaagtttagtcattggatatagcaacatacagtgtcataaagtttaattgcattaattatgaagctaaaatgtctacattttagtagagagaacatggggcatagctaaatggcgaagacataggaatgtgtatacaatttgagtttcacttcctccaaatctctcagttagaggatccctctcagtctgacggtcttatcatcaacagcttcacaaactctgacaacacctggctgggtttaagggatgggccatgatatatcttgagagtaaaagatggaatgaaactcagaaatgctgaatgcttttatatatgtatacaattttatttatgtgtatatttatatatcaatatatacaaacatatatatttgtatgatgtttggcaacctcactcatggtattcctgtgaagtaggcatgtggtaaacataattagcccattaaacagatggtagggctctggcatatctcaccatattctaaaatggtggagctgtaagcagggactaaagagagtgtagtttgatacatggctaactgcaaatctctgtgaattgctactttcctaaagacaatctgggtaggctgcatttggctgagaactggggatagtttaggaagctttaaaaatatacaaagggacaacttttcacattcattcagatatagtatcttcatttttacttactagaggcatttttttttaaaaaacagctttttatcttaactcatctgtgttccaagcaaacttccaaattgctgagcagattaaaaaaaaaaaccctacatgccaagtagaaacactgggtaaatgttattttttaaaattgtcttaacaaagtgcacttttggaaaggataaagttgaaaagacgtttggtactgtaaacacttagctgtcattgtagcacagtgaccaaatacgtccaaaagcacatgtaatgaacttttatccgactgaattatatgaccatggcattgccactctatagtacagcaggcttcagagatcctgttattaaatattctagcctaattctttatcatttgaaataggatctagcagaagtgaaagagttactaaaattaagacttgaatttacaagtgtgtttgaactggcttcaggaagacatgaaacatcaatacatctggagaatagaacttgcaattgactgttctttaccatctggtctcaagaacattttctgcttggaagttgcataagcaatgaaaaaacacacaaacaacttcctgtaccatgtttttggtcacttataatgacgcattacaaagtaaaccagctaaatatgagcaactgcgccttactcgagatgacaacatacattatataactaagatcaatgaaaaagaacatctttattttaagagacctggacttaaaatattcaagaataaacatccttccttctaaggtgtttgtactccttctaaggtgtttgtactgagtagttttggctagacaggtttgtagagtcactactacaaaacaatccctatattttttcaaactgaaaaaggatataaaaaagcaagctatattgaggaataaaatgttccatatattttaaaatgttttttaatgacataaacttgcctttttaagcagtaaaatatattctacacatgtttttcatagaaaacttttacatatctttgttttcttaaacacagtatgttgatgtaatttaatttttttctatgatacagggtcatccttgtgactattcattgttcctgttttacaggaatacacttttcttacttgtggtgagaactggcctcatcccttggctcagcctaacggccacagactgagctatagcccactagccactgccatagccaactggcgtcactgtcccagtttttcagacccatcgcctctaaatcctctctgctaaatgtattttctaatgtgctttggattagaaaatcaaataaataagaactgtagagacaatactgcttgaatgcagggtttggtagaagatttgggggaaactcatttggacacttgaaggtcttcagttacttctttgctcagggttgtaactcagagatctgaactaccagaaagtggattttgaggtattattgtgtaacacagagtgaaacatttatgcacttttattgcaaggcttcttattttaaacagggttgtccagaaatccattcttgattactttacttgataggtctctgatccattatatttcactcccttgatttcctccagcaatgtaactaacataatgacaattgggaagtaaagaaatagcacatttttaggataaggtgagagagtcttggtaactgacttcatcatagtgatggaggcaaaaatatacagtcaagttagaaaacttccctggactgctaatgggaactctggcctgactagacactgggaaaacattaaaaactgtgaagttatttacattaattttcagtgttcagagaagtaacatctgatcatcttttttcctcttctccaaaaggagaagtcagaataattcgcaatctgtgataggatagggattgtatcgaaatttgcctttttattacctctgaaaataggatttctaagcaaactaataaccttaaaactgttgggaggaaggatgggggaaaccaaatgtaacctatatgaggggggggaaacatctttaactactttaacatacacacatctgataagttactgaaaattcttatttattttgaagttagtgctgaagaaactctatctgttaaaacttagaaatctcagttcaaagtacatggaaatattccatgatcacgttttcagctcattctagtcgtctgtctcccagtttatttgaactgatgaaattttacaaaataaacttctttagctttctagagttacgtttttacccatgtaatctatttgttaatttttgtagcatgcttatatgataaaaaatactatgtaagtactgagtttgcttgttatggattatttctggatacagagaatttgcaagaaacttcagtttacagcagccaaggttactgcagactaaagcagaagttcaggcataaacttgtcttctaccagttttccacaactttgctgttgacagcatctgaggacatggttgatgagttctgaaaatcattcacaacattgctaatgtttaggaatcttatagctttgccggacctttccataatcacgagagaaaacctttgacgaaattagaacaagtcctcataccctcccttcctttcttctagtgatttttttttttgtattggaacaatcgaaagattcaatgtttttaaattccatagaagactaacgattgaataattttctcacatctctgtttgcactttcgcagtctggttgcattgatttgtgtctcacaagtagacatttcctttgttggtcacaaatcaatgctacagaacaaacctgccagcacattccacccccacccccaattttttgcagtttaaaaacaaagcacatttatatactttttcttttaaaaattactttcattggttagtaatacactaaaagaagacaaagcctcagagttaaaaatccccgggagaaggagctcctctctagctggtctctgattctctcacactgcctggagcaaagaactgcctagtgggagagcagcgctcgtccgccgtccgctcctggtgtgctctgttaacccaattaaggtcctcgccttcatacatcacaaagctgcccaaagcaacacactgtgatgtcacagtcagatatgatttcatggcaggaaaaaaccaaaaaggcagaaaaggttgaacgtactctgcttttattcaaatcttctaagagggggaaaaagggaagacttttttttttttttttttttttttttttctgagagaaaaagagcacaagctttctgacgtgaatgtgaaaactccgttctgaagataccctggtgcttttaccccaagtggataagcatgaataaagaagcacaaagaaacactgtcatcaatcagaatgctcttgcctacacttagctacaggtggaaagcaagcaggcacgatttgatttacctagattaaaagagcaattttctatcttccttttttccttttaaaaatagccaatcgattttggcctagctattgctgactgtacaggtccattttaatacaccactgattaaacggtatgttcatggctgaaggcactacagcaggaacaaacagaagcagctgaaggaagggggtgggggacaggcgagagctccaaaaaacactccacgaaggccacaactactcggcacttcccccgtagacagttgatatagcacattttaggcttgaaccagctataattctgggagtttgaagcctggaattcatttagctttttaattctgaccttaagaataaaaaaaaatcaaagctatgttttttaaaaaacacaaatgagggaaatattgtgtcctaaactgcaatgacatctgaaatgaagatgtgcctcagaaagatgcttcttatgaaacacttgaaatttcataagttatagaattatctactgaaagaggacctagttgtttagagactttgtttagtgaaattgcatgtaaaagaaacagaaagaaaataggacttttatatagggtgactatatgttgggattcatcaggcagctctcagaagagggagaatatctctactagttctagaaaataaccatcttgattatcatgagaaagtatagcctttatcgaagtctgggtggcaggaaaaataaattagggagggaccttctcaggcaactcagagagagacccaacatccagcagatgtttcttctgagaaagacaaggtccatctaacaggtgagacatcagctgaacaatggatgccaggacatgggaagtggctctgagaatcagcgaactccatgtttaaaaagtcaacccactttttttttttctgtttgcttactgattccttgttcccttctctcctgttttctctctccaattatcatttacttaatttgaaattctggccttaatggggacagaaccgtatccagaggtactattaagataagaaaattcaggaagaaagatttaatgaggggcttaggagtttttggaagaggaaaaggacattagagagaaacgagggaaaaactaagaaattaaatatcagcctcagcacggtggctgtagaagaatagcttctgagagacacagatggtctgcattctccagaacaaaaacaaacaggaagtaacagggccagagccccctctccccttcattcctctctccagtgtaaattggaaaaaaactgaaatgtgttcacatcaaaaagttttccttcaaactctagcaagtgaccacagtaaaagaaacaagagagcgctggttccagcaggtaaaatgctgaaaggatgtcacatcgtgggggtgaggaagaaatcagggattaaatacatacagtttggagaaaaatcaggctctatagctaactaatgatgaatggagcagacaggtggcagatttgaggtccggaggagaggaagggctccattttgagccgcccattttctggaggagaggtggtggccgctgtggaaaatggctactcctggggtgcatagggagacaactgacttagtggagggaagggaagaaataaactagggagtcatccagggacacatcgagttagtgagggttttagtttggatgataacaagctcttaaaacatggctttgactcataaaaaatgtagctgggatggatggctacttacagggttaaaagcaaactgagagctcttctattcccaaatctgaatgctgaagtgctgcctagaacagcaaacatgtacatgcaaaatatcaaaaatacacaaagtgggggtgcagaggaggtgcaggatgcaccagtcacctccttccccacacccttcaacagcacagagctctggcagggtcatcaccagtaaaactggattcttacaagccattccacagagagaaaccatcccaggtcccccatggctccaggcatcagtgaggacagttttcatgttccaaaactaattggacagtaaggagtgtctgtaagaataaaagcgggtgggaatggaggatggaaataaaagggaaaaaaagtgtccttgttgaaagttttaaattacaggctcagtaaaaaactggcattccaccacatccggtctagttaccaaatggaaaaatagggtcattaacatgtttatttgaattacattagtccttctctttcatatttaatttattctgttagaaaaaaacacaacgctctgcatgctggtgaaaggcaggggtgtaatggatcagggagctgaaatacaatgatctttacccattatctaccctgctaaggcttttcagaacttactaggatcattcagggattcttccctcacaagggagggaagggtacagaaagatgtaaggtacagatgctactgagtttgttaaaataatattgaagcacatttaaattaaggagtggaaggacgattttaatatggaaagtttacaaaaagaagaaaagtttgggataaatgacctcttctgagactgaatgtccagatgcaaggttggtgctaggcttacggaacatctccacatgatatggaagttgtagaacattgtgttattagtattcggggtattaaaaggcgaagtctgcaggatgatctcatgaggcttgctgtcatccacaagaggtcagggcaacttcagtacaagcaagtataatgcagtacattcaggggaaaatgaaacaaggtatattttcaggaagatgtccagaaatgacctggctatctttgtggcggtgacatggaaaggacatagacttagtatcataaggccagtccctgctctacaacttactaacaccatttgcacaagtaattcaatcagttttcctcatccataaaatgggaacatgaacagttaccatagagttgtgaggatcaactgagacaatctatgtgaaagtgttctataaagcactgtacaaatgtaagacatttattttctgaagacagtggtgccaagtgtgagccaagcagtgtgccaaatatcctcagaaataggattggaaacaaagcagggaatgctctgacaaagctgaagaggacaaggatctcccatctcagtgtgactgggtgtatcgctcactcaaacctgaagggatttctcaccgggatgctgaccttgggttcatagactaactccacagtaggttgccacccactcataatgagtcatttaaagttcaaatcttacttcatgctagcgatgctagcacagaggcaagcagttttaggctttttttggtcacagatttctgctgccattgtcaaaacagtagccccaacctctaactgcaacctagggcagccagcccaacctagacttgattctggtcacttttagtggaacaaattggctcagaaaacatcgccttctacttcttctttaggatatccaaaatgagcaaaaacttcagtctctagcttttccttaagacaagtttctccctttgctacaaacggaatcacatctttttgttatgattcttcctctatggtccagtttgttgaacattttgccagctgtttctaagctgaactttggcttaaatacaattgcagtcacactaagatcattctgttttgagcccagagcatagagtgtaattttgatagaggaaggggagagttaaattacgatcagctctagtaaaaggtaacggcaactcatgggtgggatactttctggatgaagtacttcaaaaaataaataaataaaaagaataggagaacgttcagtattaattaaaataatcatgacataagatgaagatttctatttataatgataaaatccaggcaaggatatggtaaatgtctataaagaaacaaaaggtctgggaaactgactatggatttctttttcaaattctagtatacgtgaactggaagtcatcttactacttttcaaaagaaacaatttatgacaaactaaagaactactttacacagtaggcaatcaacttataaaattcattaaaggtcgatgacataaatagtatcacaaaggtttagctaaattcatggataagtccatagtgggttattcagagaaactaggctatctggaggaaaataactctaattctttaagttagcaacaaggacaattgtgtcttatataacagtttcctgtccctgtgatcagaaaatgaatgctgaactgaaaggaccataagcctgaaccagaggggcttttcttataatcacatgcttgtaagaaagtagggactaactatagtgctgatattaagcctgctggggccagaaggtgcacaaattcttgaacctgcagtcacatatgtcacattacctaagctgtattatgccactccttctctgcagcaactattatcatctccatattacagatgagagaagtaaggatcagggaagttcagagacgaaaagtaaattaacaaaggtcacacagctggtaaatggcagatttgggatttgaatttaggattatctacttctgaagctctgctaccacactgctgctgttttctgcccagtagcctgatgtattaacagcttaagatgactaatttaacctgttaaagcgatatgaagtcttgctcttcatttgccttgatatctaaactgtgtgtgcagtagcttcttgtcatcaaatcatgtgctcatctatggctttacattaaagatgtctccagctctcattaagagggaacaaaagaagcaaacagatcacgaggaggtaaaaggcatgctgctatggattattatagagtacctcagactataatgtatattaacagaaactcttctctatcaactaatctaaagactcattcttagttttcctaatctaaactcaggtactacaatagaagtaatatccaagaagtgaatgaatatgatgaattccaacaacctccttgctttggtgactctaatgttgaatgggatatcaaaatggaagatgagaaacacaagaaatagctgggttgggggagaagcacgatgaggagaagaaacattagagaagaatccggagtttactttcccagactctaatttaatctgaatgagctttgtttctccacattttgaagaaaatttaagtttagtaataggagattgtgtaatgcaagagtgttgctagcctaaaggctgtgataacatatcttaggagctctgtgtccctcataacaaaagtaacaaacctttcaaaattatttgtggccttgaaatataatacaaaatacctgtatcttaatttctatccttgtaaaatgggaaaagttatttttatatgaaacaacgaatacataaaatactatatatttatataaaatatataaaatataattataaaatatataaaatataaaatgctatatgatagtatataaaatactatatattttatataaaattattatatatgtttacatgtgaataggagctatttgtgagttttattaaaagtctaggtaaaagtaaagtcatctatactcctttctctggggttctcttccctttccttttgtatatttttgctcccctttctctgccgcccccccgcacccacccaggattttaaccacagatgtaatgggtttctgtaacactggcaactcatagctttcacaaatgttcccttggctagggaccacccaaatagtgaccaaatagtgactctcactggctaatgaaaaatcaatgtggtttgatatcattaggacaaggtcaaaataatcctctaagcagaatttccttacattccctcaacaccaatgtgacaatctcgctgcaaacaaggcatagggatgtggcactgctgaacctggtaaagctatgtcattgttaactgaactaaaggaactatcagtgccaaagaagaaagagagtaagagaaaaatgtcagaaatgactgtctagattcagagaaaaacttgatgaaggggcatatagggatggaagacatcttcgactgatgaccagcagctttgaactctgcttctggctcttgatacaaatttgatgtgttgggtggtacaaaatcactacactgtctaggcctaaatgccttcacctgtaaagtgtgggactcctttcaaatctaaagttctgattttgtgtcttgtttggctggcttactcggttagaacataggtttaataaggttaacattagagattcagttttcatataaatcagatggcctgatataatactttgcacatagtacttaataaatatttgctcaatgaataaatgtcttggaatagagaaaaactctatttcatagtcaaggattctaatttagggttaaatggagtggggccaagagagagcacggggcttgatactaatgcatctgaactcctgggcgaaataacttaaaacgtgggtctcactgacattgagtcagtggtatcaccatatagtagttgtgctacaagaacaatcttactattcagactctttgaatcacctgaaagtgttcttgccagtagcctcttcccaaaagagataaccaatcctgagagaattccctgattttaagattgcataaatagctcatcaaatccctacaacattcagttgggatatgaaaattacagatatttttttcctcttcacttttcacatggaaaaacagaagtctgcttccattgcagtcaccccatctcctacaggggtgggaaatgacttagccagtattacagattgagccactacctctttgtaaatactatagttgagcatagaatttgcccacgtatggtacacccagggatttaggtggcaatcacatgccagaattttgctttagataatgagaatcaagtcataaaagaacttgtgaaaataaaaattgagacacttaataatatcaaccacctgatcattgtggtcagacatatgataatttcaattccttagcaatacttaaaaaaaaaaaaaaaaacaactaactaaatagagggattagaacctggaagataaagaatcaaacattagaacaagtaaccttggatcataaatattctctgacattttcaatttgcttgcaacatacagggttttgttttgttttggttttgcttccatgagtgtattgtatcccccactttctccccttctagaagctggctaagtatagacgcagacggtgaaactcaatcgcagagtgctgacagagcttctcttagggtctacagaacagatctactgagtctcacatctcttggtcagcagcgacaggtaaacactagctttattttagcagctcagctgcagctccatgggcagctgtccttactgcacataatcagtccctcttttcagggggttataactcaactatcaaaataccaaaatatgctccggtttgaaacttggtgtatagagtcccaagcccaggaatgaatgtggtttacttccaaatttaagaaaatattgagttttgtaggtcatttatttactattttcaaatatgtttgaagaatcttttaaatgccataggaaaatgtactaaaaaggacacaccattttaatacctttggtgattcattctgaatttcagcacaccactgaaagaaccaaatggtggtggaaaaaaagagtttgttttattttcttaccaaatacagatgttttgaccacttgggtcctcatcagtgttcaaaatattagtgtgttgtaacataataaaataaaggcgttaacttctttgttttgttcttttcagtgatgtgcagaatggattaacgagttcttgtttctggccctcgtataactcaaaaactcgtttcaacttaaataaattaagtaagtaattagttcataatatggcctaatcacctctggtattttgaaacaaacaaaaacacaaaaatggctgttgcacatttgcacttaattacttccacagaaaacactcatgtggactttattacaggtgacataaatttcaaatctaagctttgtttgtgatagaaacctgggttatggtattgtgtagacttccacgaagattctgtaaccgtccctactattttccttaagaaaatgaaaccacagtctatgaaaccacattcttgcgctcttaattggcaaaagaaagtgctttatttcaaaaactctggagaatagtttacttcctacagaggctcaaaggacgttaatataaaaggtagtatcatttctggaatttctgcagtgttcaatttttgctcttggagtctgaacagttcttgtttgcatacacgtctatctgggaattgctcttagtgatcaggacagccttatggaaatccttccagatgaatatactcaatagagcaaaaaatcttgctctgtctttaatgtaaaggaaaaaaggacttttaaacaagtgtgtaattgtgagttctagccttaaaggaactttcttggcttggatttcttctaccctccccttcagatacttaataatcaaagtatatgccaagaaactaatgatgcaaaccagagtattgcacatgaacttggatcgctttcccattgtgtagtgtgtgtagtgaccaagattggacccaaaaagtcgatgatagaaaatagacaatgcaacataatcaaggtacgcccaccttgggtaaattcactaacccatttcctatccttcataaatgcatataatgattctcagtatagattctgaaacttctaggctaatctggccatcagctgtgaaaggaagaaggatcaaccttgattagtaaacttccaggtcatttgcttggcatgaacccactgatgtgttagctgcatacctcacaattctttaggtgttatctgatgttaccaagcattcctgatgccctttgaatttcaatacagaaatctaagtacaactaaacatttccccaagctgtgacagccttatggctattactcattttagaactgagaccaacttttcttctgacatttgacctgggagagtttcttctttagctttctgagtcatgcaaatttattcaaattctgtattgcaacccttgtcagttgtggccatacattcacttagtgatatcttacacacaataggctctcaataaacatttgctttccagaatgaaactagccttatcataagaaaaaatggaatagatttcaatagagttataaatgaactagaagaaagactaatagatcttgagtatattaaaaaaaaaaaaatcaagcagtgagaacagttgggttttgatacagtttcccaagggaagtagtagaagtttcattactcagggcattttaaagtagaatagacaaaacactagtggggtatgttgaaataaaatatgcgtagtccgtctgtgaattagtgtttactttcaatataattataagtgaagcaacactgtaatgggaatttttcatacacaggaaagctatggctactatgtttccacatcgaccatatgttgcacatattggttgctgtggatgtgtatccctactgccctctagtggatgaaatgtaagacctacctgattaaccagatctaacaagctactggtttgggggtatatcaatctttaatcatttagggtagaaagaaaatagctgtgttgatgcattttccatcaaattataaaattgaagggcattaaaaacaacagaatcaaactctgtaattaagactgccatttaatgtttgttcgcacacggtattcatttctgtgtatccctgccaaagatccattgtgtaatgttgtcctcacatgacattaaaaacaccagttccctggaaaatacaaaaaagaaaccgtgctgccttgaaatacacggagttcactttcagaaacataaaattaatacagacacagtaacataatttggaacacaaataatggctacaagaaacttgaaaaccaggactgctccttaactctgagcaagcgtattagcagtctatgggtgtgctggctggtagtcagaagagggcaagcaaaatgggtttcagaacagggaagctgatttgagaaaggactgactaaacacatagtaatagggcaggaaaataactctaaacacacatttggtactgtgggtatatatttaatgctgtcacattgaggctgcttttcaagtgtagcacccagatgctgtactcccaatgaagaaagatagggacctgtacagttctttggcattttgtcattaagacacaggacaaatctgaaggccatcctctttgtataattttaattattttacaggatttagactttaatcactaagttttagtctcacacttagcatataaaataattctcctaaaacaccaagaggaaacaattatacaatctacgttgccaaaacaactgacataccaaagagaataaatgaaatccgaaagaagagaaacataccgtgtgcatgctgagtgcaccagggcaatggcccttattatgaatgtgggaaataaattggctaaatctttaaatatcataaattgttcgaagctggtgatatgtgagtagatgtacacttgaggggaggggaactgggtgggcatggcccagatcgctctctgagttagtgacagtttttacagtacataatttggtaaaaaagtattggtttagtaatgaaaggtaggtcccaatggacttctccttgtaaacttaaaaagagcaacagacttatctagatagagctacaaagcaacatgaaaactctcattacctgagtgatctagaagaaaatctaacttgataaatatcctggaagcattgttttcatctcaactagatttactgtatagcaattagcatctctatagatagatatggggaagcccaggagagctgggggtaagcagtatgggccaaaaggaggaaatacagccaatttcctacttagcaccacggacagagctgtcagcagaaagaaacatccttggagttatccttggtgttaaagaaacacaaagaaatcagtgttgcattttaaagatgcttcttatccccattgcgactggcagtctgggttggaattatgttccagtgcttccctgtagggcacccattggagctgaacgaataaaaaggtgtcttgcccgcctgtgcacatacaggaaggaaaggttgatacaggagaatgatgtctccttgacttttgtctgactcttctctggtttttgaaaaatcatagcactctgaagaatactatccagtctttcccatgtcaagacaagtccctgtgcatttcagccttagggtctctagggcacagggattgctctggggcacaactagggaaagggaataagtaaagacaactctaaaaggaagtaaaatgccttctattccatctcatgttatagaagattacaaataagaccctcttcttcctctcagttctggcctttatgaggtggaagtcactattagactctataactgaataacagattctggaaaattagaactatctctcttgcacttgagaagtcagtgggtctccttttctgtcctgctgaagccagatacagacaaatctagagaaccagttttatgaaagaaagtagcctagcacaaattatttggcattaaaccataccatcatttgctaaagacttggagtcaaagcttttctcatttgattgttaataagaagcttatatttctaaaatatcttgattaccagggaacttgtgggttttggctttaatcaattcttagggcttttcctatcttttgtttcttagacctttatgtccacaggatagtctagagagttgaaatttactttttgccagctcactatgcatgttcaccaaatggtaaagttctcactttaaagcccagcaagacaagatgagctctgtctgcccagcagcctttcagaggcattaagggtaagagagaaggtaagtaattcactatgcgtccccatttctataatggggaaggacgtcttgatacatttacaatactcctctggggatatttcatcagttatacctaaactctaatggacaataattgatttgaactttccacttagcacagagctgtaaacagcttcactgcagacggcagcaatgagccgacgttttgtaaagtggagagagattcagaaaacttttgtactgggtcatgccgtagcctaacagcttttgaatccagggaagaaacagtttgtcctcctggttttaatagctgggctaatcgagtttcaagcctgcagtaggtataggttatcttttgaaggcattccattttaacccctcactattatgatgggtttataacctagccataaaaatgtactcctgatttagacatacatcaggacacattcaaaaacataactttctgaatgttaatttcctggtgaaggaaaaaataagacattaaagtcattttaagactacagattttttttttttttaactctgcgtgggtggtgagcctttcagggaaaatattccctctcctccagtgtccctcatctggttgacaccaccctgtctctccctctcactcaacatcactttgtttcgggctgtatcttagtgcaatctcccatggaatggccccaaagactaatctgctacaaggcatgaaacaagcacaagtatagctctgttccatgactttcttttatagcctccctccagccccgttgaacacacaagtagatgaagtttagaagaattctttcactatttaaatcagctcttctgtctcactacggcatgatagagggtaaaatgaagagaaatgaaagactaactacattttacttagaccactacatcgtctgctcagtctatagctttcctattttgttccacactcctggaattctcacaatgggattcaaagctcacctagaagccactcttagacaacaaaggacacagtcccctttggagttgttgctgccacttctcttgtgtcaaagatctacaaaccttgtggctgtgaagtaggactttatgaacacacagcaagaaagtatattttgtgaatatactgcaaccggacgttacccgccttacatgaatttgacatggaatatgaattttccctcaattcagctgataagattgtaagagcaaaggcataccactgtcagaaaatagatttaccctgcacccccaattgtaattccctttctagaaatctacagaaaaaataggatataatcagacattttgtaagatgttgtccagattctgaaatgcattaaaatcaaactgaacataacttgttccacttggtcctgaaaattacattctgtagcttctagacatcaaacttagttctggttttgatgtaaccgctgattatttaggtaacactaagcaaggtactgaaccttacagagcctcaatttttccatttctcatttggggagaatgacacctgtgtgttcttatttattgatggatgagatgaaattatatcataagctactgaaaaaaatggtgttatatatattttgggtcagtcacctttacctttacagcagcatgaccaatgattggcaaagtagtcaaagtctacttcacccctcctgggtagaaggcaacatggaaagggtattttccatcatttggcagtaagggcctagctctacccatgttcttccccaggcaagcccttttctcccataatcaaagggcaacattttaatatttaatctttaaatcaaatatggcattctcaaatttgatttaaccaatgtctaaacttcactgagctttcagttgagccactaactccctctttcactgtcaagcttccatggaacactctttaaccacaaaattttgtacaatggtacctagtgagctcaaatgactttctcactgatcaacaattattagtctgtaaggagtttatactacagaacatcactctggtgtgtcaggctcagctctcatagacttaactaagcataaaatgtgctttacaaataaaatgcttataaaagttaacaaagaagttaacaaaagttaacaaagaagtggatgacttacattcaccctgtgttttataccttggaattcaaagttccatacttaatggaaatggggaaagcttagcaagggttcagagcaaaggccaaagaaccttccttccttgtttgcccaaaatattaaagagataatttgataatggtcattagtaagatgatgtgttaatagatgttccttacctataactcagattaaacatttaaaaagggggtttatgaagtatgagggattgagttgagttataaaattattacatacttcaggagatgttaaatcctcatatgaaatactctgatgttccagtgtaagttttatgaaatacatttgatccctatttatctgtgacaatttagttaacatgctactagagggcaggacaggtgaaccagaagagttctaggctttggcatctcataaaagttaaaaatgatctgtagagcttatcttgaaatactctttcataaaatgtatgtgtatgattcaatgactgagccatcccacatgctaagttgactacggtcatagggaaccaacctcatgtgaactgtttgatcccattattgaccagtctttatcaatgcttggcagaggtcaaggaagtaaatctaacacctataaaacaaataagcgatttccttgtttgcttttgaaaatgccacttactgattttatttttctttacagttgttagcagctgtacacggtcatattataattgtcacataacaaccttaattcagggacacatcttttgaaacaatgtattattcagcaactttgggtaaacatgcaatttaggagtggaaaagatgcacacagacacaagtaatcatagatacaaagcatggtgaatttctgtgccatgcacttcacaccccaactcatctcgcagggaaactagagaaggggcagaaccatttctattatgataattcacaaagggaggccatatagatatgcatgcaaagtctctccccacctctccatttacatgccaggatttcaactctgcgacactgagtcccttcatttagccaattagtccttccagcttcatgtaatgcacgccaaaaagaaggagaaatagaagtgctgacgttcactgctttgaaagttgctattctaatgccaaagctgcctcttgagcaatttccagaatgtattaacatgggagcaaagcgctattcctaaagacagggatcacattatgcaggggagccccgtttaacgtgtcacaattgcacagaacctccatcccctgcacgatcttacagttgtagtttgcatgggctcaagtttacggtctttacttaggtgaaacttaggaggtcttcctaaagaaaagaagcaatttaaaaatatctagtaagcaaggcatggcacatcttttgtaccatggcattgaccaagtccttttactgtcattctgaagaaagctggtcaaggtgtaaagcaaaccggcctctcagtttaggacagagtgaaggattcttcagtttctttctttctttctttttttaaatcaattaagtctaggttcaattttaattattttaatttggcagacatccctagaattttccctccatattaaggaccaagttgaaaaccattacataattgtgtagctgtgtatctgaatgccctcttatgcacgtgattctgatacttagtaggcaacaaggtgtcgctctgaaatttgaaaaaccattaattcttcagctgaccaccctgtttacagctgaagcagtgatagagattttaatatcgccttctcccttactcttggcaatggatttacaaaagccagtttgtgtcagcctggccctctacaaatttagctgttctttgcttaaatcatgacatttgcaagagatgactggacaagtcccccactgaggcagcatagcagaggtgaaggggcacttgaagtcctatttcttctacacgttgtctctgcttacttcgaccacatctgtcttctaggtctccttttcccaatacacaaaatttgaatactgactgagacgatcctgcagggttccttctagcccttttttgcttttttaccctaaaacgctcaaaatgatttctttctatgtctttggcttctataatttataatcttggctcaatcttctcccttcatttatttcctcaatattaccttttgtaactcttaaatatgctgtccctcaaagaactatcttaaggccatagttttttcttcttatactcatgcatctgaagggctgatgcactcatccatcttttctcataatctacctcttttagttagggttaactaagttagttaacttagataacactttctcttcagaatatctctacttagatggctgctagcccctcaaaacccaaataataaaaagcattctctctttccttttaaatcattctgctatacaaattctgtgtaaccacagtctaatatatccaatgcctcaatcttctgctaaacgttcacattttaatatattgcttctcatatagagccacttatcaaatttagaaattttcttatgatgatgttaactcaaatatacctttttaaactaatattcttggccagctcctaatcacattgtacctaggatatgaaaattgcctcctcagccgggtgcggtggctcacgcctgtaatcccagcactttgggaggccgaggtgggcggatcatgaggtcaggagattgagaccatcctggctaacacggtgaaaccccatctctattaaaaatacaaaaacaaaattagctgggcgtggtggcgggcgcctgtagtcccagctacttgggaggctgaggcaggagaatggcgtgaacctggaggcggagcttgtagtgagccgagatcgcgccactgcactcctgcctgggtgacagagcaagactccatctcaaaaaaaaaaaaaaaaaaaaaaaaaaaaaaaaaattgcctcctcactccaaacatattctcaatggtttgactgtcacagttccctctttagtcctccagtggctttctaccctacttcagatcaattgtgaattatagactcccagcactgaaagccccctccctgtaggtctgcttgtctaacctgtcagcatccggtgccactaaggcccaccttaatccacacagcaagtcgcttttgtcttctggcttccttccgctgagaatacaccctctccatctctgaactttttccacataagcctgcatctacggaataatccctcatgcactgaagaacatctttccttcattcagatgataacttaaacctcacttatgccagagagatttccaagatgattaccagccaactgttaaccctctaaaacaaggtaagaaccactccacccacctttccacacatttcagaaaaaaattatatttttaattgtgtattgtagttgtttataaattattttgatggcagcaaaatatggtatttaatacagtttatttattgccttgcaacttttaagtcttgatttcaaattggtataaaaaacaaaaatgaaaaaagtcccattttgttactttaatatatataaagccatttaagtctcatgctttttgagatctgtcaaccgctatgcacatgataggtatcactaaacacacacttgttgaattgaattgaggaggaaccatcttaaacagtttactcacagaggaggaaggaatcagaagactatgaacataaatattccatagcagcatctgagtgtaacaagaaataataccaaaatgagagtttcccaaatttctctcaccctcttgattgtttaatattatattcataaaactatatttttaaaaacagctttgattttaaaacgttaaatttacacaccaagaagtagacactagcaaagtctcatagtctgatttatttctctgtaatatatctgtcttgagaacatcagcaggaatacaccaaagaaatatgtccctcacgggatcaactatataaaaagacagaacacatcatcagcacaaaaatcattatccatctaatttctcccattctagatggctccagtgagcccctcgatcattactgactagggttaagatagagcttaatggattaattaagccaaagcaggactgcaatgcagaccgaagaggagaaggtcctgacacagatgagacaacaactctgttcctcttttattcaaatgtgcaagacttgcccacccccaagtactacacatttatactgtaaatagtctccaaaaataagatttggtgtctgctgtctgggtcttcccctcagcactcaccaacatctaatacttgggtgttaatcaaaatgtatcgtgtaataagaaattaaatgttaagactttctttttcttcagaaacgtggagaatgattgttaacagaggtaaagcagtagaggcagagcactcgttttggcaatcaaggagcaccaactaagggagaggttattgtttgaatgtcaatgtgactctgagagagggccagggacacagaatattcacaaagagctgaaaggaagaagtgcccacagccataaagtcacggggactggggggcatgcccaaaggcatctgtcgtaatagaaaccttgagatttgttcatttaaaggggattttgaaattcaaatgtaaaaagagaacaagataatccaaagggcacaatttggggcctttttcttcttgtaaaaagaagagaaaatagagagaatcccccataccccccaacaaagtactgtaccatagtggcagtttactctcacttttacgaaccaaatcaacatattaatgacttaaaaaccacgttcacaatggggacaatcagactctatcagacacaacattaaatacgcaggtattaaaagaaaaaaatgcaaactaccaagaaatacctcactccggaaatggtaaggctgacgaaagcagactatgtcattaataccaagcacaccagaaaggcatctatggagctagactgggagggacaggcctcatttgcaccaaagaggaagtgccctgaaggggcccagaagtggggaactgggtagattttagtctttttctttttttggtaggtggggggaatgacagaaacctggcaggctcctgtggaggtctggctgcccccaccatgttgagtcccagtgtctaagtaagtaaagaaatgaaaagacacctatctcaatggttgtcctgaaacagttttaaaagcaagtacaagtccccagcccctagtagaatacaaataatttcatttgtgattcttgcatcaaggaaaaaacttgtgctaagttcaaacaataggatacctctcaaaaagatatgacttctcactagagagaaagaatcaaattctggagtgggaagtgttttttaccttagtgatcttttagtcattttgtaaatgaggaaactgaggacttgccaatggtcacagaagttaattctgtagttggcaattctagcagtaatgaatttacagatagatttggggctatgaggaatccagtggaattgggtccttcaaggccttttatttaaacaattatacatatatatacaaaaaaagatacagggggagagatctatagatatagataagtctgtataaaatatattgctgggtagtaaaaagaggaccggtgttgtagcattttcactaccatggtcaagaagccacggactagattcatttgttcagtgaacaaacagttactgaactctgtgtgcaagtattataaaagtaaaaaagtacgattagacatagtttgtgctgtttcaaaaagagttaacagtatagttgttttatatctacaatacaacctcttaaataatcaagtagtcaaactaattcctattggattaatacaaatcataatcattaattttgaatcttgagagaaggcataaactctgcattatattttagttagacactggaaataatctggaatgtttctggtaccccacatctaaagattggatttcagctattcggtgcatttggatgtttttttccctttagaatccatcctaaattcaatgccctaactcggtagctcagaaacagagctctctaggcattgctgctctccttctgcccagtctctgagagggtattgaggttgaggatggggatgaaactaagaataaggcagagaacgttgctaagtcatgcttctttcagatctaacacatttgtagtcagacctctggccctccgtatccatgggttctatatccgcaaatggaaaatatttggaaaaaaaaaacctccaataaaaaataatgataccacaatgaaaaataacacaaacaaagaaacagtgcagtataacagctatttacatagaccttacattgcattaggtattataagtaatttagagatgatttaaagtacacggaaggatgtgcatgggttatatgcaaatactatcccattttatattagggacttgagcatttgttgatttcggtatctgtgtggtgggctggggtgggatggggtgtcctggaaccagtgccctgctgattggatatcaagggatgactgtacttaatctccaagtcatttcccttacagttatattttagtatatggcaaagcacaatgatttcctttgagatgaacaaaaattgagtagctaaaacctaatgaatacaattagtttaagtaatctggttatggagaaaaatcactagtagtaaagaagtgatcatattacccaagcatttctcttaaaaagaagaaaggagaaagataacatgtgagtgcctactacatttcagtactatgctaggttctttacacaaattagctcatttaattctcataaacatctcccagagcagagattgtttccatttcttctggtaaagaaactgaggcacagcaagattgtgttttgagcagacatacaaagctagaaagtaatttatggcactcatatttggatccaagtttgtccatctacaaagcctataagcctgctaagggagaaacccaaaaatgaaacaacaatgaatgccactggcagtctttttattggatatctactatatgatgctaagttatgtgcccaattaattcgaatataaacacacattttctgccaccttgatgtttaaatatatgagcatgagcaaactaacatttggatccaccatagaatattgatgtagaaaattcaaatcactcatgtatttttttaattttagaagacaatttacctgatgttgcaaagttatcatgcaaaaattaatgctaaaaacataaaaaataccctataaactctttcagtgccagggaacatcatgcactgctcctacaaaaacctggcacagtgaattccctgttaactgccagtagatagggttttatccttaaaaatatttaaaggtgagcacatagtctgcttcatttttactccagggttggcattctcactgcctctacttaccttgttttctgtaaagtgtggaaaggaaaacaagtgaatttttctctcatatatgaaggcctagatgtggggaaaggttgtttaaatgaaaacatggagtttctcctcgtgctaagctggggcatttggagagtcccctcctccctgtgcccctccatccacacaaacatacaccccagttcacgttctagtttcacgcgggataggaaaagaaaacgaaaaacagaaaaagcaggaaaaagtacagaagaagaaggaggaaggataggaagagggtctaaggaagtagtgtagtcttccagagtgctccagaaagtgaaacgatgaaaagggtgagcctcaagagcaaggcacctcccagctctccatggatgaagagtctctatcagctccagaactaaaaccctcagtaggcaggatggtgctaaaagaagaaaaactctggaagggggtcagagacggatattgcagagctttctagccccttctacattacgtataaaaacgattattcaagaaataatgtaattttccagagcatgttcaaatgcaagaaaaaggtgcattctaagattaaatgtactacgacagctaatgattcattatgttaaagttatttattatttacaattattttctatttatgacattgtagtctttcattgacacttgataatcaagagttgacaaaataccatttgaactgctttgctaaagaacaaaaaaagagggattaaggtagacaggaagtgcgtccaccaacaataaaaaggacacatgactcataccccaatattaatgacaaaaatatctacagtgagatcctaaagttctgggtatttgtctaatttttccacaatcagaaccaaaggtaaaaacagcattgacagctactgcagtttggtctgtttaacagaccaaatgctgggatttcaaagattcatggctgggattccaaagatttgtccatgttggaaacagcattcacagtagcttttcggtcaagtggcacaaaggagtgaaaaggtagaaaaggaaacattagcaccaaaaatctctagtcatcttttaccaccttaacatgggttagctgaaggccatggagaataacggatgtgcagttgtctctttcttatacagacagcagagagaggggggaaaaccacacacttatattttgctaatgtaaaagtcccagtggaaacattagcactcaaagacattaatgtggatttgggacactccctgaaggattttgattccattagaaaaaaaaaaaaagacagtgacagatataatcctgctttgatatgtttaatgccatttaaagagaaactgtacccatttacctcaggccaggacaccaagagttcaaaaagtgaaataccatttctcagtgcaaagaaaaagcttggaaaatattatgtgaaaattaatttggcatgcttctttgaaattttagatttctgggatgagcaaatgggtacagttttcttttaactgtttttgaacaccatgtgttgagaagaaaacaacagaatggcaattgctcatccaaaatgctaacttgtggcatggcacagtcaagatggcctgccacagccaaaaagcaggtgtgtgctatgcctctcacttcagtagcatgcacgccacatgtccctgcattcggcaacctcttgcatttgcttttggaacctttctgagggggacagtaaacatgactcaacagaatgtctagctgaggagggactggctctctgagcctgctgtgagacagactttttgaggaagaaccaaaggaaaactggaataatgtatttattttggaattctttggtatcacttcctgtgacctaacaccaagacgactggttccagatcattttgtgtggatgaaatttagcatctaatcaggtcggagagtaatggtgaagcttttgtgtgactggagaggacacattaaatcagctacctcatttggactgaggtcaaggttaatgtagctggtacagatcatacgaacctaacctaaaagcttagagtaataaactcctcacccctcaggtccatggataagcttgaaacagggtgtacaaaaccatttggtgtgctgggatgccaaagcttcttcaatctgacattatgaatctgttattatgttactctaggaattaaaatagttttacgtagatataggtccttttcaactatacaacagtcctatgagggagacgaggaaacagaaaaaaaagattttccttctgccctgtaagaagcctgataaagaggccaagttaaaagtcatgaccacgtctaagctcaagtcaggaaccacttggaatgaaatcccaggatatctgtgctgtaggaatagacaaggtctgaagataaagaagtagatgaaaatcaaaattactattttagaagacaggagtgggacacctctactttattctatacttttaataaatacatcaataataatttattaaaaacctactatgtgcaaatgtcaagagtggggaagaatgaaacctataagtaataaactggaaagaaaaaacatccttaagcttttctgatgtaactgagtgatgttctctgcttctgagtagaaatttatggattcagaaaaggtaatttctttccaaacactcacatgccattgttaatttcactcattcaaatcacaacatttactactataccttttatttctgatggcacattctaggtgttgagggggatacaactgtgtgtaagtacagtctctgtatttattaagcttactgtgcagtggcaggaggaatgagacatataaacatgctctagtataagacagtatgtaatcagtgccacaggagacatacaaataagtgctttagcagttcggaagaagcaagtcctcctggctatagaaccacccctccatagacatactgaaatgactcaatgcacagaaaggaaggatctgtacaactttaagtcaacttacaattgatgtgcattaggggattggagggttagctaggctgtgaggggagggatgtgctcactgtgtccacagctcctctcacactgggtcaccccataattaatgtttatcaaaaacatgcatggataaaagtggaagtcaattgaatgatagaccaggtcaatgggtctgtgttagttctagatattttagatgattattaacaccctgctagaagttggcattataagaacatcattttcttcccacactagtgtaaaaagttcagttttttacccattccagagtgatgggaagtaaaattcagggcttcagtcttccaaatgagggaaatacttggcctgtgcaaaatgctctcggtaggggtatcaaaatgtctttcaaaacagcaaaaaatacatttcctgatagcccctaaggagtatgagttggaatccatgttctctagatgtgacgatggagttcgggagaggcaggtatgctaggatccatataagatcgtatttcccatggtagtgggaaatagaatttgaatgtcctggcttctaggtctgggttcttcctacagaaacatctttttcattttgtattcctcttggacactctagtcctttacctcatgaagagtagccttctgcaattggggtgtgtgtgtgtgtgtttgtgtgtgtgtgtgtgtgtatctttctaagagagaggatagccttactgatgtgcttttgtaaaggattcaaggttgtctggatcctcaaataatgcaattgaaaaaatacggtttctttgattcaatggtgcttacatttgagcagcgttttctttttccattctcaaacacagtatttgagactatctgccaacaataaaaaggtttagagcatcaaaagtgtaggcgaaccaaatcagaattaatctctgtgaaaaccgagattcaggcgcatggaaaaagtttaggaaaaaatccaggtgggaggcaatcccatagaaaggtgtctggcatctttcctgattcaaagtgaggtgtagtaggacacatgtggaagagagatgagcggttctagctattcatatgatccattgtctcaccaatgctcacacaacttgggactgtgttatcagggggccatttgatttatcatgtagtccatgtatcctattgtatgtatgatccggagagaggttaataaagggaagtctaagcttaactgggactaaaatgaggtggcaaacagccattcactcaaacaagactcaccagattaatctgtggagtatccagcagcatttccttttattatcatatgaaaagctgtgcattttattggaaaataattaactctttaaaaaaaaaaacttgcacaccatagcagcaaaagggaggaagataacagtgatcacttctgaacacctggtacacgtttggcactgtttttctttatgcatggatttctttacatatgttatctcatttgatcttcataccaactacgaatgattgatattttgcccattttttttgtataagaatcctaaggttcagagaagttacgtaaatatcctttggtcacacagctagtagggactaagctggaattcaaattggagcagtaggacacaaagcctgtgctcctcaccatgccttgccaggccagacttcatgtgcttttcatggcatgaaatcagtgttgggggaattctgcccagcatctctggttagcagagtgaattgcttttatcatttgccaacatgtcacagaaaaaaacaaaacaacaaaaaaattaaaactcctggctctagatttcctatcaacctgaagtttggcttggttacatattatttgaatatctgacaatcttataaaaagtctaacgagaataaaaaaattcttcatttatgctagctcctatgttagctaaaaatctcctattcctacataacaatgtgcctggggaactctctcactgccagaaactcatctgaaaatgctgaaaagtcagaatttggggcctatatactgactaatgttaccagctgtgagtcagcttgaacatcagtaatatgatatttcccgctacaatttgatttggttaaaatgtgtttgaagttcacccttttattaactggaattaccacctcctgtaactggagggcctctgagaacaggctgctggtgcaatccaccttcccacccgccaacggtgcatttcctggcaacaaatactattaaattgataactacagaaataggtcaaaatgtcttttcaatagttgctaatatttctctaatgctccatagcctccctttgattcttgtgctgacatttttttttgatgagtgcaggagcaacaactgttaaagagaaatgaccagaagaaaggaaagctggctggggtggatggaggtgctcttaggagttcccgtatcagacagaaaagctagatctccctagaggcccaagggccccaaactcagctctgctgttgagtttggtgacccagaagaaaacctgtgtcccatctgagcctcaatactctcatctgtaaaaagaggagactcgagatgactgattattcaaatttgcaaaatgcccagagttcacaggaggtagaagccctgacttatcacaaaacatttgggttttaaatttgtttatagtactcttataatgttacctgttaaggccttggctatccaagatagaaacttattttcatacaaaaaaagtaatattgtgttatattttcgtaagagagaccctttgctatcatactgggttttattcactatgtaaacctatattccctccctctctttcctccaggaacaaagtttgcttttctgagttcacatcacatgtgtgattacagcaaagacagaagtttgaggctgcagtgagccatgattgtggcactatactccagcctgggtgattgagccagacttcaacccttaaaaaacaaaaaagaaaggggtggggtgggtatagtcacattgggaacatagctgattgtgagcctgcaagaagaaaagtccccttgctaaaaaaggttttccagcacttcttctgagatgcaaacataccacggaggggtcaagccattcatgccttcatgctataaccacttcaactccaagagagttatctcagtgtaaagcagttttgaactggagctggagggagggatagggataattctggaacaggggaaggtgaaggaagcaatcagattaactaacacaaggaccctaggctctgctggcagaggagaagatgaagtgggtgacaaggactgaaaagaacccagtctctattgcagtttttgcccagggccttgtctggagctggtgaaccactaaaaaaatcccttgagagatgtcatggtttatcaaaaatgcctttggctcttctgttgctccatggttgtgctgttgctcaacaggcggtcagcaaactacagcctacttggttgaggtgagagtagcttaatctcatataatttaaactcacaaagactatctctccatcagatcccttctgttttccttcctttcctagagcagggaggaaaaaatgtgtgaaagtaagggcaaagaaggaggaggaagaggtagaagaaattaacctttcctcagcttccaagtgagttaggctttgtgttaggtaagcatctctctagatccttccaacagccctgaagatattattagtaataggaagtattttatagggttgaagcagctaactagagctcaaggtggccagtcaggctccttgttacacagcactcttttctcagctcctacaaaatatttatttatatgtatatatttctttttcttctcctcctcctttcactcatgggtgcttgaaaacaggtttaggagccagtcatgtggaatttatctttcaggaatgtcgaacaccccttgagttatccaaagcatacctgactaggagtcaggaggcctacattttctggattaaggcttggtcctaacaaactgtcagtgtggacaggcccatccatctctggggtctgctccaggccttacaattctgtaattcacactcatcaatgtggtggcaggcattagtgtgtttgtacaaaactcagcaagaagtagtctccttagatgctacatgtagactgaagcgaggaactgcctcctgctaatgccagttgtgttttgagtaagaagaataaaaggattgatctgagctgaaagcagaagggaagatgaggggaaggccacagaacacatagctagcagtggcattggtgggggtctgagagaggcagaagcccagggccagagctgagagatcagcttgtttttagcatacacggatgtgtttgatcacatgatggttgggaggtacctaggctaagataatcttaatgttaggtgctcattttaaaacatcaatttaatgactgaagcctattttaatgatccaataaaggccaaagccctcactactatgatacaactatttctccctagtattcactccttgccaaaaaaaaacaaaaaaaaccaaaaaaaaacaaaacaaaacttggctgagacagctatagagtttctgattacaaaacaagatcaccttgatcataatcatctcaaggtgcttggaggaaagaaggagagatgagttcttctgaaccacattatgtggacagaaatcttcaaagagtttaatggaggaattaacttttgaggaattgaaaaaggtatcattttcagtaagagaaaaaatgactgatactttcaattggtatgctagggaaagataaattctaggcaagaccagctctataatttgtggggctcaaggaaaaataaaaaaagtagggctccttattaaaaaattattaagaatttcaggacagcaacagaagcacatcaagccaggcatagggcccgtccaaacatgggaccttgtgcaactgcacaggttgtatacccatgaagctggccctagttttagttattgtttttaccaaggtattccagtcccagagctacccagacccaaatggaaaagcacataccacaactctcaaaactctcagttaaccctgtcttcctacggtaaggacacaactgaattctgcaacaaggatcagaaaatcctggggtctgccaacatatttgatagattgcaactgcactggcttctgcgacatttgtcacagtcactaatccgtgtttctgtcacaacctaaggatgcccaggatatcaatgtctgggaattcaaacatattttctaaaaacacaaatttatttaaaaacaacaacaaaacaagcagaagtcactaaaaagaagctgagtcccctggatgaaagtctgctcttaatctctttctggctttaccttgagtaggtcttgggtgtatgcacacaggttcagaagtgcaggtgaattaccacaataactcttttcagttagagaaaaaatagcagaaacagaagaatctggtcatagcctagcagaaactccctcatttcaccaacagtatgctttctccctttcttattatgctaagttgaagcgatgacttcactctccatggaagctaagtttctctttcctggatgcttggaatgggcctggtgaaaagctattggagggtaacatcatgtctaaaaaatgtatgtatgtatgaagaaagtagagatttaaagagctcagaccaacatcaaaagaataacagcagtccaaagtgaaatgaatgtggcctcttttccaatgaccttagggactttatatatacttagcctacttcttgagtggatagaccagtagcttggcagatgcctaggatgtctgtacaggttgaaacttaattccgtcctttctatacatctttgtcccattaaagaaaaatatctaatatagagaaccagttcactcctacagccagaattatactttgacactagaccaattgctacatccttgatttaggattttttaaaagatatctattggcaaagctaatcttttatttggcttaataggtttgtactgctgctctgcataaggccattagggtccataagtagatggaaatgtgtttgaatctctataatcatgcttagatttcaaaagtcttccatttcacagaggtgatgtaggctcagccatcattttcaagtgttttaacaaatggtaatcagcagagaaggtcttacttttttttttttaaaaagtgactgaccttcacaatggatgcacacataaaactctgattcatttattttaaaaccattctcccctgctgtaaatagatagctacgatatatacattaatatatgtgtgcacaatcagccttagcaatactgctgtgaagtagatgaggatagatggttttctatttatttgacaaatacactattacacagataggttaagcgatttgtcctgtaaggaagggtggagctgggggaaaaaaaaatcctcccacatctgctcttacatgataccactatggaattgggtatcctttattgtttttgagtgacttgatctaaataatgggtaatgtaattttcctgaaaaaaatttcactatttctctcattccctcttactttcttcttctctctgcttctcctctgagattattataaactattgataaatgtggttgctctaaatttacacttgctcttcatgggctttgatgggtttcagcttctaaagagagcataggggagaaaaaagcttatttctaaaaggttttaaaaggatagataacgctgggacagtttatttgaattaatgtcactataaagtggatactggtacgagtactgtcttggacccttctctcgcaagagctagtccaaaggctctgaagtgataccatgggaaggaagagctttttggaggcagaacctgctcatcaacactctgctattctcctgggatatcagacaaaagccagagctttctgtgcaccttcctgttgaactgctttaacttggaactattctctacattagggctgtcctctctgagtccctgaccttagatggtctttctctattttggcacatatttgcatatcagttacggtgacatatttgataaataatgggcctcactgttttttggccagtgaaaaactattttgctattattttaactctttattatctcttttgtcgattatttgtgtgactaaaaagatttcttgtctcttatcatgcttctggttactgtttctcaatgtcatctggtaaatgcttagaaaatacaattttattttgataaattctaaacaaaacataattatgaagaaaaaccaacagagacaagtatataatgaattttgaagctaaatataataaatagttctgaattttctgccactccggctcatttagaatgtaacattgctgacaaattagttattcatgctgttttttaaaaatcaggggcaaaattataagtttcaattctcctaataggagttataacccctgcagcatgaaagcacttgagtaatgtttgctatgtgaaactggcttcggtgatttctcctgaaggaaactgcactatcaaaaccttcatcaaggctgcttctgtttaagacccactgcactacgaatgtccctgtacccgtcagaaccttggctggctgtcatcccatcaagcacctcatctgcagttgccactcagacatgtaaagcgtgtgtttggggacgacgcgcggtggaatgagaagggatacagagctctgttgtaccactacatttattgtaagcaaccacttacacggcaactgctttgctcttttatattctaggcaacacaccggtgaatataattcataatgaacatattcaacattttttccatcagttcaatacattattcataaatattagagatggaaagacctggaagattacagagtccaaacctcctttttgtaactccctttcccctaactgttgatggtagctcaaaaaatccaaaccaaaaccaaaacaaaaaaaaccaccaacaaaacaaaataaaccaaacaaacaaataaaatacaaacacacaaggaaagcaacaaatttacaaattttataagtaaagtgaaaagctccaaagctcgtgtttggtgggggttgttgggggcaggatttacactgatggagctcgctgaagactaggagtatggatgactctttgctttgaagacaggccaagggagggaaatgtcagtttcccccttttagataacaattcaaggtaaagcccaagaggcaataccaagttcttggccaagtgttaactatccatctctacagcctgttgtggactcaggactcaggcactcttctcttcatttagaacttgagatattaatgctaatgataaaaagaaaatgtataaatgaatagagagtgaaaactactagagaatgctccctgggattatctgtactatcaagataggaaaactttgcagatgctactgtctctctagaggaataaatgcttgcattttaatattctcagcagctggttcctgttgaatgccatcaggatgattcagccacccaccaggaacaccagtaacagcaagtgcacacacagaaatctgcaaaactttcttctcttgatgccaacaccattactctggcaaagtcaaaatcctttattgaattatcagttctactaaatgtgaccttgttcccctcacaaataccagcttattctcaaataaatggaacttctggctgattaaaatgtaacattccttctgacttgagcacaccctgctgtcagtctctcttctgccatgttcatgtgatctacctctttttcgttttcttgctatccactgaaaccttgaaggactggcaagatccatacatactcagagtccactttgtatgttgctctgcttgctaaacccatacatttaatgttatatctctacccttacatgtctcaagttatttcatcatttccattttttagacattttctatttccacagaatgtgtttgtatgtctggaaaaacagaaatgtgtagctgaactgcatttaccattgacctcattaatacagaattaccatgccatattcaagctagataaaaatgctatacttgccctcttcttcaaatttagaccagattacacactaaagggaagaaaatgccaaagatgacagctagctatcaaaaagatctcactgtctcattttcaggtctccaaagtaaaatctaaggacattcaacacagattcaggtgctctcaacagccatgaaaatatatggctgaagagggaatctataaatgtaatgaatacacaattggcttataacagatgcaaccaaaattaaattcgatatcttgacctgctctccaaagtgaaagtttctagtttaggctacagacagaggtgtaacaagctcattaatcacatgaaccagaaatataagctgacacttctggggatgctgcaaagagcagtcttaagctgttgggggtctgtggggaacctgaaaaatcatgtggctctgacagtccacagcaagcaacaccactgcattttacaatgtatgtgggtcaggcactggccataaccaccactattttaaacttccaggacaggatttaaggatctttgtagggaaataataggtccaatatggacttttataaaaagattcaatatatttttattaggttcctgttacacaaaaatcattgtgttcattgcatgagaagacaatgaattaggtcaatctatgacctcgagaagtatataaatgggaaagaatcagaggcaggggaatattaataagtaatagtagcaataacaataacaacaatgatgagtgataaccttgagctagtcattctgctaagcactttatatactacatttcatggaattcttatagtatcctaggaaggcagatatcgtttttctctttacagacgtggaacgtgaggcccagtaaaattaagtacattgcctaaaattatgtagacctgttctttacattacaaataaatacataaatagcttgcatataaaatgaaatatggcaaggctcattaaaagatacaaagtgttgtagaaataaaggaggcagaatgtgtttctatttgggaatactaggagaaaaggaacatggatgggaaaatgtggtgtgtgcttaggaaacaaggattgttccagtttgtaatgttataaacctgttgaatcatcaatgtctcattagaactcatactttgataagatagtaaaatataccaatctgtacaggaatatttctacaaagaaatacttctttccaaaagatcttctgactacaatttctcaaaacttttcttgttatttattttttggtggcgatagagggagaaaaaatgtgagatacaaggctatggaggtctgggcagcagtgttaactccagagtctctagggagtacaatgcatttgggtgcattttccttcattcctcagaatgccttatcctcatcacacatatttgtccctgccacatccgaggtgaggttactggcatagaaatagaaaccctgagggtctggtttcttccacttcttcaaagtgggatatcacttactttttatttttataaattagttttagtggtcagccttttggcataggagtacatcaagaaaacgtgagttagaaaacttgagttctggtcccagttttgccttgctcatcttgaaagcattttatctcttctctgtgtttaagttttcttattggcaaaatgagtagtttaagcctgaatatcatttcttaatctgttggacaaccccctcatcaaattttttttgataaaaataaaaccttgttttaatgtagatccttctattcttctctatttaaaattcctggttcacagaatgcaatatatagtaccattagtccagataattttgtagagctttactttctctattttgttaagtttttctcgtaaattttgttttccaaatataaaacattgtaatatatatgtattttcaaattctacatggtcctcgaccagatattccaatattccattctgaagagttggttaacccactcacccatattgagatatctaaagccccttcaagctccaagatacagtgattatgatgctctgatgctgacatttgctttgtcaacgcttaaagcagagcttttaaacttcaaacaatagcataacaagttgctataacaattacacttacataaatctttaagcagatgtgcataacagctctttacatctactatcacactggacaaccaaagcttatgatgttgttataaatccttgcaatagtaaattctacagttaattataacctataggaaaaagtactgtccatatttagaattgattgactcttattttccacatctgttaattttgcacccagctatagggctttaaatagctcccataactttaatcattagcccccactcagtcatgacttctatgtctcacccttctgaccttgcccactgagttcactcttactgatgtaatcaaacatgtttcattgtagttgcattcgtcacagtgctcattagaattatcatcattcctacagcacctcagtgcaatgaaattgtgtgcctatgcaatttgttgttattttaagttcttcagctggaattttaaaaatctagatggacaattttattttatctgatcgataaatatatatccagttaagtgcctctgaaaaattggtaagaaaattatttattagagcaaaatcttaagtctagagagatttttgtaaacttggacagcagcattcactgaccttgaatccacaggttcaaaatttattagtgtcaagttagtcttttaaagcaatccattaaagcaataagtataaaatatatatggtttacatttatgtatgtgttgaatttaataaattagtcaggagtcaaggtatttttaaagaaatattaaatctgttctatattgatcaattaactgactttctaacttaaaatattcttttgctgtagttaaaacctttttttctttttaaaacaaacagagtacataaactgtaaggtggcaatgtagttcactgcgacaatctatatattccttaacgtttgttctttttatggtcatggtatgtagaaacaaataaatgtataatagtttaagtccaggagtttttgcctgactaaattctaaacacatagcttaaataaagggttgaaagcctggcatctcatcattactgtttatatgttataaggtttgcagggccaccttataaaatatatagttgtttattttcatgttcaataaataagtagtgtggggtttcagactgagaatggattacagattgttctctcctggttatttttggctttaagtatattgatcattttatcattttcttgttttaaactactttaaacacagcacaaatgttattctcatcatgccagaaatgggtttggaattgattctgagtttccatcaattttactctttgctctttgtgagaagttttgcactgcttaaattcgaaaggatagttttgtttaaaagatgtcacagtacaacatttagagaaccttagctgcccagaaaaactcagattttctgctttacaaaagaataaaaatcatcgaatttattaccctggactttattgaaatcagtgaagaatattcatacaaatacagtttcacgaacttcctctctctctttcttcatgtaagtgtttgacaaaagcatgtatcttctgagaagccggcctgattggtccaggttggcactgtttcagtgtttggcctacggcggctgcttaggaataatttcatctcatcctctctattttcctggactgtatcaaactcagacacgtggtatgcaaaggaaatccaagtcttttaaaaatgctatttcttttggtactaaagccaagaccagttctactttggccaaatgatcttatcaagatttaacaagagatattcagtaatatctccaatctgtgagaagacattccactaaggaagataatttattacatacagtgtacatatatttctccacttggtaccaggaagagacatgatcaaacttattctattggtactgaaaacaatgtaacactgacaaaaattctgtggcaattattcatttcaattaatttaaaaagaaataaacaagtagctcttcccccattaaaacagatactggaaatctattttcagttattgctgaaaatattttggcttccacaaaggcaccttactaacacactactttgccctccactgtgctgtcacaattcagaacttgtaacattttattcaggtactctagactaattagatgaaacaactgcattacagtattaagatgcttttgtagaattaaatgaaaggagatctgcacagttcagatagcttggaagatttgcaatgaatatcaccaaaatcctgcatgtgcaatatatttttctacatttacaaattagctaatgaataagtgtattccacaataactgctaggatttaatttcacacttaagaatatcaacaaacacagagagaaatttagataggtaaactccatttcccttcccaccccaccctagtgctcccctgcactgtttgcatttcagaacaaatgcttcatgtctcttgaaaagcgccaggaaatctcttctctagctatgcaggcctcaattttatgtgtgtagtatgacacaccttaaaagagagagccccacaaactagagtgggacgttaatttaaatacagacttaaggagaagagctccatctactgaatcagttagatcatagtgtgtaccctatagttatcccattcactactttcaaccacttagaggctctggagggaacaggaaagttatagacctgagcaaccatgaaaaacagctttgagcctaatgccatttgggatatttctcggataccctgagcccctttcctttgcccctccaatttcaaagctttccatgttgcaatataaaataaaaatggatgttttgctatatgaaccatcccttggaagtagaaagtcattggttgttgaaggaaatgtctcagacagttgaagagaaagctacagaaagaaaatctctagctggcaggttgggcagcctaggtaagaagggaaaagaagagtagcctacttactcctcctgccttgcaccattgctggggaagcctgcagccacccaggatcagctcttctggcctctccccggctgcacagtattgttgtggcattgggaatttgctgtggcttcgtaagattatggggatgtgcttcagcaagccaaaaaagtcacaaacaaaattcaagaggaaaaaaaaaaagtataaaaacagctgatcttactggagaagctcttggcattttcctacatatgccacaattttctctggtatttcctggttctgtgatcagaaaaattatcgtatcatatttattactgttgtttttttcagggttgctggtggtgacgggtggtacagtgagggcaaacagatggatcaaggagaagcaaagtaaagattacttctcccacttgtttgaaagctttccaagagattgcaggttaaaaaatctcttcttcagaatactgaagatgtatagatatcacatataggaaaagatggccatactctttctagattgggaaagaaaaaaacttctaacacagtaacagattcggaacaaagcaaattgtatcagaaaaaacttaaacgttcatatagctgcataaaattcagcagcatataagacttataaaaatacttcataaattaagataaaatatttgaatataaatgggtgttaagtatatatataattggatgaaagcaatagttcagtgaattttttattacagaaaaataaaatataatgaattaacaaaagttttacagtaatgctaaccttttctcttgtaggttaaaatagaattaatgtaactgtaaagtggattcatgtttccctgtgggtgtgaatgtatatatatacctgcccaggtattactgactgacactgaaaggtgatatgttgcaaagaaattcaaactttgagcattattttaaattgggtatttaaaatatcagtattaacctggcaggtttctttctttttctttctttctttttaatacatttaattttcagggtctgttttaaagcacgaaaagaaaaacagattagaaaagcattgcacatcaataagtattttgtaaaataatccatttgcatttattagaatattcagttctcaaaaaacggctaattggattttcttcaagccttttcaagacaagttcagttctgtgtcaaggataactatgagaaatttcacctcaaaaggtaatttgtttggttagttataaaagcctgaaaaacaagattatctccaccataactataacaaaacagctaatgagtaagtacattctggtaagaatcgataagaatggcaaagcctgagagggtcatcgcagacttgagaaaggtaaccaagtgaggaaacatcaaacagagttaaagcattctgaaaaacggaaagtgttaataatcactgacaggaaagaatattcttcgatagcgatgacaacaacaaaacaaaacaaaacaaaacaactaaaacaactggaaatacatatctccagaggcaaactatgactacttattaagcaagaggagaacctgcttctttgtcattccctttggaagcctagctttaaaaaaaaaaaaaaaaaaaggttgcacaaaagatacatgtgttccttttctggtattattacaggcccacctagatttagctttcgattccagatgagatcaggcatgttcagactagcacatctttgctctgtaagcacagagctgctatcatttcactggcaaattctcgtatccccaaatttatgcacaatagataccctttaaaatctgcaaattttctatttcagtgaaataactgattgagttaattttttttcttaatttacgctgctcgtattaagctgaaaagttaaggcaggcaactcctataaaaaaggaaagttgaacagtacttaccctaagtgtaatgtgcaagccttaatggggcaatttacttttgctctatgatatttagaaaggtgtccaggtctaaactcagctctcgcctttttcccttctggaaaactgagtagactcacagaaggtgcctctgcgaaagatcatacaaatcaacagccttacctgtggccattcagaagactgcactttggtgtgtgtttaaaactatgaataaagtcagatacagcgcatgctcagcaggcaatttaaaaatatttataacattgttgtttcaaaaacaaatttcctcaaacaaagcaaaactcaaatttttttatccatgccaagtttaacgttctgagacaaagctgttttggagttttccgctgaaggaaaaaaggcttttaaaattttttgttgaacgaaaaatagttctctcttcccttttgggtacgcttaaaggggtggaataaatttttctccaagtttcaacaaaattcacctctggctatgataaggcattacaaatttaaggtctgtaaaaaataattttagagaaactaacaagaaactaaaaactatgggtttaaagaatgtaatggtcatctgaactttcaaggcagtcttgcatgtaactatacaaaaattatatcctgatacaaacaggatatattatatgtagataagaataatgtgtatacaaccatatgcatacctagagaagttttatttttcttttgctaactaaaatcagaactctctaaagccgaaaaagaaatacaacaaaaatttaggagaaacccagtaataacatcggcacaattcatctgtttttcatagcaagcgtggaaaagaaggcaatcataccaattgattaaattttgagatatataaaataaaaatttgataaaagaaggtttttaaagtatgaattgcagtagaaatgcctgtttcgttcctggttgaaaatttctttctcttccttgaatatccctaagcattccattttaccatctatcaccaaaccctgaacagctcacagatctcacagatcttatttaaatctcttacttaattcttaagtctctgaatgaatttcagctcctgctctactttccaagggtgctcagctggcctcacaaaagctccacagacacatcgttcactatctctgatgctttcaagcttaacagaggatgccaaaaaaaaaaaaaaaatcaacgattaaaaaaagtttattaaagtgaaactaggagtgcaaatttgaagaagttgcttctacttttatttctctctcaactcagcacaggtgtttcctaacttatactgctgtgcatgctgatgaaggggagggttaaattaaggtgagggagtgggccaagggcagaccaacaagcatataggatctccagcctcatgtgttaatggatgtgtttaaaaatggaccccccaaaaagcctagaatgaggtttctttttggcaaataattaaaccagtatactgaaataattaaagctttgtctttaaataaagcatcagatcaacagaacaaaaacaaagataaaaattgcacacacatatgcatgtgcgcacacacgctatgacacacacagatacgcaaaactagtgggtgaggggagaaggaaattaaataaaagaaaacaaacagagtcctaacaggccattctccgaaaaggaatctaaataaaaagtcatatgatatctgatagtgcaggacacgtcgccaagaactggagcggattgcctacaggaagaaagggccagtgtattccagctcaaagagcttttctttcctcctcctctattttttttcccttttctcctcgactgtgaatgtgtcactctcaggtcagatccacgaagaatcccagaatgacagctatcacctgtcactgtactcttggcggcacaactagctgataggagctgcctgagttgggatcaagaagagctagtgcagctttcagtaacagcctgttatcccagtccctctgcccctttcaaagatccccttggtcacatcaaaaacagaccaaaaagaaaaagaaaaaagaaaaaaaagggggggtaccaaatgaaaaattaaaaatgcagggacaacagcccacagcaacaaaagaattcagggagaaaaaatagaacacaagcaaaaaggaaaaaagcaaaaccaaaacaactcttgtcttcaatataaaactttttaaagactgagtttctcttatttggatgacattctttttaaaagtatttttctccttaagcactattaaaagcattaaaaaattctacaaaaatacagaaaagtctgaaagcaattcaagaatattcctaaagaaaacatgtaagtgtaagaagtgagttaccctggaaaattctggatttgccaaaagttcccctacttctaatatctttcagtgagttcaagtgctaacactggccacctagtacttgttttttatctgaggatcattactgaggcaacacatacatagtaaggtttcccgaaaagactccttgttatcaagttacttcaaacataaggcactcacacctcccagccaggagggttttttgatgagcatcacactctgccctgatatgtattacacccttaagaagcagttacataaatgcattctataattatggaaaatgtatatatctatattttcccctacattttccctccccagggatatgaatagattttattttcagttaatagaaaaaaaaagaaaagagtttctgattcttgaaacaactgttgtagctgttttctacttagcaaaacagttatctgtagttaggaatggtacataatatatatttaaggatttttgtagagcttgagaattgttccccttgtttagtttcgtgtctataatgtaccttaaaaagatttctaagtgacaatcaacatataaatgcattaagaggagaactttaagaaagaaaacattatcttgggtttacaaatccaggatattagcataaagatataaatgtacagcatatataaaagataaaattgtttactacattttacacatacagctcacatctgatttctttttgcttttgttggagcattaatttgaaaatgataagcattctgaaatgtttgctacaacacaaattcatggtaaaaatatacatgcataggcaaaaattgaaatggagaacacaaagctacgtggcaatcagaatcgttgacaaaatctccatctagactatattttgcatgaactagtgtatcatagaaggggcaagaaatctctctgggggttttgtcatttacataattagaaacaaaaataaaatacaaatatctgctcccttactaccttttcttaataactgacaagtgacacaagtggtaccttttaaacagatggatgcaaaaacttgtgagatcgaatgaactgatgtaccccattggtattttgggaacccaaattccataattaactttttacccaagtggcaaaagtagaagatgttctagtcaccaaattgattatttgatggacttttgttctttcttccacaagattttggcgacccagaaagggtaaagacatgataagagaagatgcatcctgaacaacttttattgtgagtagaaaaaaaatagcataaagtgagcataagaacagttggatttggaaagattaaaagaggagaaaagagcaacatatgcaacttaactagtctttttctttttaattttttcatgtacatatatgtatatattgggatgatggggagaaaagataactggatttcttttgaatgtctttgtgtctttatagagtgaatgttctgttcctgtctctttctttttaggcgaaaaactaataaaaatagaaaaacatatatcagacattaagctcactccccccccccccacccttccctttgtaaagaactctttgttctctagtgaaaatgctgaaaaatccccgggcagctactccctgaaacaagtgcaaaacacttagaggcttttgggctggctgggagccagaaaccctcccgctgtctggttagaagaggaaaaaaagaagagagagggagagggagagaggggaagagggatggggggcagagagagaggaagagagagaggaagagagaggaaaagagaagggagagagagagagagagagagagagagagagagagaaattggagcttcctttaatagacataggaagcagcgtttttttctttcttttttttcaaaactggcggtcaagcgttaagtaactcccgtctaaatccacctgctagaaatgaacttgggtaaccccccaggggtgcacaaagacagggaagacagtaacatactccatactctttcccaccccccgttgtactgcttccattctttctgctctcatacacaaatgcccacagcttctcacgccgcccctcttaccccccaacaacaaacacagcaaaatacatgctccctcggtctcctaaaaaaaaaaaaaggcttttccatctcggttgcgacacagtgataaggggtagcgaacatctcatacctggtgtgaatgctaatcagtcaggagttctccttttcccaagacagggaactgtttccttccaaatttattagaacctcctccactgcctctttgaaaaaccttctttgtcaccctctcccaagtcccgatacttctttaaaaaaaaaatggcttcggagctccttctattcttgatattgattctctctctctccccccacccctcctcctctctcctgtctgtgtctcttctgagtggtctattgataagtccctggaggcactgggtcagcctgcccgtaggaaaccagacacaatgcacaaatctccgagtgccattctgccatcagcaagcagaccacgtttaggagagagagagaggaaaaaaaaacagtagagcaagagacagagagagagagagagagagagagacaccaaccgagggagggagagagagactgagagagaggaagagagagggggaagagagagaggggggggagagagagagagagagggagagagaggagagacggagagagagagtgtgtgagaaaaagactgattggaacaggagggagagagagagaaaaggagaaggagagagagcgcgagagggagagcggcactgccagtcaggttaatcatccctactttaattagctgttcggcttagacataaaacaattgaatttgaatgatctgtcagcaggctcggctgaaccaaaggggaaaagcgaatattacaaaaagactgttggtgtgttctgataagcaatactgctcgtactgacaaatcctcaaagggggaactattaaaacttacaactaaacaaaaagtgcaaatacaaatggcactagatagaggtctttaaaaaatggagttttctcctctagttttatgaaccatagatatttatgtgcaggtgccaacatattaggggttttcgtgtaatgtgtgaaagtttattaacgatggtctaggagtgtagcagacagatgctgcagagaacaagacaggtacagtcagatgccgaatctagatcttggagggagaaggatgctggaagaagaggcaccgtggcaagagatcagcacagacaaagtcagtgggcagataggcagacagattttaggcacggcacgatctcatctaaaaaggcaaaagttctgatgcaatattaggtacaaaacaatccatccatcctcctctcccgggtgcactccaaggtacagttaaaatggattaatctttgtgacaaacagagctggcaaggcagacactgaaggcgatttgcagacccagagaatacagagctagaaaaagccccagagatcaatctctccccctcccaatttagtagagaggaaactgaggcccagagtcgacactagacactaggactccaggagcccaccaggccagtgctctttccaccacaccagctaacctagagtattctttgaagatctggcccaacaggtatgaaaatcacccttacctcccaaataagaagattactccacctatatagttagtgcacaaacctccaatttctcaaaatgtttaaatagccaaatggaaatataattacatatataaatacatttccactttatatatatgtgtgtttatgtatatatatatatatggagagagagagagagagaccattttgaatgctaggaacaagggatttaagtctttaattcattctaggagaaaagcagaaaaatataatattgtagaggcctcgtctcagcaagatataacttgtgtcacattttcaagctaatgaaggctagtggtttgatctacaaagacctcaccctgaatttacaattcgctctatgaacatcatctgctatatatcaccaagtgagaagatgtggtttttctcatacacctcgtttctaaaatataggcacattgtgggtgaaagagattgagtctttcagcatactatgtagttttaaagcactgatgagattttccacctggagaattaggtatgtacaacctttccaatatatttcaattgaaaatgagctactaaaaaggggaaactatattttccgcccatgaaagtgatggtatctttttcgggacacatatgatcatgttcactaaggattcccttttgacaatgggtaattgaaggtccagtttttaaatggtgaaagaggtgcttatgaagagaacagtgccatcagatgttactggagagattaagtttcttgccctaaaacaagactcaggatgtgtatgaaaccgaaaactatctctcagtcatgcttcagcaacaacattgctacttagggagaaagaagaaaaccgaaagaaatgtcaggcacgtgggagcccactcaaagacaagtaatctgagagaagtcatagccagagtaatttagtttatttgcacaccaacctctttaacaatggctgctatgccatgcctaaaacacacggcctacagttgactgatttggaaagggggaaggaatcagtgattttgataatggcagatcctttggcaagccccaaaatacctgataggccagagcccagaagaaagcagtggagtgcttagtaaatgtctgttggtgaactgagaaaaaagaacaagagctttggagcaaacacatatttatatataacactgcaaaagtcacagctactctgaaagcctcagttttcctttctgtaaaaggtgatgatattggtcccatagagttgtcttaaggatgacatgaggaaacatataaagtacacagctagtcattacacggtagttattatggaggaaggtgtgtaaacaaaagtgtatattatggatgtgctgagtgtgttatattcaaagcatgtaggttcaagacatgaaagcatatagcaaagcaaggatctaatatacagatctctactagaaaggattggcagtagagattataaagtttagaactaaattcctaaaatctaaacttcaaggatgttaggtcatctggggttgtattatttctttgttcccagattttactatatttcctggctcataataataatgatggccaacatattactaattggcttgccctaagcagtctgctaaggactttacattttaaaatcatactttagcatcacaagaatcctatgaatgaggtactaccaatatccgcatttcatagaaaagaaaactgaggtatagaaagattgtgtaacttgctcaagatcacacgcctagcaagtgaggagctgggaattaaatccagccaatctgattttaaagcccgcattctcagccatggtactaaactggcacacagtaggtattcagtcaatgtgtgttgaatgaataagcaaataaaaaaaacactagaatttttatttcattggagatcagtaataatctgtgcaaaaccacttgagagaatcttgttttcgaattatagaatctgtccttcttctgtagctcacttcaggtgtagtcctttgtcagaaaccagggtgagccatgtccctgcatggtgctgaaaatggatgaagggaagagtgctgaccatgaccacccagggcatttaaatatctgacggcattttcagcactttgaggacagtgttagcacaagggttattaattggcttaattccagttcggataattacatcgtgtctctttaattttcccccgactatgccattcttcacttcctgtcacaaatgtgctctttaaaaaagcatacgaatacacacaaacatatagttatatttaaggtttgcataatcatttagggtgcttttttttctaaatgatcagtgtatagtagctatgtaataaatgaatgggcaaaagaattaaagtcattgtaaaataaagataactagttgaagctttttgtttggcaatgaaacagatttttaaaacatttccttggtgacagaattccaatcacatttttttctcatgggcagatatttccagagctgatgacctgctcatgataagctgattttcttacactatgtagtttccagtataaaaaaataccaatgaaaacttcgatattttagagtagaaaatgagactaagtcctgagtggtagagcatactgaacgtacgggttttcagtgaattattaacccatttattagctctgacttacttgacaggttttttttttttatctccaaacatatcactagaataatcttcaaattatgaaagaaaaggacaacatatcctaatttaataagcttaggaaagtttgacagtcataaacagacacaactccttttcctttttccaaagaattcttggcctttgaaatactgtgcctgcattatactaaagaaacactcccagaaaaatatgcttaaaacatgtacacaaataggtaaatgcacccatggtagaccatagtttattaggcctttttagtgtacatttgtatgaataagtcatcaaatatagggagtgtggaaaataagagaataaagggttaatttatttattatgcaggaaggtttctagatctttgctccttcagcttttagttcaaaattccatgcatattctgcacataataataaatgccataattcaacgtatctcataatttgatttactttcaagcacctttttttctggttcagctcttgaagccttccttcttataaacttcctccaagttattttttgtagcgctctgtaaaatatcatttaaagttggtgttcataagataaccctcatgctatagagagatttgtatcaaactagtccatatttccttttgagaaccagtggtcaagtcccatgctcttatctgagaacaagccacaataaatatataaaacagccctttcccacctgtttgacccctgtaataatgatagcagtctctcagtgactgccctctggttagttactcattccttaagactgagctcttccaggacaaggtctttccattctaccttgtatatttaatgtattgtccagcatcacacctgccatggtggtagatgatctcccagaaaagctggaagcaacaaattttaattccctttgttcttcatgagtaaatacaaatttttctctctgtgtgtcaagttttcaacatgtaaaaggggcatactttatcctaagattagtgatttgatgttcagaaaataatattggagggtatagtatttaagaattagctagtgaaaagcacttgttttggttattttcatagtatcgccactatttttatagcaagaagtacttagaaaacatgttttaaattcaaaatttaggtgaattttgaattcaaaagaaaagtggacaagatttatcctgaatattagagatagtaagcacttggtttttaaatgccatttaggaacagcctgacagattttatacaagcagaaggtatttaggaaattctctggttctctcagtttacagagaagagctgagtggcagagatattttatctgacaagcttaaggtaaaaaaacttggtagaagtgaactagtgctggaacccagtctgtctgtccctggttccacactcttctcactcatactttgaaagatggcttttatactcttgactccagatcccctcttttttggacatattttactgacggaactcttaaattctggtgctgataaaggggtacaatattcctaatgtagtctgataaacacactacaaaggaactatagtaggctgaggaatggccccccccaaaagatatccatgtcctaatccccagaacctttgaatgttaccttacgtggcaaaggggtcttgcaaatatgattaaattaaggctattaaaatgaggagattatcctggattttctaggtggactctaactgtaatcacaaaggttcttataagagagaggcaggaggatcagagttagcagatgtgatgacagaaacaagaggttggggttatttgaagaaggggtcatgcaccaaggagtgcagggtcctccaaaagatagaaaaggcaaataaatggatcctcctttatagccgctaaaaggaaccagccctcccaacacctttactttagtacagtgaaactgatttgagacttctggtttcagaactgtaagagaatacatttgcattgttttaaaccaccaagcttgtggtaatttgttataacagccataggaaattaacacagggaccatcagctaccttgatctggacataatctttcaacacagttgaaatatttcttagctctttaaaaaattattttagcagatatattaccttactggttcaaactgagcttgtgatacaagaacccttaccagtcttcagaaaaatattgactaggataagtcaaggagggtcttttctcctgacactaagagcttccttctaagttgacataaagcaatcaatctaatgattattggttaattgatcagttggctgcagatccatctaatcacatttgcccacctcctgtcttatagtaactcttcactggtggtttggcaattgtatctccaagttaatctacaacagtagttctagttagaagcaaagagaagggtttcagtgtccatttcttgagtgccagagacctgaactcattcagaagtgagtgctctcttgctagacccccaccccacatttttttctgagctttcttaacagaggtcagaaaaaagaagcatgaggcagcttaggcaaaaaacaaacaaaacaatctcctcccccccccctctttttttttgagacagggtcttgctctgtcaccgaggctggagtgcactggtggtgtgatcacagctcactgcaacctcaaccacctgagctcaaggaatcctccagcctcagcatccagagtagctgggtgtgaccacaggtgtgtgccaccatgccaggctaatttttaaatttttgtagtgatgaggttttgctatgttgctcaggctggtctcaaactcctggcctcaaatggtcctcccacttgggcctcctaaagtgctggattacaggtgtgagccactgcgcccagcccctatccaaactttaataagactcttttgccatagtgtatcattgccattcagttaccgcttacattctataggatagtgctcctaaaagagtagtccttgggccagcagcatcagcattgcctagaaacttgttagacacgtaacttattgtgtcttattctagacctactgaatcagatgctcagaggtggatgtctgagtgtgtatattttaacaagccctttaggtaattctaaagcctagctgagaacaattgtcataggacaaatctgtgaggctcatcaaggctaatgaaaaaacacgttggactcagagtgagatcacctgctaatctaggtgtcatggtgactctgtcatttgccagctatgtgactttagattatgttcttagtctatttgtctcatctgtaagatggaaataataataattaataataataataaattgctttatgtgaaaagttaatgtagaagttaacaagatcatgcatatgaaaacactttacaacctcagggttattattgtagaagaaacatcaatttggattgcaagtatcctaggaccacattgttggtgatattgccttgatatttcatattaactagggctcccaggtagtaatactgaaaaaaagttcaagaagctccagatgtccaattctccaggccaaaataaaggctggaagtctgtagatgtttaaagggtgtgatgctgaatggaggatctgctggcattattagtctctagaaccaagtgctaaatttcttgatttgaaagtctacctttctatttatcaggtagcagaatttagtgacagctttgaattctgtatgccagtgaaagtctatggcttgtgggattcagaaccacaattttttatcaatttccaatgacactcagttttagtaaagtggcccatgatctcttgcatttccataccatattctcaaataagtaagaagctccagggagctcgctcaacaattgattatggtcacatattttttcaatagaaaatatgtatatcctggtaggtgggaaggatggtcctgatcaggactgagatctttttagaggttcaagtccaaactcttagtaggttgaagggaactcagatgcaaccagattagacacaactatgattttcatggaaaatcatcagaattttatccaatctctgagtaatgaaaatttgcagtatttctcaacagctctatatatgtggagaaaaccacctcataagaaagctaaccatgtcttttccttctttcatgaaataatagtgacgtatgcctcttggcctgaggactcgtccttcctctgaagactaatgtctgcacgtcaccttttggcaacccctctgtgccttgcaggacagttgtgtagcaaagattctgtttgggttgctgtttcctctgagccagtcacactggtgcatcaggagatgcagctgcaccttttaagagctctgtgtccttaagcaagtcatctgtccttttacatttcatagatttttcatttgtaaaatatgaataatatgtgccttaccaatcttacaaattgttctgaagatcaaaatggatgatgtatccaaaatgctttgtaaactaagaatctcattcggttggtgttactgatgttgttattatttactctttagcaggagagtaaagatatatacagacatattgggtacggtagcttgaatatttttagacatctacgttgtatatgcctccaaggtttccccctgaacttacattaatccctttttcaggttacagctaaggtggtaactaaggatgttaatttcctttaggtccctataggatctctattttgatcatgattagtttatacatgaaatagacactgctgcagaatttacaatgtttccattctggccaactcaactttgaacatattccctaagtaagaacaaattcagtactataacactgaagaaaacatagcatccgaagctggtattgagggagtgaaaatatcttcaaaggctttttcttgattgcttaatataaaaaatctgcttagaaatgtccactagttcaacaagcattcctgaaggaaatctgtaacaaagctactgtgcattaacatttaaaagaacaggaacatgtagtctacctcaaaacaaattattattgcttgaattgcccaaactttgttaaccaaaattgaatttcgcctaagttgaattcatgtgaagagctcataatgcattgttgctatttagatagttgtcatagtatgtggtactcagtaagtcctctaaaatggaagggaaattaactacatggtataatttcaacataagtcattaatataattgtgcgaagaatatctctgaatatattgaactgctatttgaatctttaattgtgcatacaattctaccttttctgctatgcatccttaactagactatatgctccctgaggacaattcctgatttacacatctccaaatttcccgctgccttcagtacagtggtttacaagtagcatttgctttcaaactatctgctgtttaattatattcactttttattggcttttcttggggggcaatttatgcacataaagtgtccatagataaatgcatcattatcactgaggtgaaagttgtgattcttaatttttttaaaaaaacatatacattgggccacttatttttcctgtgtgacactcaatctaattatagaagtgaatagaaaaacatgatctcttttaaaaggcgcactttacgtgaaacaattttaggaattcagcttatgtgtcaagtacagtcattctgcacagtgatggtgatggggaggctctatgtactatggttttgacagaaaatattttaacttaaagccagctacccataaaattacgtaaacataaatatgcactctcccacaaacacatttgcacatctttaaacttagattaatgcaaagaaaagatatattcttttgttctagtggaatacaaatgataaagactaataaatgaataaataaagctctaggtaaccaaatcaatgtctgctcaattctggtcaaggaggtgaagggaggtttccctttgagtcagagaatgtagtggataaaaaggacatgaatagctggggggatttcctgaggccattgtagaccagctcacacactgttaagaggctcattttcatgagacttttggttgcatttgtaacacttgctctaggtcccctagagcattgagtgccacatcacagcactacaataacaggactaaatgcaagaaggtacattacaaggttctttttctttcagctctgaatatccaggagtttgtagatgttctcaagactttttttccccttcgtttttccttctcccccaacccccacacactcccttcaaatagaactaagtggaaaggactgttttgtttttaggtaaaaacctaaattcttgtacttaaaaaaaaaaaagccagttgtaaaatctgtaatataattaattatttccataggtaagagatattttattttttataaaacctggtctgactggtaagtttgttctagattaaggatttagctacagtttggtgagtgtttgttctctgttaggcttggtgcatattaattcgtacatattttaacatttcactactgtattaaattattaataatttgaaatcattagcttgtactgacaccatttttctgaaacagtaccacctgtttcttctaagtttggtccagaacaaaagtctgaaatctaatttgtcaagaaaacaaatgtgtagttcagaaaaaggataggggccaggtgcggtggctcatgcctgtaatcccagcactttgggaggccgaggcgggtggatcacctgaggtcaggaattcaagaccagcctggccaatatgatgaaaccccgtttctactaaaaatacaaaaattagccaggcatggtggcacacgcctgtaatcccagctactcaggagtctgaggcaggagaatcgcttgaacccaggagccggaggttgcagtgagccgagatcgcaccattgcactccagcctgagtgacagagtgagattctgtcttaaaaaaaaaaaagaaagaaagaaaagaaagggataggaatcaccaaaagaaggaggtccaaagtccaatgttaggatgattatgctcatgacacggccatttaatctttaaaacaaatataaaagacaggtattccctgtggcagagctgagctttacctcaggtctgtgtgacagagtctcatctcttctcttatacatcctcaatcttcagacatttaaggtctctgagtatccaggatttcctttgcgacaataattaacaaatacatgtatgtacatttgtgtgtgtgcattatgttttaagcatatatatatatatgcaggaaactcacatctggagtaccagagtctacaggccaggactagatacttagatctctagggaagtgatccaaatatctagttgcagctatgtagatttcaagaatgcagtgaggggagaaagagtatacttaatatatgagtacatatacactatatatatcccatatatgtatgacatatgtaactaataatagtcaaccctcactaacacaatgtgcctaatattattgtaagcacttcacaccccgttactttgttctcataacatctaaggtaggcatcattattattatcatctagttttacagatgagacaagcaaggcacacaactaataagtggcacagtccaagttcctatctgtgatcctgtctttttcatggaccttttcctatctgttgcctccatgagaacatatctgaactttggcctattcttttttaagactttgctccctcttaggagataacaagtagcagaactcacatgttacccagccaatagtgtacttagcttgggaacaaaagactaaatttgtggaaattcctcacatttgtacaagagaacgtcccaaagcaagatactatggcctggaaaatggaagagatagtttgggcaggtggatgttttgggtctcccaaatcacaacacatgtgcaatgcgcaaccatcaatacataaatccaatttaattcagtatatatttaataagcacctgctgtgagcaagggactctgctaggacctaagctctagaaagtagctacaaagattagaagcaataatcctaatatttagaacatgggagaaaagaaataccacataactaaaacacgatgcaaataagttaataccgtaaagcgttgctaaaaaaaatctgtaggtttcagtgacttgaggaatatcatttgctattcagcggtggacactgacaaagttacctgaagcaggcagtgtttgagatggactttggaatgtgggaaaattccaacaattagaaattggagagataggttttaggcaagggaaacagaaagagtcaaagcaagggataggaaagcacaaactgtgtctggggtcaatttgactagcttctagactactcaaaggatagcagtaggagtttgagatgttgtgggtgaaacatgtggaaatgtccattgagcagcaggaaacccacatgtgcagtaccagagtctacaggccaggactagatacttagatctctagggaagtgctccaaacatctagttgaagctatgtggatttcatgaaactgtccacagatttcaagaatgcagtgaggagagaaagacagacaaacttacattttgtgggcagataaagggaggatggatgaaagatcattcagatgaacaggagaaccataaaaacagacgctatagagtgtaaaggtgaagaatgcttcaaatgcttcaagaattagagatagatagtcaaaacaatcaaatcataaacaggatacctaggattgctgtgaggaagaggtatatttaagagctagagtcttcatcactgtactcatctttgaaaggaccacctcttattgctttctaccctttccctaaactcaagcatgcatacaatcacacacataaacaaacattattttttcctaggaaaaatgttggcattattaactctgaagcaaaactatatctggaagtttttagagtagttagcaagatccaaactttatggtttgattttaattcaaaagataactgaatttttatatgcaggttaattattccttggtgggaatgtgaatttatttgtattttattcaggaagtatttttgagcatttcctaactccaaggtattgtgctaaacgctgggatcagaaaaatttccataaatgcttggatggcttttacctgggagcactccttcctatggttggcaaaaagctgacgcctttgtgatgatgagtttcagtcctagcctctaagagtttttgtggtcatgttattaagtgcaatgtttatgtgtattttttctgttccaagattttttttaaagttttgaatatttttttatgtcaccaaaaggtgctttagaagaacaaactaactcaaagccaacacagaaactggttctcttgctttgccaaagtggcagtgtagcatgtgggcaagtaagaatacttttctcaagtatttaaaacaactacagaaatcttattcttcattgtattctctaaagaataaaggtaagaaggaaaatcaggttttgatagagaattaaaaaatagctttagcatatgttcaaaccattaggtcaaaagggactaacaaagccctgtagaaggggacccacaaaagctgcccttgggacttacttattcacttatttgtttatattttttgtatatgtacatatttttctgatactgctttgacacatcactttagctctttttctatatgtatgaatattcttctcctacaacataggaatcttgatgtatacatagtttagtaatctgcattcattctttcaagataaacatttttaatcctacatggtattctattctaaggatataccagcataaaatacaatttaaacaatcacctatttttggacattttggttgcattctgacttttattcttttcaataattctttgtccagtatcattgggcatagtctttgcaatgctattatttaatgaaaagaaaattttggaaactttaacaggtaataccacaagcgaggaaacttaatacaacgaccacaagcaatgaaagaaaagtcaaatgcctcaaggagccagggtggaagagcaaatgagtgaagtaggtgtggcataaaatatggggtgatagggactttgtcaaactggagagaacatggtttgtctgaagtgagcagctgctactcagttccagatattggtgccacatgtggatgcagatctaatgttgtcagatctccaatttttcaagagaagcaaaaaaaaaaaaaaaaaaaaaaaaatctagtttttttttggtgtgaaatctctttaaccttaaaggttggctcaaattattttaaatattctgtggaccaaacatacattttaaaaaattctatctgctagctagatgcagctcataggccactgatttgtaactttctaattaaagaaagggcaagacggtgtttggaaatatatttctaggtagagagttaagcaaataaagttttacttcaagttttcctagtcacaaggaatgtaatgtggagagactgaacctcaatgtgcaaatcttgaaagatgggtaaatactgctccccacttaacacccatgaagaatttaatagaagaggggtctaaaatgcttttaatttcacaaagaaacatgctttaatgatataaaactctaacccagtgcactgtatgatgatatctaatgataatttcccttcatttcccatctgaacaaacatttcccattaacatccacctgcactacttcctttcataaagaggaggtggtatttggctatgttctggttctgattcatgagaaatcagcccaagcccaacatttctgttcttaacagattttggtttttaaatctgtagaacacaatgtttccctgggctgagttctagcatgccaagttttggctggccacagactttgacatctgagtgaaaaatctttcaacaatggcatttaaactgaagaatcaacagacctttaattataacactgcttgtaattccctccctctcttatcatgatgttcaaattgcctcaaatcactaactgcatggacagcatgttatttcatttgccattggaaatatcataattttaaaacttgggggcttgagattgtgcattaatttttgaaaaatcagtattacttattcaccataaattaaagaggcatatggaacgaaggtcaaaattactgattcattagaaataaaaaacaaaaaccactcaccacacaatttctcaacttatctaaaatgctcaagatttagattaaaaacaatatttccacttggaaattaagcattaaagatatagaaaaagggagtctctttttagtgagatttcactaaatacctctggtatctctccataaaatgttaggtgatcatttcttaacagctttttaaaaatgacacagtctcagattaccctatgtttcccttatataataacaaaagacacttttatactactaaagtacattaggaatcctttgaaagtttctgttttagaaactgatgttgaaaaagtacttaatttatatttaacctgcctatctgaatatacttagtggaaaaattagggttaaaaatgtaaatgtggaaaatgtttatttccatgttttatagtagttagttttttatttgcttttaaatatagatcttggttatatgtggaagacaggcataatttcagctcctttttcatcttgaagagaaacctggctctcaatttccaggaaatatatttatttagacctaacaatataccagaattttatgcattatttctaatcttcataataagtctacaagttgggtgtcattaatctgttactgataaggaaattgaaactcaaataaatttaatgcttttaccaaggtgatttagttagtgtctttttgtccatggattttaagtggtagaatttgcatgcaaacccagatatgactccaacggctctgctttctcctttagaagaaaaaaactccttcctgaaatactaacatcttttctttgtgtaattgaccatcctttcttaatacaattggttatcagagctatcatattcttaattatcagtattaccttacgactctaaaattcatctttgtccagtgtatagaattcacatcctaaggttagatataggagattaagtctctgatctcctggagcagacctggtttcaaatcttgtcttttattatccccataaatatgcatgtatttataaaattatgtcctaagtctttgttcagaaaatatgtagtgtctgacattattttgtgtataaaatgctgaaaaggtcacatccaggaaactagtcctgaccagcatacaacactcaagaaaggttctccaaggtagaatcaggggagaatcccaattgaagttgttgaggggagtaaagataataaataatattaacaataataactccatgcattgaactcttaatattcttcatcctatctatatatcatatttaatttttacactactcccattttgcgtgtgagaaaacagaggcttagagatggtaaataactagttcaaggtcacatgactagtggcattttactccagagctttgctttttgtactttgctaaactctctcccagaatatgggaacaaaatctaaagaggtaaattcaaagatcaatattaagatgataaatacaagatgcagccaggaatcaggaattggagtgggaacagatgaggaaacaaggtggtgggtccagcagggttgcatggttgaagtcagcaaatgtctgatatatgggggtgtcatgtcacattgaaagtacagctacatcagggaggtggagcgactgagagaatatgtagagggtgacagatataggactgcttggctgatttcatgtttttcctttacaaatgtaaataaaacattgtgtgttggaggtcagagggcaaaggagatataactgaggactctactcaaaaaaacatctcgcttcatgtgtcattaactgaacaggggaaagaaactcagttgtctaacaagatatttttaaaatatttatttctccaagagggttaaacctcatttacaccttggagtaaattactttaataaggttaccagatcacctaactgaatgtaactaaagtcaagaagctgcagtttgaatggggaaaggaaatggataactgtggaactgaagggtgggagaaggggatgatagtgacacaagcaaggataaaaaggatttccttaggcgaataggagggcaccaaagataattttatgaaaagacagttcagggctaaataaatgtaaagtactaacatcatcattatcactagttctactctgcacttatgtctagaatttttgtagtagccagtgtacagacaaaatcactaaaattggttgctaatttctgatttacaagctgagcagaattccctacttagagtaactcctcaaaacatacttgttgagcaaaatgggacgtcaaaattttgcctggaagttggaaactttcagattttccaaattccaacctgtttttacagtctaggttaatccagtctaacctatcaagttcatctaactgggtcctccctgggaaaaaggaagaaagaggacataggaagtgaataaagaattgatacctcagctgggcgcgcagtggctcatgcctttaatctcagcactttgggaggccaaggcgggcacatcacctgaggtcaggtgttcaagatcagcctgaccaacttggtgaaaccccgtctttactaaatataaaacttagccgggcgtggtggtgcaggcctgtaatcctagctgcttcggaggctgaggcaggagaattgcttgaacctgggaggtggaggttgcagtgagccgagattgtgccattgcactccagcctggacaacaagagcgaaactccatctcagaagaaaaaaaaaaaagatacctcactgctctccttcccttctgtgtggcccaatacagcatgctgttgaccctggggaagcttcagaatgtatgatctaggaaagctgaggcaatgctgtaataacaagagctatgtgaaaggtaaagtatgaaatgtatgatggaaaccaaaccaaagagggtatgttaaagataagcccattaaggaaatagctcacctgttggactggaatctcaactggctcttttatttcacgctaaacctgtgctgagtctgcacagaaggacttctgaaatgcttatatatacaacctgacaggtacaatcagaaacagtacaaggactgcgtgcctcaacaagaatagccagagcactgaaatcaattgcagagcacagacatacttcaactgtggctatgcagacagtccccaggtatggctggtgaacagcacgctttatgtgtgctatgtcccagacttcctggctttcttcccttccgtcctaccccttcggcacacactacatatctttcacattttataaaatcacaggagatttccaaattattgtgtctttcaaatactttaaaaatatattgtcctcctaatataaaggagagaggtggagtatttagctgatgaactgaatttgaaagtaagtttgcatttttgatatatttccttccttatgagtgagtcatgaaaaatgcatattttgtctaaatattgataaagctttagaatataagagctggagtgaacctaagaggttttgtagcccggcaatttccaacccaggatgtgtctcagaatcacatagagaggtttcagattcccagccaggcacagtggaatgtggctgtagtcctggtgactgggaaggctgaggcaggaggatcactggacccccagagtttgaggccagcctggggcaacatggtgagacccctgtctctaaaaaataaaaagtaagtagaaaatacaaatcacagattcctgggccttttccttcccctgccttccccaagtgattctaattctatgtcagttttggctgcttgcaaccagttatggagaccagggatcttgatcaatctcttcatctatctgatgaggaatctgagacccagagaagtaagaggtacagtgatttctctaaggttacacagtgtatgagtccatttgcacactgctgataaatacatacccaagattgggaagaaaaagaggtttaatggactcacagttccatgtggctggagaggcctcacaatcatggcagaaggcaaggaggagcaagtcacatcttacatggtggcagagaagagagagcttatgcagggaaactccccttttcaaaaccatcagatctcttgagacttattcactatcatgagaatagcacaggaaagacaagccccctgattcaattacctccctctgggtctctcccacatgtgggaattgtgggagatacaattcaagaggaggtttgggtgggggtacagccaaaccatatcccacaggaatatgttacaagtgaagatagtctatggacactgtaaaattgaccccattagctatatcccaaactagttcattattttagaatctattttgtgtgtttgcatgcatacagcaatgcttcacatatctgcacaccacttatgtggcattccaaatatggttaagaacaaacaaagtgaaaaagacctgcaagcagccaaaattggtactaaataaaccacacataatcctccaagtctttttaaaagcctcttctcttgcttctctatctagtgaggcataggtgactcaaaatctttatctccaagcccggcccttctgctgcactatagtgtcgtgtctccaaaagcctagtggaccactcacagatacccagtcggcaccttcactcagtgtgttcaaaattaaacgtgtgctttcccctcccaacccttctcctgctttgctgctctgtttatgactctactaaggttcaaaatcatagagatgtgtttggtgtcttcctctcccttgctccccaaatataatggattaattctcccgccacatttcataaatcagtttgccatctctgttcattccctctgcccctgccctagttagtgccttcattgcctttcacctggactattgtaatagtctcctgcctgatcttgtgtcctctggtctctccctactccaatccattttactcactgttgccagattaatcttcctgaggcacagctctgattatgttactctcctactaaaaactttcaatagctccccactgtctcctgaataaagtccaaattccttgccctaataatcaagtcctttcactttctggtcccaatatacttttaccgctttatttcccactacttatcttcacacattccatgctcaagttaaactcaattacttctttgcagaatctttaccctttgattcttccatgcttttctcatgatagagtaatgttctttccttctatctctgtatgctcaaatcctgcttgtttttcaaagcccaaatccagtgtcatcttttctgatgaagccctcagttagccctcctctgagctccaagaataccttatctgtactacttttatagagcatttcacttttcactattaattctagcaaagtagacacatgtctcagctccgttgctagattaaaacttctagggcaagacatgtcttatctgtgtatcctctccagtgccaagtatacaagtgcacgactcacaatatttgtcaagtgaatgagttcatgtatgtactttacacacaatcaaaacatgtttttttgttttattgtctaaagaagattagaaataatgcatcagagaaggaatgaggatcttagagacttgcacaacagaaagtaacttaatagctaaagaagaaaaataaaaactacgaaaagaaggcatgagaactaaagatatagcagtcagagggtaaagaaacacagaagcaaataatcttatagaataaggaccaaatggttaattgagaagcttggaaaccataaaataacattcaaatatgtagcattatttttatacttccacaccctcatcaatagaaacaaatttgaattgtagttcaagataacaaccctgaatcatttagaaaagtttgaattatggtaagtatattcttttttttgagatggagtcttactctgtgaggctaggtaaataagctgcctttattaatgaagaaattcatatttttctgaatattagagaaatattaatttttcccaattaagatatgttcatgatatacaatttagaaaatataggagagtaataaaaaatcttaaaaatcctaaaaaaggtgggattataccatatgtattactatgtatgctgccttttaacttaatatatagtataaatagttcatactattataggttcttcataaacatttactggctcaaaattctatctaatagatatgtcgtactatacttaacacagcactctagagttgaacatctagcttatttccagttttataatacaaatatgtctaacaagatttaccatgggctgacaactgttgaagcagagtgaggaactcatgagagttcactatgatattcttcctacttttgtatatgtttgaaatatctagaacaaaaaggtaaaaaagcatatttatgtcttaattcatttgtgttgctgtaacagaatattataaactggctaatttaaaaagaaaaaatatatttctcacagttctggaggttgggatgtctagtatgaaggtactggcatctggtgagggccttcttgctagatcatcccatggtggaaggcagagggcaagagagcacaaaagccagagagcaagaaggagccaaactcacttctataatgaacccactctcatgataactaatgcacacactcctgcagtggtggcattcattcattcatgaaggcagagccctcatgactgaatcacctcttattaggccccaccttccaacactgttgcatcagagattaagtgtccaacacaagaacttttggagacacagtcaagccacagccatatgataaatatcttgtgcataatggcttttgtttacttgtaattattttcttaggttgcagtttagggctagactgcctggatcaaagtcttaccccatcattacctagttatctaaccttgggcaagctgctgatgctttctcagcttcagttttctcatttgaaaaatgggtataatggtaacttataggggctgttctaaggatcataagagaagatgtgcttctaatcccttccacagtacctagaacactgttagtgtgcaataaatgtcacctttgaaaaagcaaaatactggttgcataattatgcgttgtgcttataaagaaacatcacatataaactgaaaaacatacctgaaataacatgcttaagtgtgcaccatttctatctccaggctaaatgcttatttcaaagatacgaccactgctaaaataatttagatccataattaccattacgaagcattttctatgtggttgatattggccttactgggctacatgtttgatgtgtactatctcatttaatcatcataagagttttctgattactttatagataaagaaactgatgcttaaaggtgaattaatgtgcccaaaaggacacagggtctgttttcaaacacaggattgaacctctggaattcatctctaagctactgaaaatgacctttgttccctgcactttttttttttttttttttttttgagatggagtttcgctcttgttgcccaggctggagttcaatggcacgatctcagctcaccgcaacctctgcctcctcggttcaagcgattctcctgcctcagcctcccgagtatctgggattacaggcgcccaacaccacgcctggctaattttgtatttttagtagagacggggtttttccatgttggtcatgctgggcttgaactcctgacctcaggtgatccgcctgcctcagccttccaaagtgctggcattacaggcatgagccaccgcgcccggtccgtaccctgcactcttttgcatagacttcagtctttctttctttcttttcttttttcttttctctctctcttcttccttccttccttttttctttctttctttctttcttctttccttctttctttctttctctgtctctctctctctctctctccctcccaccctccctctctctctctctctctctttctttcttttttttgaggcagagtttcattcttgttgcccaggctgcagtgcaatggcgcgatcttggctcaccgcaacccctgcctcctgggttcatgagttctcctgagtagctgggattacaggcatgcgccaccacggctggctaattttgtattcttagtagagacagagtttctccatgttggtcaggctggtctcgaactcctgacctcaggtgatccgcctgcctcggcctcccaaagtgctgggattacaggcgtgagccaccacacccagcctagacttcagtgtttctaatctttattcctcagaggcagatatgaattttggacaaagttttggtccaattttggatgtttaactggacctttgggtaaagtacctttctccttcccattcactttaatcagaattatttatttaacaaattttattctagcaaacaattttagagaagaaaaagtagtactccataacaagctgctcttaaaaatgcatatctcattctggaaaaactaatagctatcatggttttaaacaataattttccattggtttgattatcttatgtccactgtgaaacaacagttcattattaaacaattcattatcaaacacacaaacacatatacacatttaataactttaaaacagtccatatttacatattttactttaaatatgtaatctgaaatgtgtatgcatatgtgtatgtgtgagagtaagacatagaccccggaagtctgaatttggaaaaaccctgtgaaagtctgaaaaaggtggttttctacaaaccttatgaaaaattaagtcatagaaggtcacaattttaaaaaatagataccaaattaagtattttattctgggtttagggaggcttctcctgtgcaacatactttagaccaaggcagtcaagaaatactaaaggggatgctgcaattcctctgcctcagacagtacatttatgcatctgtattataaaaaatgtgccagctctagcaagctcacagtactgagcaaagtgctatagttacagctggctctgtttactctttttttttctggtctgttcctctattgggggggggccacagtagggtgttttttcaggatggggggaagaaggaaggagtttttgtgagttctattttggattttggtgaataagaaagcagagaatttgctagcctgttactcagttacactgaaacatgatgcaaactgactcaatttggagcacagaaggtgctgaaaaatttttctaaggaggtcttgaaatatctaagtctgccttcaaggaaggacttataaaaaaaaatcaccatgtaaataatagaagtatgttgctacttctcttaaacctgacctcttaagtcactactcacactaatatactctaaaagtagccagcatgatatttcaaaaattactttgtgtcctttatcctcagtagagtattaagaggaagatgcttgagtgtagacacacatgtgggtcttctttacaaagtcacgtctacatatgtacaccgttagaagtatgggctctaaatgattgaacaagctgtatttccatatttgtattgtccaacctattttcttttttcttattttcctgaatatgtctgaatatatgtgttcagtataaacatacaattgtgtggacgtgtctatgtgtgtttctaattctatactatcttgaaaatggctcagcgttctagaaatacagccacataatttgttttgttttgaaaaactgctcagcaaatgcatacaggtcataatggcaggtaacagaccatttattgaagtgctgaaacaaatagaaaacaaagtccaggacaccatcacagagcagtacttcccttgtgagatactctcagctaagtaagaattgagtgagacaacaataaaacaaatacccataggcttttcaaacagtaacaacccgctcagggttagcagcatttctagaccttgatggtacaatgatgttctcaacctttgctttcagacactggatcactgcttaagtagcctttatcttttccccctaatttttgttgaagatgcccttgaaattagattatatttgttcctaacaaagcatatgtatattgtggcatcactcttaaaaccaacaattgggcttagttttatgaagaaaaaaaatccaccaacctttcatgctgagatttctcatgctagttctcagcacagaagtgattttttttttttaagttgcataaagcctagcaaggtttaagttttcccagcaaggagaaagtgtttttcagctgttaaatttttcagatgctttttttgaatttggataaaactcaaaaacatgtttgttttaaaatgtaaaccttttcatgtacagaggtttgcatatagagaaatgctattactatgtttaaagatacttgcttttgaaataaggaggtcacatgcatttaaaaataacaaactgcatgttgctttatgaatgtcctattaagccctaacgtaaatatgatgttctggaggagcactgatgcacacgtttgctgataggatcacttacaacactgcttgtggatgtatttccatgtgagagcaaagggtggtcaggtttgaactgaagaacatccatatagtcagctaatatgctttttaaagaccttttacctcagttgcaacacacttctttgtcctaaacctgctggattactcaacttgttggctggactaaagctgacacaatacatatttcaagcacaaaaatgatgaggaacacatagggatgtcagcaaagaggcaaagaggatggtaagtcatcggaaggctggtcatttttttttttttaaacagttcaatgtctttactgttttctgtaatattatcattttccatttttcaaacaatggaaagaacaacaattagtttcatttttaaaattattagatcataaaggacaagtttaggaatattgtttctagcatactaatagatgaagttagttgtaaatcaatagtcttatttctctgttttaaaaaaatagcaaaatacagtattctgaggaaagttctgacagattggagtgttacaggatagtctgaaatctgtttcattatagaagtttggccaatatagagataatatattttaaatggcttaagtatatattttttgtggattgcacattctgtaagacggtttgagtgccttgagatccaagtctttaggtcaagactgaactctagaaatggccccatcgaatctacaaaaggatacattaaaaaaaaaaaaaacctcatttcctgtaagctgctgatgctactcaacagagttgaaactcaggtcacacgcatcctactactctagtgctgccccatttactaatccaaacgaggataaaccctgagagatccgttatgtttctacataaggagtgtacaagcttctcttgaaaatcattgcattgggagagacacagagaaataacagaggtgagaatccctccccgatttgcttgctaaatccgtattcattcctgaagatccagatcaaataccacctgactgttaggccttctctgagaaactctattttgcaggcaagtattggaacgactctatgcgcatctccagtcccaatgcatcctttaaataatctgtttcctctctgtttcttgctgcattacagacatctgtgttacacatccatccttccctaatagtcagtggactcttttaggtgaaggactgtgtctctatgtccctatgctgaaaggacaatgggaagagatggtgctattgatgcccagaggcctgggtcaccagggaagctggagtcacagcaggtttgttcagagggagtaaaccacaaaggaaatgtggctggtgatgatgatgatgcaaagaacggtgggggaaatctctggcctatgccttctactgaccctcttgccactcacaagtgtctcacaagcaccaaatccaacttggaatctagctgacatgggtcagccactgttgtagagcaagggtagggtgagggttgggtctgagggtaaacacatccacaatgtgggagcaggaagatgtctttgcaggggggtgtctaggactatggacttaagataacctcacagggtcaccatgccccagcatgacccagaagggcccagagcaaggaagacatgacaaaggagcctgaagacttgaggaggccttggagctgggacaaggaagacacatcagggatctacatggacaggaaactaaagatgaggtgggctctcagacatctcagggaatttgagctcagaagacaacactgagaagaccagacaccatagtgagtagactgtatctaactgctctccaccctcactttcatattgcatttggatggcactccaaggaaggggagaggagaccacctagcagaatggaggccaaatctgagttacctcatagataaggaaagaaggcctgtgatttttaatgggtcagtcactcttaaattttaagcaaactgtagattttctgaataggagaagatattatcttaatctacacaaattttttgttgtttttttggcagggtttaaaatatttttattcatgacttatagtagaaactacattttatattgtgacccagtaactgtttacacacatacatggatgtatgtgtgtgttctggaggtagaaagtaaccaatctgctcaaattttaaatattaagattattcataattctttaagtagtttattgtttggaaagttatagaccaaggtctagaaattcagcagacctctaacctctaatcaaggacttttaaaaattaagaacagtacctgattttctgatttagtctttgaaatgccagtgctattcattctttgccttattcactcataattatttattcattctccaaacatttattgagagcttactgtatgctttatactatagacctgcagcacaaatataggcctattacttcacagctgctttaggatttatagcagtactggtcagatagttcttaaaaaggaaaagttttcagagtgcaacaacctgttcacaataattcctatgtagcagtgaagagccttgacagcatctcttttactttctcattgtggttctagtttaataacataagtctatttttacttttcatatttaactttaattaaacatgctatgagtgcaatcatgagattttaataaattagactatttgaaaataattttcccataatgatgtcttcctcatatctttcatgatacacaaaaagaatatttgtacaaatattttgttgcttcaaatatgcagaaaactgaccattatttacagtgattttgaaaataaatgagtgaaagcatgcgaacttataaggagagtaaataagcagcacaccattaccatctgagacagcatggctgctcccctcttggtgagggcagtataggtacagcaagcagaagacagatcataagtatttactatcagaccttctttaagtgaatatgtcctattccagtagaaagtatcatataagcatacggcctgaatccaattcaattatttacatggctctaccagtaaatggttaacactgtagaccagaaatttagaaaatgcagaagactgaacgatatgtaagtgactgagaacatgagtctctctcctcatcatgtaggacatgggtcgaggtcatagacttaattggtaggagttgctactttcgaagagtgaaatgctttgaggcttttaagagaattttaagttgattaactttttatttgggggaattatgatgtgagctttattaaaatatcacaattcggcattgtttcataaacataattataggccaccttttcaaaaattgcaagagtagtactaagaaggtcctttgaactaaggttcaaaggaccttcttagtaactcttgtaatttttatgggtacagttagttgtctgcataaagtcattccattttccaaagctgcttactctttgcacaaatgacaaattggcacatgcacaatggcacaggaaaagaagtaactgctaaggtcacatatgtgaggacgttgcagcctttaagtactggaggccaaagttaccagaaacatgggcagacagattaaaattttcccttcttatgtttgtgcattgtttctatatggaaaattacatttttctgagagtatatgtgtaaatatgcatctgctagtgttttggcaactctaagttacctaaattagttttgatcaacactgtcggatttttaaacccaccaacgtaataaaagcaagtttaaaaaaacacaaacaaaccctacagtacattgtgtgctctgctgttccaagcctcagcttcaagacaaaaggagagcgagactttgtcattcgctagctgttaataatcaagagaagatctgccagacaagctcttcgagggctctgtctgtctggaccaggtatatactgcaatacacaaagggctttgcagggggagaaaaatgagtgttcatggacaatgatgcagctttcttaattaagattttcattactgatacatacattaagttctgcaactgcaagagccaaagcactgtcatgtgcaggtagatgtccctgattccatcttcaggcagtaaagctaaaacatattaaatgtgcacccagcaaatgttgtgggagccaggagagctccagaaatatttttgttggaatgcagagaggccccattataggcagatttgtaatgcatctaataggcaggagaaaagctcatatcaatagagtgtgtgtgtgtgtgtgtgtgcgcgtgcatgtgtgtgtgtgcgtgagtgcacgcacgcacgtgtatggaagtgctttgaggccctggaccacagacaaaggtaacagtagctgatctagaagtaatccccatataataatataatagctcaggtcttaaaaggaactttgatcttttaaatttgccaatgccgattgttgagacaggaaataaaggattgatttggtagcttttggaagatggtaaggactcctgcatacagccagtcctgactctgcccctcctgggtcactcagtctattttccctggatccgcatgctggtctgaaagtcaatgcagtctgccaaagtggtatactgttcccatgaaataatccaactgtggtatggagaaatctttttttcttagaccaagttatttttacaaaaatacttttgcgaagaaatgagaggaaactaaaaccctacacaatcctagaagtggattactgtctagagtgcatgttttttattccatcttataaagcctaactcattttagggtggctagtgcagttaaggtgcagacatctcttggttgtttttctggtgcttttacttgcatgctttcctgtttccaaatctgcatccatattgggggttacccacagagagctgttgtctcctctctgaagaacatctccatcttttggtcactacttgagtagagatgagtgatgcttaatgaaatatcattttattacaacggtcaaaaattatggattcatttcttattagattatatgctctgaatgttcaccaccccccaattcacatgttgaaacttaattgcccatgtgatagtattaagaggtggagtctttaggaagtgattaaatcatgaaggcagagccctcatgaatggatttgtgcccttatataaaaggtgtgaaggagctgtctctctcccttttcctcttccaccctttgccatatgaagatacagcaagaggtgcgatcttggaagcagagaggacttcaccagataccaaatttgcaggtgcctcaatcttgaatttcctagtctctgtaactatgaaaaataagtttctgttgtttataaattacccagtctcaggtattttgttatagcagcaaaaatggactaacacattaggtacaagcatttatttgacatttaaatgtaatccctcattttctaagaaggaataagccagaatccaacatcaaaatgtttcaaaaggaatacttcaaagtgttttagctgtagttctttgtcgattaaataaaaaaaaattccaaataatggtggtcagtaagagtgtgtgtgtgtgtgtgtggggggggggggcggtgtatgaattcctgtgctaagattcagatctttgaaactgttttctagaatgttatcctacatgtctaaaactttttttctaagtgtatcagagatttgggatggagtggtaaacacataggttactaggaggtggcttgcctctgtacccattctagatgagtaatgttaatgactgatgataatgtaatgatgaaaaaattggttctttttaagtaaatagatagtctacagacaccctgtcaacagatagtgcatgcttactgaggaagttaacagtgttaggattcttcctaacctttactgaaaggtactgttataaaactggtagaggagtatgtgaaagctactggtgaagaaccaatgcagtgaagattattcaagcatggtggtgatggataaaagcatagaaaaaaaactcagaaaattattttgactgaagacttttcattacttttcttatgtgtccttgagtagcttataaggactaggctgaaggctactattaaaagatttaggtgtacctttcactcatgttctttcatgagacacacggttctctcattcaaagtacaaggttaattttaaattagaggtgagaattattcttcatgtatcaaaaagcctagaaatttaccagggattaaaggtagaacccattttagcctatcgaagtgtgagaggtaaggtgacctgtttagatgaatatcttgaaatgattctctggagcatgcctgatctgttctcaatacccacacattagaagaaatgaagaataatatagagactacacaaagagaccatgtaaaagaagaaccctgataaaagaaaaaaaactcttaattttatcactgcaaagacttcttgtacaagatgcctctgcaagtgtcctagtagcatgactccttaaacaagtaggatgcgtgtatgtggaagatatatatatgtatatataacatttaaaatctccctcgaaccccagcttctgagtataaactatgttacagaagcatgtggataatatgtgaagctttctaggagcatcattaagaaaatgagacatttgacactctgagccctaggtacactgagtcagtggcatggtctccaagggcactgctggcagcactaaagcctggctcataaccatatgtgcacacctcaagaggtgtttgactgttcaggtagaggataagccatttcctaggcctggttccttccattctccttagcttgtagttggcctgaagggacttcctagactctaacatgtttgcctctcttttgcttcctttctggacactgtctaaggatttaaaacacacatgactttcatgtccacaattttctgccaaagagggggaaaaatgccccagagcatgtcatcccttaccatctgcaaatgaacttctgtggtcaaggaatgctccaattaccacccagaacagctttgtacaactcctgaccctcgggaagactcgaggaactcactcccagaacccagatgctccctgtcccagaacacagggaagacgccctgtcatcacagtttgcacggcagaggcggaggtgatgctgttagtgtggtatttccaattctctagcgtctttcactttccctgaagttgctgaagaatattccatttcattaagtatgtagtaatacacatgggaatcagagagcggggaaagatggaggacgttgatgacatggcctctagcactttatttatgagaacatccagaaatctctatctacatctgggagaagaataatgtcaatcctgccctggagacatggatcaggcaatgttgccagtgtgtatttttcccttcccaataatttactgattctggagtctaaggcagagcgctgatgataatttttacattcatgtgagtgagcctggccctttgagggctggtgatgccaaataaacataaatgtatgtaaccaggtgaatacttaccacctcccaacccagaaatgtcataggtctctggtggtgctttgcttcccacaacactcccctgaagggcggtgagggtaggtgttgccatcagagcataagaagcagagcttgaggtggccttggaggacttcagggagcactgcctttgcagtaaagaatgagactaagcaaacaaacctgttagacggctcatttgtcttttccaatttttttattgtgttattcatcctttcatcattgatttatagctattcttaaaatattagggatatatcacaaatatttttcctagtttaaaaaatgattttctaccatagtaatttttattttcatgtaataaaatttaaaatacatgtattttttaaaaagttttcaggctttggttttatgcctggaaaatgcatctcatacctccagtatgaaaatattcatgtatatggcaaaaattatcactgaaaattacagaattagtgaggatgcagagaaatgggcagtctctttttttgttggtgaagatattaaccaatgctagaggacagtttagtaatgcattttacttttgcagttccactataattaattgatcctaaggaaataatcatgtaagtgtacaaacatgtgtacatatgcatgtgcatataaagacagttattgtggcattgtttagtaagaagaaagttccaaattcccaactgtccatcaataagtgattgagtcaataaattatgcatatactgaagtgcaacgttgttgtcaaaagataatgtagatctatatttattaacatggtaaatgactattacaatgttaagtgaaaagaatagaatacaaaacagcaagtaacttctcctttcagtctggaaagagaaagacaaagagaaagaaaaagagaaagataaacaggactgtatggaaatataatatttcctaagttattaatagtgattatctctgggctgtgagatttcaaaggaatttaaccttgctctttataaatactatcaatgaaacaaattcaagcaaaactaaatgtatacttttttagaattaaaaattagaacttttattttgggggaaaaagaacttacctaaaacctgcaataaatacttaaaaattccaatatgatcttcagtcattagcaattactaactagctctcttagtagggtgacatcaatgtctgcctcaagtttcccccaagtttgacactttgagatgtacatcatagttcttcccttaaagaattttaaaatataaaatttcaagtagtgaatataacccaaatatttttatctagggcatggttaggtaaattctgggggctttatgtgatattattcagatgttatagtgctatttataaagagtttttaattataccaggaagtatttattatataatattgaattaaaatgggatacaactgtatacatgcaatgtatgctcaggcatgttaaaatctagagaagacactagaaggtgatctaaaaaattattaataatagttggttctgtgtagtggaattatggatgtttcccctttactctatactttctaaatatttcacaataagtgtgaattatagaatcataaaaaaagtaaatattaaaaaaaagctgttttgctcgacagctgccaaattttaccccagatgtatcagcaatttagcttttagtcaaatgaccctaacatcatttcctaaagggaatatcacagaatggaatgtgcccaaataaagataagccatcacggccaccacctctttctaagctatcattttataatgcttaaaataaatctgagtaagggatctttcttctgttggaagttataaacttccacctccttcagaccctctccatatcttctcttgcattaccagcacctggaatttataattaacctatagtaccctggtacgtttctaggtctggaagctgtttttggaggctgatggtgtagatcaccattagggatggaggattatttattcattttaaatgggagttcccttgaataacaaacagggatgagctgctatataagatcttgtgtagttaatatgctttcttacccttcttatatatatatttattgattgattgattttttgagatggagtctcacactgtcgcctgagctggtgtgcagtggtgcgatctcggcttgctgcaatccctgcctcctgggttcaagagattctcctgcctcatcctcccgagtagctaggattacaagcacccgccactatgcccggctaattttttgtatttttagtagagatggagtttcactgtgttggccaggctggtctcgaactcttgacctcgtgatctgcctgcctcggcctcccaaagtgttgggattacaggcgtgagatcccgtgcccggcccgcttccttcctcttctttccatccctcccttctttcttcccttgttccctctctcacctgtctacactcctgtctccagccctcttaaataaatagcttttctgtagtgttagatgccagctcttaacatttagagacaattcacactataccaataccatacttcaagtagatgatctaattgtttctaaatcatcatattttagcaaaaagataatgggagaaatcaaagttgtctctcacatatgtatgatgcatactagaggcttggcaataaggcagagagtagatattttttgagaaagtaaataacaaaacaaaacaaaaagccaaaacacaaaaacaaactgggtattgtgaggacagggcagagggaaggagcaggcataagaaagaaaaggaatgacatcggtctcctggtccttgcaaaggttattcaagtccctgttcctggtgttttggaccagatatcagcctacaaaccaccctggactgtgagctatttgaaggcatagatggtgtcttactcacctctgtattttctgtaccaaacacagtgcctgatacaatatactcaacagatgcctggagaatttaactaagccctttcactgccctttcttactggcctcagctagaaccaaaacaagaagctaaaactcctaatgccacaaatgctaggtgaaaccctatcctaattcaaactcatttcttctgattttgcaccttggtccccaaactgctggagaaaatcccatgacagagcagataggtatcaacatcaacccaccagactcacctgcaccttccacactgccaaggagagtcctactgtatttctctggtcaacttgctgtcccatttgtctcaagaacgatttcaaatctctactttccttaaatctcttccccgcttattcttagcaggaccttgcccctcagtgcccatcacttgggaaacctcttaacctttcagtaccaaatctacacgtgggcttgcatctgctcctttcctttactcctcctttcttacaaaaatagaagatgtgtccctccttccatctctccacttgtactcaggattccatctctctggccttatcagtaatcttatactgccagtcatcctatgctcttctctcttctgcacattggatctctcctctctacggtattcttcccatgaaaatacaaaaaatactagtgtttccatgcttttccaaccttcttttgacctcacttcccccctcaagatattgcagtagctcattttcctttccttcatagcaaaacttctgagtggcccacatttgctgtttcttcacttctcattctctcctcatcccattacaaacacgttattgttttgaccacttcaacaaaacagcttttgctgaggtcaacaataagctcaaaattaatataagcaatatatatttgttagtctttaacctacttgattgctcagtaacatgtcacatcactgaccactacctttgaggcactctcttggcttctgtgcctatgttttctgattttcctgccaccttcttggtggctccttctgagggtattttatggcctcatttttttctaccagcggattaaatattaagagctcttcaagtctcagtttaggtcttcttctcaatctaaccctgtccctaggcaatgttattcatgccaacagattcatttaccactatatgtcgattaccctgaattcatgtctccagccttcatgttacttctgaattccagttttatgtatataaatacctgtgcaatatgctcactatgtatctatccaaagtacctcacactcaacatctcaaaaacagaacttacaaacttctctccactccagtcctcctttggtgtttcatgtaactgtgaatggtattatccttcatatagtttgataagccccaaaccaggagtcattgttgccacttctctcttttatttcacataaccaaccatgaaaaagtccaggaatattttacttctgaattatctctcagttccatcaatttcctcccatttccactgtcaatactctagtctgcctcttatgtggtctactggaatagctccctcactggtttcctcatatccatttttgatccttccaaattatttaccaaagttaagctaccttgatatatatttttaaatttttaatttcaagataattttagattaacgtgcagttgtaagagataatacagagagatttgttattctttttacccagttttgcccaaatggtaacattttatataactgtagtacaatatcacaatcaggaaattaacattggtgcaatccatctgccttactcaggtttcatcagttttatatgcacatgagtatgtgagtgtatatttagttctgagcaattttattacatccatacactcatgaatactaccacagtcaagctacaggacagttccatcacaaaagatcccttgcgttatcctttatagcaacactcacctccatttctatcccaactccctaactttgtcatccacaagtatgttctcaatccttacatatttttttcatttcaagagtgctatatagataagaatcgtaacagtacatcatcttgagattagctttttcacccaatgtaatacccttgtgattaaaaccagttattgtatgcatcaataatttattctgcttagtgctgagaggtattccatggtatagatataacagtttgcttaaccactgacccactgaagaaaatgtgggttgtttccagttttgggctattacaaataaagctgctatgtacattggtgtaacataatgtacaggtgttgtacagttatgtttccatctctctgggataaatgccccaaagtttacccttttaaaaaacaacaatgatcatgccacagtccttcttaagtttgctcctctactgtccttaggataaacacaaaaatccttaacatggcctaccaaggacctgttatcatcaggccttacgtatctcttcaacctcaacctgggctgctagtcacctttttctctctgtgcagctctcttcagggacttcatgctgttccctctgcctggaatcctcttccaccatccatccttactttttgtttttaaccttcaggtgtcatctcaaatgttactatttcagagaagcttctcctgaatttccagactcagttaaatcttcttcttttatttgcccttagagcacatggtacttttattatatagtggtaagcacaatttgtaattacaagttatattgtgagaccatttgcttagtatctgtcttacattccccagattataagctccagaaggagagagactatgttaatattcctttattatatatacctttagtatttagtagacactcaactttgtgtccagtaaaatttggctgaggcttttaagacatagtcctggaatcaagttctatctctaccatttattagatgttcttataaaataaatcaaacatgttaaatctcagttttctgatctgcacaattaggattatagtagcatctacttaatagggtagttttgaaggttaaatcagatagccatgaaaagtatttagtccagtatctaaagcaaggcaagcactcaataggtatttcttattgttattattagttgaacaagaaactagagtttttgtattttttttcctaactaggcttttgtccattatcttcatttcttgcctgttcccccaggttctgattcttgtaacttttgagactctgaaaaggggcccttagtttagatcttggataaccagtaggactactggttcttaccccaggtatatgctctcagaccagatgtggctctggttcccattttcatctcactcagtacttcctcctcttgttttccagtctatggatgtcagtgtgggtaagaatgcctcttccctactcctagtttccagatgttttctaaacactgctttcctcttgtctcattccttataattccccatggaggcaaagtatcccattggtgggaaagcccttggtctatatttctcaggtaggtagaactgatctatccaaatttgtaagcacaggagtttaacctctttgtccttccttttctactgagactatcgggaggtgatgacctggaaagtgttgctcatatgcagatccacattttcctgtaagagagcttttgaaaggtttgactgaagggaagagagtcagcaaacccatttcctctttacactaagctatgctcttcaaccaacctttataaaaattttggttccctagctatcagttcttttgtcttatttttcaataggtttagaattcaagtggggaaaagtgatgctatttatgggccccctcgaagattccaacactttggtatatgattttgcttggaatatgattctgtttctcttcatcttttttacattttagccagttttcaagactcagctgaatcagttttacatgaaactttctagcctgcaaggctctttcatgaatgaaaccctatggtacttcctggactgtatcattccttttggaacttagtcatttattatcttatgtgcatacacaacgctcaacaatataactgtttttcctaactcaattttaaattccttaagagcaagaaagggtcatgtacttatggtatatttatgctttaactatccaataaaaattattctttgtacatagcatgtttttaataatatcttaaagcgtgaatgtgggggagagtggcctactgaccaggctttgatttgaaggcccaaggtacaacggaaatggcttagtagctggatggttcctgaagaggttgtcgcagtgcagtggtgaaagaaagaaaaggttactatgggcatgtccctgaggtgtgtatcagtgcaagtctgtgtatacacacacacacacacacacacacagtctctctctctcttacatatatatgtaaatagaacttaaatctgtcttgtgctgtgttttcgccttagtaatactttatttctcttattaaaaatacatggaactcaccatctgataggtagaaaggctaagagaaatgcaaccagagggaggtaatattcctggctatagtcgattggtgttcagagtgttttgattctctgaatgagtcaaaagattgaaaaaaaaatagccactcttatcactaggaaaagaaatgaggaggaagggtcctgaaaatggtgtctgagcaatgaaagacagtgaatattttaaagatcacaaaatttaatttattcaacctaaatgcataaaagtacaggtggggacattatttatgcaggtatatgcaaatcactttataaaataggcaaagcccttctgctttttataagttgccaaggtggttcctgatattttaaaagctatgcacctttaatgtaatttcctaagagttggaatccctctgtcgaaatcatagtcattgtcagagcaagttgatttttttttttcctatcctctgggacatttacaaggatcttataaccatcacaaaaagagtggtttccacagagatgtgactggaaaaatcccttggaaattgctgaggagcaagtcacagtgttcaaagcaaagaacataggctttgaaaacatgaacccatctgacctcttgaatttagtacagtgaattcctgagctctgaaacatggggcccggctgtgcatgccatattggtgctataagactggcagtaggttggctgtggcatggtctatttcaaactccttcacagtgcccagtgttgcatgttcccagatgacatttggttggcagaagctgggcttccaaagctggcagcctggaatgcagcccactgtgttttgacaaacacataattgaccatctgatcaccagcctacgttctgcactcaggtcactgggggacctgggctttcaataggtccctactcctcgtcttgttcatcttcccaaacctttctccagaaagcaatatagagaaggcttaaacacacccacgcatatcctcccatttgcaaaagagaacatagtacatgaaacataagctgttgaaaatttcctttaaattgtcctggcagcccaaagtgaacaagagaaaagcacacttatggtgaactctaattcagagagaaggaatgaatacactgaattgtttcaacacccggctgtgcataagttgcaattcagttcaatggtttggaaattttgcttagaaaaagggagcaatgagaaaatgataggaaattggggcattgattgactttaggggggcattatttagaaactgtttcattttcaggtgaaagaagagacaagcaggacactgggaatgtcttctccttatctgcctgctcctccctcacacccactatgggcagtaggaggcacgcgagcctggtgaccagggggcagtagctcaaagtgaggtcatattcaaattgaggtctttgctgaagatcccataaggatgtattttggtctgaaatttgactccacacaatgtttcagcctttctcctagaaggcaaagattatgcaataggccaagatatgctggaattacacaaaggttaatgtctatttcaacactaccaaatagcctctccctccatcctacccctactgcacagttcaggcctttggcttttacctttgacctggtctccctattctgagtcagcctctccactttcaccaagtgctctttctaaaacatacatctgcttacaattcttcaaagcctccttgagcctgcaggatcaagtccaaactcctctgcacggcatacaaggtcctccgtatggcaggcaaggtcccctgcctgctttccagcccaatctcatactactctttcaaccaccatgtttcaatcacactgaactattcactcctctgaatctcgctgctacttaacgcctcctgattttgtaaatgctcttacatttttcttgattatgatccccttttctttctgctctttcatatctacctggtaaactgcaatttactcttctgactttaagacccagcctggtcaccttaccacatccaagtgggcactcctccttcattcctcttactacgtcttgtatatacctgcatttcagtgcctatcatatgctatagtctttattcacttatgtatctcccctatcagactgagatttctaacaaaagaaagcatttcttatttatcccggagtttccagaaccaagcacagtgactagctttccataaatgtttgttgaatgaaaactaaataaagagctgtacatgataattaatcaaaacgaagccaagtagtagtgttagcttttataagcatagtaggagcccattagcaatctaatgaaggcagaagatcccagcagtaaggcactttctgatgggtatggcaggggctggtgactggctggggtgacagtaagagtgagggataaattctgtgatggaggaaggtctttttaacagagactgccactaaggctgtaaattaacacccttttcaagacttaatattcaatactgaaagatattgtcctgagaataaatctgaatctgaattgtatagagacctaacttataagaaccaagtttcccaaataaggtaagtctgtgctacctgcttcaaggtagcatggcagattatggagggttcctctttgtttctgctaaacagtaatggaatgggaaattcttgggggaacatctgagagctcttcagttcctattgaaatccaggtcaaatacagattgtgatactggactaaatgcactgctaagagaagatcgaacaagcagaattctgtacctgtttagaggaggccattgaagaggcacttggagtcaaagcactggggagataatgttctgatctgttctcaagggacattggacatttcttttccttttgtcgagcctctggggcaccactctggagccatcaaccatcaactgtgtctatgggatacttgaggacagtaggactgtcataagcccggtcaccctgctgatatgagggcagcttcaagatttggaacaagccaagcaaacatgaagcctggcccagggatggcacaaggtcatgggtatatgaacggattatctgctcattataggtcactcccccagccttatgtgtggttaaaaaataggatatctctagaagctatgcaactgatggctgatgtagcatagaatcagatttgcattttcctatgagccagagacagcctttcaactacactttttatctcaaaagtctcccccttgattcctaattggtgacacaggtcccctgtactgcttgtgtctgaggctcgccctatagcactgacgtcacaatagctgagccgtgcgggcaggagtgcactgtgctgactcatcccggtgatgtgaggattaatgccttgtctaacacagagctattatgtgaactgtttttacacaaaagaactgtaacaaaaatgatttgccagtcagaggactagaaatatgcagtgctaggtaactgaggggagggctgtgcagatataaagtggtaaccataagcatgcatattgacatcctccaaagcatttacagacccactctatcaacactgaaatagagaataacaagacttgtcagggacaggtaggacccacccctgttgtataaatgcattacacacagctccagtctttggggagtttaatcaatctcctttctctgtcaaataaactgtcacgttacactttagccttagcatcctttggaggattctgcctccctaaatatatttgccactatcttctaggaatgttagtggaaggcacgcataaacaaaatagccatgggaacctccattctgtgcaaatgattataatacaagaaataccttggagtgaagagtcagtgaagcaagatataatgttgtgaataaggaacagagctcaccagagagtgagaagcagccagaggataccgataattatttatcacattaggtgactatcactacctgtaggatcttttgggtggtgtctcttataagtgactttgattatttgggttcattggcctagaatctttttcaagcagttcaaaataaaatttatttaaacccattcagtgcagcctggtttgaattttaaataatgaacgttctcttttttttcatataaaatcgtgtttttttttccccccgaatacctttccatcttttctaaaaaagagtggtacctttataaaccttctggcacacgtgaatctgggatttctttttttcccctgtagacttcataattttgcacaaaagtttagtctatttattttacagtcttgtacttcttagtaaagggatattagaaattttgtcaataaatgaaagctctgatctagaagttaaaattaaaaactattggacctagggatgggtacataactgaagaatacataattgcccaatgattgacaggggagcaaaagcccaactgttgctggtatttggctgaataatgtaagctatactttaaaagagcagtgacttttgcaaacagcagctgcagccaagtaaagggcagcctttatagaagtacagtatctgggccactggtattttctgcaccctcatggatagcaacttagtattaccaccaacagcatacactccaaacgcaaaagaaactaatacacactacagaagcactagaaaccacaacaaagtcaactaggaaatatgccagtgaaaaccacaatttcctaaatctgacacttttttttttaaaggtaaagaaatcacttttacttacgtaaagagaaggggcaggtcacagactgatggtcaaagatctgaaaatcaaagaaaaaataaggaattaaaagcaaaccgatatatgatgcaaaaccaatatataaaagcaaaatgatacagtgggaagaaagaaagcaaatctaggcatagatgggactggttgttcctaaaggagcctattttgtcacttctagcctcaaaataaaggagacccagcttcataaaaactttctaaaggtatgaccccctgctatgatgaccaagacagtacttcccagcacaaggagtgcaaagacctttctttgttcatttcattctaatctgtatcatataggatttggtagagctatgttaccatttaacaaaatagccactagccacatttgtctatttaaatttaaattatttaacatttaataaaaagctaaacatttagttcctcagtcttgccagcttcatttcaagtgctcaatacccacatgtggctggtgactgccttactggatagcacagatagaaaatgtttctattattgtagaaacttctattgggcagcactgactagaataggtaaaagctttactatacagtacatgaccaattttagctaattttgacaaagatgagtcaaaccctgataaactttgtctcttttaaggtatatttagtatgtttaatgtccagaagttcctctgaacaaattcaatacattcgtgtgtagctaagaactcagtcctaagtttgccccggacttgccttctaaaactgcctctaccccttctcaccagcctagaatgtcccctctatggtggaaaataatctgataaagtgattttaaacaaagcttctctcccaccaaacacaactctgtttggtgatgaaaatttcagatgaaatgatgaaaattttagattttggagaagctgaccctaacagtgttcttgttctatgtttaaaatctgatatttcactctttaaattacaagccaggctaggcgcggtggctcacgcctgtaaatcccagcactttgggaggccaaggtgggtggatcacttgaggtcaggagttcgagaccagcctggccaaaatggtggaaccctgtttctactaaaactacaaaaattagccaggcatggtggcgggcgcctgtaatcccagctacttgggaggccgaggcaggagaattgcttgaacctgggaggcggaggttgcagtgagcccacatcacgccactgcactccagcctgggtgacaagagcaaaactccgtcaaaaaaaaaaaaatcacaggccaaaaaaaaaaaaaactattataggactggtctgcccatcattgtgctttgtttttttttctttcttttttttttttttttgagatgaactctccctctgtcacccaggctggagtgcagtggcacgatcttggctcactgcaacctctgcctcctgagtttaagcgattctcctgcttcagcctcctgagtagctgggactacaggcacgcaccaccacacccagctaatttttgtagttttagtagaaatggggtttgccatattggccaggctggtctcaaactcctgaactcaggtgatccacccaccttggcctcccaaagtgctggaattacaagtgtgagccaccgtgcccagacccatcagtgttttgatagcttctcttagaaggataaaactgaagtaggaggagagccatgacaaattaataaaccaaaaaaagatactgagaaaacaaagcaggtccccctacctctagcccacttaaatatatcaagaatttaatacagggtgattcaatcttgcctctctgacaccatgattttaacaacttcacataaggcctccagaaatatgcaaaacaaacttcactaaaggagatcaagtagaaggacctgattaagtatctttgcattgaaaaggctaaagcagaaaaccagcaattaaagacatcacccttcctggaaagtttctgggacaactgcactattgtagagatttcttcaaagaaatgatttccctttgtggtcaatgtgaaaccttgctcaagtacatgcaggtgtacttgatgcaggatggtgacaagacgagttaagatgaaaatctccagcctggattattataatgctaatacaagagaggctggagatctccaatgctttcaaattgtttcacaaaattcatgagtttaatgaaaattttaggcaagagaattagattatgtatgattcattgaaagcacatacaaatttgaaatatatatataacactgactagtcttcaaagattttaaagctctaagttttgctatattctagtcttctctgcaagccaggatattagactatggcacaggggcatattttcttaccattttcctccctccctctctcctttcttccttccctccctccctccctcctttcttacattcctctctctctatttctctttctttctttccctctccttttttgaacttgctgtcttctctaaccttggggagaagaagaaaatattattagcaattttctatgaaatatgttcaatgatcatttttctgttgcatgttataaacccaataactctcaacaatattatgctcttctaaaattatacctagtgtttatgttcttatatctaaacacataactttcttttctaaatttcaaggtgcatttattcataaaattagttaaaattaaatttttgatgtgatcaaaagagatcaatgtaagttgtacccaaattgactaacacatccaatgtctggaatgaaaaactatctttcctggatgtcaaatgacacacaggatggctgtcaatgataggaatccaaaatggagagaaaaattacagtgtgtatgtcacagtctaaaacaaattaaagccaagttagatggaagttttattggatataattgttgtacttatatgttaatataaaatgataatatgatcccaaacttaatagtatggctaaaaatttaatctcagagttcttacacaattcataaatgttcataggcatcaaaagacacctacttcttgactgaattataatctgctatgtaattctgagaatatgtattaatctacatagatttatatttgctcaattcaaattgttatttcattgatacatgctctttccacctaagtgatattcaccttatatgtctataagttgtttttatctgaaatgcaaagaattatctataaaagtttcacagaggattaaaaacatttgcattaagcacactttgttcaaagcataaatatatctagcaaagagtataaaactgtaaagcccaagtaattcaggacgttaaaatatcagggtggaaggtgggggatgagcagagagagggggatgacgaggggtgaagtttaatcttcgtattataatgtctgagtggaaattattatatagtgtcaatctccaagaatcaaaaatattattaattataactttaaagtcaattctagtgtagtttatgtaaagttctacagcagtggttttcaacattttgaagtgataccgatccctatgagaatctctttctccagaaaactcctcaaaaacaccaagtttcaaggaactcctagactccatgaaggccattcatgaatcccaggttaggaacccctggcctaggcagacaggggagaaaaaccctctttcaatcccatagctactcacctctacagagttttcatgaaatgctataaactaaagccagcagcaaagaaaatgtataaaaaagagttctaagtgggtaagggtatgtggttagagccacacaggcttctttgaaggcctgccagactcctaccttcctagtcctttataatttcttttttaaaaaaatctacaaagccttagcaacaatggagtagaggagtaccgagcagagagatgataatgatataagaatcactatctactgagtccttcaggtaccttgagaaataaatccttcccaaatttggatatgagtatacccaggaatgtgagcagtgtaacgggagtagaaaaagccacaaaataaatagtaaatacatggctgtcttcctggagggtcagtattccttgtgggcaagtaatttaaagtcttatttgcacacgtgttcatttatccaataactacttcttcaatgttataccaaaaagaaaacagatactgttcttgtcctcatggaacttccggttgagtgaaacaaacaagaatatattgaggagctgaaaggaaaatctgtgtatatattttttgggtgaaacctgagacttcactgaaaagtcttgtttgtggcagactacttcaagcaatgtcctggcaggcacccttagtattggatcactcactctaacttgaggatcacccaagtggaagagtttgagaagcatggttagcagtgtatcatttaatccccactacaagagaaaatactgttacttccaatttactagagaaaaaagagaaatttgagaaattaggaaacagctcagatcataccgctgctggcgtctgaataagtgtgtgccattccaaaatctacatatttttaaccactaaattacactacctttaggagtttcccactttatgtttccccttgaatctgggctcattcaggattacgcaggctagtttaagcttctctttggaagcagacaggtttggcttgatttgcattctaaatatttcacagtggtaagcgaaagctattattatacccattttatggtgaggaagctgaaccacttgccagctgaggtatctggctgggttaaaaacagaatctgggtcgtcagactctcattcctcttgactaactccaagcctaggcactattactgtccatgggcttttctgaacatgagattcacactgggtgataaagagtgagacaaattctgctaagagaaaacaataatagtgcaattgaaaaaaagggaaaataagtaatcataactcacaccaaaattggttactttcagcattgtgaatagaaaagggagagattattcatcacaaatgagtcagaaaattagaatgtgtcactgcactgatgacagagctgaggaatttggatgaactgaagtttgacacttatccttctagctgaagagggtaaatggtgtgacaacaggacagaaatgacctcttatttccaatcttaattaatatttccaatcttttttccttaactactctgtctaaaagttagatgggtttatatgtttgttttctatcggtagagataatgttttaacatccctttaacgttctagaagtattgcgttaattaattcttatgtgggagtcattccaaatagtaggatgatgatttttaccttattgattttcctaatacctttctggtttccagtgttttcaaaggatgaggcactattagatttttagatttatatgtctctcaaaattaagtgcctgtcaactgatattccatctttactctggatacatgatttcctttatctgacagattcaaaaaaatttgtactagatttaatgacatttcatgcatcttgaatttgggagtttttaattctctattttctatttggcaaaaggtttacaggagaaagccagatgcaagggtatttatatgtgcatacagaacctgtgccatcactctctaggtactttggggtttcctgcaggacagattcttgatgtattttcattccttttggtcaggaagaagaagactataaatgccacaaatggtcatacatatcttggggtctgctttccaaaacgcatattattttggatccgtctcaagaagaacaataagagaatgatactgagatctttttttcttaagatgctatgataacaatcctaaaaaatggcctgccttcaaaattttgatgatgaaataaggttataatcaataaagagagaagattttaaagttcagcaattaggtctgggactgcttctgcgcctgagacattgccaagatacaatgtaacactccatcccaccccatatgaatctccctgttccttcttgattcttacggggatagggtctgacagactagaatgaaatgaaagcagtagtgctgggaggggtggcaaggaccgaatttgtttaatacatttaggatggttttttattgctgctaaactagacacaattccttagcatgatgacattcaggaatcctttacaatctgattccaaagaactttctcttctatatcttaaactactgaaattgtagctctataaattccaaagggattgatgtaccaggacctttgacttatagtaaactgatcttaagggatgctgaaaaggtttggcactgctatcatgtggtctaatcatttagacttgtcactaccaactatttgcttaagagcctccaagacctttcacaatctggccccggcccacctctctacttttaataaaaaattttcccactgctgcttctttatatacggtgacagcctatttgctcttccctgaacatggcctgggacatctatgtctctgagtcagctaacggttcacacttgaatctcccaagcctagcatagtgtgtgaaacacagcacgacactccaatgtttgttgaataaatgctgtccgtctattttaggagacagagatgacagaagaaagttgttaaatcagtaaataaatagcaccagagagaggtcaaggaaaagttaattttagtgcattttaggagtgggggcaagatgagcttgaagattaggaaaactgatgctctttattcttgggtctagccaatgctatgagtcagttactttttcgggaacaagtttaaacctcaaggttaaatgaacacaaatgccctgtccatcagcatataatgaaaaagttgtggctatttccacatcagcacagtgaaattaaaatatgcagtgcctctctaagaggcatcacatatgacagagcttttaaaaatagtcccctttgccactcaggtatagaaagagctatagaaacaaaagcaaatgtttgaaaaactgagataatttagcttagggaagaaagagctgaggtgtgtctttatggttttttgactataagaaaagttgttacaaagaggataatgatcagcatttttgtcctagggcaaaatgacattaaaccgtccagtgcagaatttaagacttaaagatgaacattctaaatatgcaagtggtaaataatcaaatagattgctaagagcagttctgaaatttctttcttcctgactctcttaaaataggaaaaatcttcatctattttggataaaataaatgcagctctgcctccagtcaggagaatgaattcaataacttttctagtcttgtttaactctgtatgattctataaaattctataaaatgttcaccctaaaaattatacagaatcacaatacagttgagtaaaatacattctacagtttaaaaagaaataagcaatacagatagttgataagttattacattcaaaatagtaatatatggtgctcacgttttttattcaatttgccaagtgcatataacacaaataaaattgggaaaaatgtacttgaatctactaaggctttaacatagcgattatctagagtaaaacagtctaacaattaattctttcatgtctaagaaatttgctgaatatttcataaacctcatattgaatatgtatataaactcaatttccaattaaagaaaaagttttttgaaggtccagaaagtaatatatgaactcactattattatttcctggaccatcttcaaagacaacaggagaaccactaaacaattcctttaaatgaccaaaatgtgccccatatgattaagaatgtaaatctaataacagactcacagataaggtctaacaggggtggcaagttactggctttctttgtctatttaccttttagctttggagctcagcagaagtgtccattacatacagcacagggttagatgaacagctccaatgaccttgtctgaaccaaattcatttaaagcagtttgccacttttcttaaatagaagatgagtccattctatctatggcccagatttggactggatcactgaactattgcccaactcttataagcaaagcactaacatgtaccaatcaacaggcgaaggcatcaggaaggtaaaaatacacatacataagaaactggcagtagattaaagaagaaagctatatctaaagatggactttggcttttaaagcctttgagtgttattcgaatcttgttaacaaaaacaaaaacaaaatctgcattccaatgtaacttgtagagaagatccagtaaaaaaatgaattcaagagagagagagaaagaaatgtagttttattttgcaacccattatttccataagaacatgaatcaaagagtcagctatgccaatttcttcatagctgactagttataggatattgttctagtcttcactaatgacttcttgaggttggttattactgtgatcaggagttgggaggatagaggtctaagacctttcaaaagaaacgttttgtttagtatcactacagaaaataaagtcagcattaagctaactttgacaacctaactaggataatggttggtgcatgtagccattgcttatgctgcttcataatgaatggaacagtaaaggtgtcaagttaaccagcaacttgaattttgaaaagctgtggcacaataagctgataacataggttgttagaattagcaaaacttactttctgcttcccccaccttctagtcctacttatttccacatccacattcctatcaccaggcagttaaagaaacagaaacaaatgcggctgagactgcttctttggggatactcttagtgagctctccatctccccaaccacaacttgctctcagtttgctaaaaatatattcatttaattgttttaatgcctctacttaggggaatttgcattttcttaactgttgatacaagatctacattcagtttttttcacaggtaataagcaaagtatttggggagtgtgtgtgtgtgtggtggtggtggtggtggtggtggtggtggcaaattccgtcctagatgcttcgagttttccaagtatactgctaaaaggggtcatttgcttccccacctcaagaagccaattgtgcttatagttttacttcaaataaagatatatacctataaatgcacacatcatacgtgcacacacacatattcttcttctcaaaagtcataaacatttggtgactctctgtatactccatgaagtgctgttactactaaagtcagagtaatttaggcagaaacataagaaaccccaaatggtttgcactgaaattttattaacatatttgtcagtgttttcctcatggataatctccattggttcctggctccttgtcagcatatgctccaggagcctctcacaatatctttctgccctagaaatcctggcctgtgagatttccttgtaaatatctgaattcttgtattcacctattaatgatccagggatcgaggatgttttctatctgctccttaacctcccacttcaaggattagattgtaaacaacctagtgggaacccttcaggccaaaccacagctgaacgaatctcagcaggcagggaacccgcagcagtctgtgaaataccgtgaaacacaattacgaaaatataaagtattcacccatactttggggaagaaattatgttgtttccaagatgagacctcaaaaataaggctagtatcctaattgagaaagacatgattttaaaaagtgtcagcagaggtaaatttttaaaagtaccagatttgccaggtccttctcaaaccatagattcattttcagtatatgacagtggcctgagccgacacttcaagggaagtccattcatctctgaccaatgaagcccaaagtactcactgcatgaaagggttcctttcttgtttccaaaggcaatcaatttttgtcctagagtctgaaggttcatgggctttcttttaattttgtcagtctgcacatgcatggttcctcctgcatgatttggtctggaggaagtgacccacccacaacgccacagagctaattaaccccacactgagcttttttttttttctcatttcacacatccactcaatgctttaaatgacccagcagcagcatgatcatatgatttcttccccctcagtgaggaaagcatggtgatgggaggagcagggatatatctgccctaatcaaaacagcagtgtgatcctaaaatattatctaattgcattgcatccgagggtgcaaaatactaagaaatccctgaacgaatctctttcatgtcattcatttaacttcttgcagtgtccatttgaagtagcaaataatacataagaaacactgaggtagagaagtttgatctatactcagaatgtttaaaaaacatccgatcttacagggggtaaaagaccgagagctccttccctatcccgaatagcttcaagagaagggccttttttccatttgaaggaacagactcatgtttttccagatttattttttccaaagggaatgccttgaaaactctaagatgatcactgttttctaacttttcaaaaaagaaaaaaaaaagtgaacatgatggtggtgggtgatttaatggaatcagcttgtcaacatgatgaaactgaaaaaagcttttatagactctgtccacatgctaaaaaaaaaaaaaaaaggcaacctttaaagttatgtgtatagtatagagtggtttttgtcatggcaaagaaaagaaatataattatcttatgcagtaaatgtaaggctctgctaagaatctcattggataaatcatagaaatacatcctggccagataaatggagccagacaagttctaggtcttgtaagaagctttcaaaagaatcatcatattgtaagtctgtcatctctgtaagtgacaagaaaaattctaggctatttccctcggttctactagtaacatggcttcagagttttaaagatttagacttaaatggacaagaaaatgacttctgaatatcccatcttaggcaaactatcggatttctctcattcttacaagtaagtgtagcaaattggttcaccttggaaggacttggttagagatcatatatgtcttatgtgaacttttaacctctctttcctttgcaaagtgatttatgcatacactattaaatacacaggaattctataattcttagttcagtgaacagttagtacaagggaaaatctatctaatattttaaatttttgtttagtgtcttaaatcctacactttagaactggagaccttatagataagttctataaggtcttcagtgtgctgaaaaacacatttgctactgctccctaagcttctcttaggtaaggctgccaactggggtaaattgatggataaaactagctcaataggcaaaaaacaaaggtccagtgaagcacagtttatttttatttatactggtcagaaatatcacagttaacaaatagcctaaatcaagctcttatatctagggctccagcctttggctgaagtgtctcatctggtaattctgaaaaaaatagggttgttgtgatttcaaagactctcctgcccagtagactttttcaggctcactgatgcttaggattctaaagcctttactatggtctgttagaccaatacagtatgtcccttactatttctctgacttcatctcctaacattttcatgcaaaattggtccaacagacaataaaatagacagggataggaatatgaatggggactaaaaggaactaattaataaaaattagttgctttatgtccttgttaaatatcaactctttcatgacagcctaataaagtttctgaacttatcttgagagttggttaagataggggagaatatacaaagtatttccaacaccatgcattcattcattaattcaacaaatagttttcccgagtctattattgattactctgccaactggattctacttctgccctcaaggaccttccactctaatgtatgttttggagagtttctgtctctattatcactgacaggttattagcccactttagacaagttataaatataaccacctgccatgatgattcctcttcttgttctttatttgtttttattcatttgccctgtaacatccattaacctttcatgaatgacctgatcctttgtgagctatactatcaacacagctaatttttatataaatgagaaaccccttctccactcccaactaacttttctttctcaaacagccatgaaaatataaaagtctacccagaattatttaagtttttgaaatgagtccttacaatctgatctgaagcaccatttttttcctttcttttttgaaagagggaatggagcctcagcccctaagatacatatctcaagttacaggcaaattacacacaagttactggtctcccagacgtagtactcactactctctggggtagaacaatttctgcattgaacagaggaccataatctagctcaagtaatctcaatctcagagaacagttaaccaagtgcatatttctggtccctatattctcttataaggagttaccctctccactatattttggtattttctgaacctggctaccttaggtaaatgacagtggacatggtaaaaagaacactaactcttcctcaatttgttaaacttgtttttcctcctcatatgctttataaacaaaaatgggagaatttaatgtatgtatagagcagcaaatgttctctctgttgctttcagacatttttatcttatataaacagtggtgatgaaattataaataccattattccacctctatgttaatactcttattatcttgcatcaacagacgtgaacaaatacgtacatgacaccaatcaatcccttttctaaaaatgcagtttttgtatttctaaacagtggaggaagaattttatgaattcaacatgtagtttacctatttatattttgaattttaataaagtaaaaccaaattatcgcttatgttctttcacacttacatcagccattaacactctccatgctggcatggggtagggggtgtgtagaactaatggcaatgggtccaagtcccctgggtcaggtggttaggggcttggcaggctggagaggatgtttagatgctggggcaggatatttcaacctgcttgacaggtaagagatattttctggcagtaagaggaatattttttatggaacaaattgctagggagaggtcattttggggcactaggtgagagaaatatcaaaaccaaacctaaaagcagtctaagggaactcgggaaaagaaaatcactactttttcaatctcctcactggtttcccttattccatagtgtgccttctccttccatcttctagcacttcatactcttttctcctccatttcttcaggttttctttctcctacctctttattataacaaaaaaaagcatttaggaagaattctaggagacagggagacaaaaaaaaaaaagaatttagagaagacataataacatactgcataaatatgtatgtatgtatgtatgtgtttatgtatgtgtatatgtatgtatatataacagatattcgatttaccaagaaggataaactgggacttttgagatttaaaaaattcatggtatgtctggtcatattaatctccaaaccagcttgtttttagcattgctagagctataacagaatcaggagtagaaaacaaaaggaaaaaaataaaatttaacaaaggatttatatttgcaaaggaaagaggacttatttagagttgtttattgaaattcccccaaagctattttttgaacttatatattgacaacatcaagagaaggagcttaggaattctcatagggtttaggaactactaaaccttgtatattatgttcatctcagtccactcaagcaagtaaaggataactagaggatggtatctcacagtgcataacatggttggttactttgctaggctgacatatggagacagggcccataggagcagagcttttcttacgaataccagagagagacacccaggttcatctaaatgtatagggcatgagggattagtggtacagtgttatctgcaaagtacctaaaagtgttttctaaacaagcactaacttcttagcccagtcttcttggggattaaacaaaatccaatagtaagtaatggggaatactttatttggtcactgggttggggagggttgctgagacatatgacaacattcaatccattaagataggaggaaatgaggagaaagagaaaacaaagaaagggagagcgagggccagaaaagaagagtgtcacctctgtagactctctaacagaataaatcgataatcttaagaaaagtaaaagagcatgcctagagggaaacctcagcacacttttggaatccaaggcaaaaaataaaacaatttgcttcttgtcaagtttattgccattgacccatgggaggttcctatttattctgctcttacatgcacaggtatttcttctactcttacattcttttcctaaggattagcattctgtgataatggtggtaatgacagctgccttaaattagtggcaagttaggaatgaaacactgaccaccaggctatgttcttgaatccagtctatgccctgtaatgtgttcattctactttctgcattttctctgagacctgtcgcataagacttgttttgtaaggccgggctccttacggggacacatatggctccagaaaacaagtactctactttctcaccctgactttttggttttcttgttttttcctcttttctcccagactattattttccagtttcttctctaccagtctggacgcccatggttgttaactttagagatacccaccagctccatcaattccctcatctacagttctcaactgtatttacctagttctggagctcagatgaacccacatgtatgttctcctcagcttccaggctgctgatccttgctggagaaaaagcacaaaactgtacagcttgatgctcctgcagaattacggtttccagcataagttcgaatttcagaattagtttgcaattttaaaatttgctcctagtcagtttcctttttcactccacagtttcattcattactctatttaactggttataacccatcccctacccttcactctcagctagtaaccttgcctccttttgcatagagaaaacagaggccatcaaatggcacttcctatcactccacctttgccaccaatgaatccgcctgtaacatttcagagatctttctgcctagcactgataacctcatccaggatcttattatatcagttacttttcctttcttttgtattttcaattttcctactgcctgccaacatgctttagctgtcttcatttaaggtaacaacaataacaatgataataaactaacaaacaacaaaccatcttttgcagactttatctttccctcttttgtgccaccttcaagcttcctaagctcccgtttattcctcaaaccattacaatctggtttctctagctgtgtttctaattaaacaatttttttttttttttttgccaaagtcaccaaacacttctgaattgttagcttccaaaatccattcttcaacctcattgttttctttcttttaaaggtcaggttcactgaggtataatttacatacaataaaattcatccttgctatactcatttaccattcaataagttttgccttatatgttggaggcctgtaaaatgaagcccaacccccaagccgctttgcttcatatacaaatccctttggcacctctcagcagtcttccccacataacccattgtctggtgacaccacactactcagcattcaaggatatatgccatgtacattcatgccccttgtactttctttatgtttcctctctataaacatatatgtcttggtataacacagtaaatgctatttaatattaccacatcaatttccatatagaatcataaatctatacgttattttgagaagctgaggttttccaaatagaagtcatccatcaaaatgctactacctgaagatctctattattttagtattatgggttgattatgttcccttaaaattcatatgttgacattctggcccccaattctttagaatatgaatagatgtgtgaatagggtcattgaagatgtgattaagatgaggtcatgctgtagagtgggcctgcaatccaatatgactagtgtacttataaaaaagagaaacttaaacacagacatgcacacagggagaacatcatgtgacgatgacggcagagattggggctgatgcttctataagccaaggaacaccaaagattgccaggaaaccaccagaagctgggtgggagtcacggaactcacagccttagaaggagccgaccctgttgatactttaatcttgaacatctagcttctataactgtgagacaaaaaatttctgttgtttaagccactcagtttgtggtagttcgttacaaagccccagaaaactgatatactcagtaaaagaaaaaatcttcagtatattggaatcagttctttcactcatcaggtacttactgagtgcctactatgtgctaggaactgctctaggatattgaatgaatgactaagaacttcatcacgttactgcattttttgttcactaataagtaatcaatctatcaatcaatatattaatagatgaaatgcctatcatttattttatcagcaaacatttgttgagtatctcctatgtgtcagacatcgttctaggcacagaggataacattattggcagatcaagttctccaccttgtatagtttaaattccagtagagggaacatatattaaacaagaaaataagtaaataagatatgtaattttactctgtttctgacactgagagtcataggcatttatcctctaaatcactgaacaaagcttggaactagatagcgaacatgttacttcacagtttacaaagtaataaggaagacaatgaggtctcatactagaggcacgttaaaccacaggcagtgtgcaggcttaaagtgtttgggaaggacatcccaaaagctaggtttcttagtcagttcgtcagtcaatcaacacatatttcttttttttttttttgaccaaatttctctctgttgcccaggctgaagtgctgtgacacgatctcggctcactgcaccctctgcctcccgggttcaagcaattctctgcctcagcctccctagtagctgggattacaggcacctgctaccatgcccggctaatttttgtatttttagtagagatgggatttcaccatcttggccaggttggtcttgaattcctgacctcatgatccacccgcctcggcctcccaaagtgctaggattacaggtgtgagccactgcacccagccatttgacatgtattttttaagcgcttactgtataccaggccctatgctgaagatagtagaactgtggacagagccaacatggtactattacccactgagctcacattctaaggggaaaaatttgaacaacaaatctcacagtccgttctttatcatatatcctcataagaatacataaagggggttaggagatcacctgggtcagaggactggcccatgaggggtttccaaggggccttccttgaagatgtggtgcccggacactgctttagggctggggtatgggtattggtttgagcagggtcatgaagttttcggtttcttcttcctcatcccctttcaaccatgtacacacatttcaaatacttaaaagcattcttcaaatatactaagaacaccaagaactaaacacaagagaaggactctccagaggaaaggggccaaaaatagaagagaaaaaaaacccctaatctcaccatttgttttgaaaacacccaaaatgattaaaacatattataaactaaaacatatgaactaatcacttgccaagtttcatttttaaatcaaagccgttttgaggttcataaactgaaaaaagaatcttcaaatatgaacttgtgtttttcttttcttggccctcagttggcttgaagcatttgctgttatgctgtgtggagggaaggggaacctgctagttaggaacatgtggcatgcatgtactagaaggtaagctccacaagatcatgactcttcacagtggtatccctggtaagtagaagagtgcctgaaagataacaggggctcaataaatacctgctgaatgatcaactagtgaatattctgggccctttaagggattctccaactctcttttcttacccaagctgcatcttgctttaggccagtggttctcaacctggggctaatttttgcccccagtcaggggatatctgtattttttgttgtcacagttagagaagttcctactggcatttagagggtagatgccagggacgctgctaaacatcttacagtgcacaggacagccctgttccacagagatttatctggccccaaaggttaatagggccaaagttatgaaactctgatttatgccctttgtttctattgggctgtacctgggagtcagatcctctgcatatttggaatgaagttcagtcctaaaggaagcaccccagaaaagcctcattgcttcatcctcattcccttcaagacctaatagaactgcccccactctaaggcaggctcagagagagccaattttgccttttgtcctccctgggtcaacaatgcaattgctagggaaatcatctgaaaaagtctgtctctacaatgcaagtaaataatttttacagtacattggtaatttccctgagcttacctaagcatatatactaatttagtaaaattctcttgtttacaaactagtcatgtatctgcaggaaaaaaaaatctcctcaagttcaaccagtttatccatgtctgctcaggatcagtacatgactctagctttattcatgataaataagatcaacttcaagaattccatcaaaccccagtaatgtgcctttagagagactgggcttatagcatttcctctgccaccctccttgccctgcatattaaaatacaggtatctgattccagtttcaatggggaaacttctgtcgtgccagaggagggcatgcgctgatttccccactctgatggttgctctagtaatcttggtgttgtggcatgtttcccagttaccatagagactgcatacactaagactgcagcattgtgattggtgggaaagatacattttgcagaagcttttctggagagataaaggtaagacacgagaaagaaagtgagactgccaataaaggggcagagcacagagaagtcccaaacaaccatacattctagaaaactgggacagcagagattacaactactgctataaaactacataaactgttcactcaatggctgcctgtcaggaaaatttcaagtattgtcagacagaacagacacaagatattctagaataaaaaggtaaacaagtaaacctactgaggttataggggtgacaaaagggaaatggcaagaaaacatttaaaaatgattcaatgctagaaaaaaaaaagaatctcagagagcaataaaatttaaagttacatttaactttaaatgtaggctgacctttggggaattatttaaattctgagtacctctgcttccttccctatgaaaaagaaaaagaaaaaaagaataaagatggaaatagaaagaataaagatgacttctctctcactgtttaacaggagtctctttaaatatctcaataatttgacattatatcagttgaatatgatgtaccccccacacaaaaatcagacaaaaacacttaaagggggtgataaatagggggacgtcattaacaatgcaaattgactcattccatagtttcttagagtaatgagtcaactgactacgtgatctcatgtacataattttgttcggcatgagattttgaggtatacaattactacagaaatcaaggtatacctgcaatgtaaagggtaaatcgtaggcattttaaatgaaagctggggataggatgtgtgttggtttgagggatgagtgggagtggatttaagagaaaatcagtctaggaaaatatcacataagtgtttgtaagttccttgatattcaggtctgtatcttgtaatgctttattaaacatatttcagactaatatgtccattgcctactggacattcatatctccctgtttttaaatacctttcaaatctgtatcttgagccattacttatctcttgacctctaaccctttatatcaaatgaattactagacaattacaattagatattccaaaagcatcctaaattcaacatgtcaaagctgaactcatcttttccttcaaactttctcttcctcctatgttccctatgtgagtaaatattaatagtattaccattcacccatctgccaaagttccatacctaggaagaatcatggttgcttttatctcaccttcaaataatcacccgtgcatatagatgtgcaatcctaataaccaaaggaggccttttttgaatagaaagcaatatttacagttaattgggttttgaactaatattaatttattaaacttacaaattttaaaagcctagttttctttacacctttacctgttaaaaacacacatatatttttctatgtcttaatatagcaatttttgcataaaataagaaaaattactttcaggaagggtgagattactagacaaaaaaatttgggacctcaaactatttcaactgtcagtcagaatgttaaaagaatgagagttagggtctgatctgggaacacctttcaaatgattttgccaaggtcaccagtagacacactgaatgtttttatagtcactctgaaaatgagaaattttacgtctataccctacaaaggaaaatttacaatccaggtcctctatgtttaagtttcattcttatctaactcttttataatcactttccactttatagcctgataaaggtagacaatattttgtgtctccactaaccaggtttcttgaatctagtgccctttcacttcataacgtttttcacatttctacctctctcatccccattgcaccacattagctcagagcatcattatctgtcacttgtaatattgcgacagtacattgtactatattttcttaagtttctgagtctttgcacatgtcaccacctgtgtctagaacacccatattccctgataaacatttactgaatgaaaaaaaagttaataaatgctttggatgttgctgctttgggtgctgaacagaaatagtggcctatctaagattctggataagcctgcataaagcactcttactttcaaaattaattttgaagaataagaaaattttgccatggagaatcatggagcctatgccacaatattatgttttgcatttaataaaacacctccaaacccagggaaagaatcagttattacttccttcaattcatacaacgaatatttactgaacactctctatgtgccaggctctgtactaggcactgaggatttcttagagcatagaacaggcaaaaaacaaacaaacaaaaccgaaaaaaacctcacaatcatggggcttatattccatggcaagaggaaataaatgtgtaaataaaatatatattttgtctgaaggcagtaggtgctatgaaccaaaaggggtggaaagctaaatgttaaatacagtggttatgaaaggccttacttagaagtgaaaattgagcaaagacctgaagatgataagcaaacaagccttatctggggaaaacatttaaggcggtcagaaaagcaagtgcaaatgtgaaatcatgcatggtaggctggaggttaggaagggggtcaatgaaggttgaggggagtgagctagggtggagcgctaaatgaagacagagaggtaatggggaaattgaatatggagggtcttgtgaactactgcaaaggcttttcttccaagtgagatgttgagccattagagagttctgagcagagaagtgatgtggtctgactgaaattacattacatatattgcaaagcatcactctggctatcattttgagaatagactgtaagtggtaaggccagaagcagggaagacaattaggaggctactgcaataatccgggtaagaaatgatagttgcttggattagggtagtagtggtgatgaggatgaggagtggtaagattctggacttattctgaaggtagagctgcaggatttgttcaatggttgggtttgtgagagaaatacaggtctgggagagaaataaatttttgatttgagtaaccctaaaggtggagcgttatttaccaatattggggaggctatgtatttgcttggtaaaataaggaattccatttctggtatgtcaagtttgagatgctcattagacagacgtggagatgttgaataggcagctgaatatgtgagcctagaattctgtgtaaaggcctggactagagatacaagcttgcaccataagcttgggtgcaaatattaagagagtgaatggagctgaagagaagagcttcaaagattgagctctagggccctctaatgtttacctgcttgggaaatgagaatatgctagcaaaagagactgaggaggagtagactgtgaggcaggaaaaaaatcaggagagtgtggtggactgaacgccaagcgaagaaagtgttttaatggagaatgaataatgggccatgtaaaacaattctgagacatcaggaaagacaaagactgccgaatggttaatggatttagcaacatggaagtcattggtgaccttagcatcaacagttttactagactggtaggtgcaaaagctaactagaggggcaaaagagaaccagagcataggattggagagtgtttatagtgactatacgcatttcttgagaagttttgctgtaatggaaatcaaagaaatgggacaggagctgctagggagtatggtttataagggtatttttaggatgagataaattatgtgtttgtatactgataggaaagttttgatagaaagagaaaatttgataaaacagaagaaagatgtgagctttttcaggagcactgtttatgcatgtgcaagaggagagagattctaaggcacaatgagggatgggctgagccaagggtacacagagtttatccatagttgcaggagagaaggcaaaatacatgggtacagataaatatgggagggtaggtgtgctggacagcaagtatttgtgaagttgtcttttgatggtttctattttttcagtgaagtaaaaagaaaggttctaagttgagcgtaaggatgggggaggaggtgttagaaatttgagagagggaaaaatatgaaatattcttgtacagatatggaagagtaaatgacaaggaaacatattatatttgctgggcagcattaacggcctccttgagggatcatgaatttaaactgagagtcatacatttgcttgtgtgtttttctccagccacattcagctggcacacaggcatgaaatagatggcgagttgcatatgatcagtatagttgagatttgtcaagagagcacagttaagtcagagaaggtcaatggtgttaaaggcgcatacaaggaaatgattaaaatcattgtccatggaatctacgctatataatgaagtgagcatatgagaagctatgggtaaaatcaatgaattaggggtcctagtgggtttaaggaattggtgtattaggggtaacaaagggattgaactaccaagacattaggctgtggttggaaaatggaatgcttgaaattgagattgtggaatattgtaattattagtaattaaaacatcagaaatgtagccatgggaatgagtagctatggcagagtggagaatcaatcatgagaagttcaagaaattgagaggaggtattagagggagcgtgtatttacacagtgaataaccaataattgtaatggggtagaaatggaaagagtgttagtgagctaggggctaacgttttcaaggaattgggaaacttgcctggtagacaactgcatcaagggggagttatgggaacacttagcttttctactacctcctcaatgtttcctctctctcactttccatctttccagcttatatactggcattacaaactttaatttcctagactagatagctacatatcacctgtgtctaccctttctcctccctatccaaattatctccaagtcttgagaatttccaatttttttttctgagatggagtctcactctgttgcccaggctggagtgcacagtcatgccatctcagctcactacaacttccgcctctcaggttcaagcgattcccctgccgcggtctcttgagtagctgagattacaggcacgcaccaccacacccggctaatttttgtattttagtagagacgaggtttcactatgttggccaggctggtctcgaactcctgacctcaaacaatccacctgccttggcctcccaaaatgttgggattacaggcatgagccactgtgcctggcctccaattttgaatactctctactctccccctttgggaccatcactactctagcctgtcactctctattttatcactcagattaatgttcttcatggcactaatcgctctctaaacttaacttgttcatttatttgtttgctttttttgttggggggggtgtctattttccttcattaaatataaatttcataaggggaaaagttttgtttaatttgtgcctggaacataatatgccctcaataaatactttcaggatgaattaataaatgccccctataacatgctgatgaatccttatattcttgggttcacacaacagctttgctttactatcctaccagcttctccctcctttcctgctcaaaccatccatttcaccgagtaaagtcatttcactactcccccaaaacaccatgttcatttctattcagatgatttcatcatatttctcccttgtttatgtctattccccacataccaattctttgagtcccagcttaggtcttacttctcggatggtttttctatgattaccatgaggcctgctgatttctccctcctctaaaatcctgctatccctaacaacaccagctgctttatattttctaattgtttcatatgggttattcttaccttttcactttaaaataggtttatttttggcctaaggatcctgacttacaactacagtatactcagtaaaaactaacacagtgtagggcagataacgggtattcaaaaaatactatggcctccttagatagcttcatagacttccatcttcctcaacaaacattttctaccttttaccctgctgttagctaaatctaactattcttcctgctctatgatactgtctttgagaccagaaccaacccctatgtccactacacagaattctacactcttgcactgcaattcccacagctaaatcattgtcattgccattattgttcctggattctcttggcaattttagtatattcaaggcatagctgccaagatcatcatcctccttgattgtttggaatctttatttttttaaatccctgcattttttccatcaaactttaagtgttcctgtgggatttgtttttccttggctccatccttggcctggttcttctccactttcttatgttcagtcactcgatttgccctttgtctcatttgaaggaatcagctttcacaccttcttttaaactaccttgcatatttagaatattttctcaaataatataaaatttataatatttatgaataaatgacacaatgccaagatattctgtctcttctttcaaataacatctgaagatgcacctgcactagtgagttctatatttaagatattgaataagtatcattcacccatctgctttcattctgtcctgcattttttaggacctgcttcagagttgtattttgaggtcttttggacggggaactgtctggcatagttcacaaactggcctttgctctgtatattcatgttcctttgataaataataaataataataatagcccactgtgcatttttacattccactcataaatccctggaaaaagaaaaactaacaaccagggattataatagaaacacagaaacaaaactaaccttttaccaggttttgctacagtaatatatacttccatagacctatattctaacaaataattacctgcttaagtcatttgtaaattgttcctttgccaacattatgtataatagcaaatgtctacgtggtttataggacagggaaaacaactagaacattacagctatgtgggggatcagtgcaaaagcagcaaaataagaggtttactctgttgggtgcacagtttggaagaattagtctcacaagtagaactacttgacagaatatatgcctgctctccagctcccccttctcccctcctccagatcttttttcaataatggaagaagacttactttcttttttcaaatccaggtgggaagtgtatcattttgcgtgaaaaatctgtttttctttgaacataacaaatggtctgattgaagctgctctatgaaaacggcagcatatctaaccagggaggtgggaactatagtttaatgggtggagcacctccatatttagctgcagatgagccacatttaactttaaaaaaaataaaaatttaaaaaataaaagaaggccaaaatgtaatgattgtcttgttactgcagtggccactagatggcaggtccaaaaatctgatgggagtctcacaggagggcaaatcttagggagcagaatgtttctggcactcaatccagtgttggttcatcaataagccttggcagtttgctaaaatatcaggtgggtaagacaatatccatgttatttcacagggctgaagggggcaggaagccctttggtatctaggtttgtagagtattgtcatcacatactcacacatccagatactgctacccctttggacttctgtccacagacattcttggagctggtttttatatatgttcagctgtattccattatctaatggtctgtgcaatactgagccataatctcaggagtgtaaaaggtagttgtctaatctgcctccatggaaacaaatgaaggaggctgtcaggctagggtaagggaacatacagctgtactgtatttaacaacatatatttaccagtaattgcaacttcatgttaaatatgtgtatttcctatactggaggctgaccatatattcatgttaattgttttgaaaaagagaatgttgatatataagagacttattatttaataggataaaataactaaggcctatgattaaaaatgaaatgagtaaatttagaacaaattatttgttgtacacagtagagttttcattttcttttactaggatgggagacttctagatgtgggtcttatgagactataaaaaagtcattcttggaccaattattctgaagatagattgtgtctttcccttcataatttttttttttttttggttactagattatcctgataaaagtgatttcactacatggacaatgcctacttttctttatcttttaattaaagaactgaccttatgatttttaaaagtagagaatcacaagctctgagataatttatcattctcactaaagaaaatgtgctctagagtcaaatttatctttgtacaagagctgtgacatgcattttgatatacatttaagcatctatgtcaattaaaatattataaaaataaaagcaacaaaaactcaattatagccatgcaactcagtcatcactcaccttttgttccctttttctttgaaaatttagatagaataatggtaaacatgttgatttcatctattcttgctctgtatatttggactgtgaaatgtctacatgagacacaggaagagggcacgggtcttcaggataaaaaacaaaaaaaaatttttcctaaagaagaaatatgggctatattgaattatgatagatgttttaaatcagtaccgttttcctttagtttggagtaaaatttaaaatgagatgactgaaataatttacgataaaatatcatggttatttctacatatttaaggtttaaaaatgctcaaacttatactttcctcatagaaagagcactggaatgggaaactgagaggtctgggttctattctggctttgacagtgactcactgtgtgacatccagagagcatgacctccccaggctcctcacttctgaaatgggagggttttgaggacaaagtctctctctgctttaacattcaatatccaagtaagtaaattgctacgtattgcagatttttttttcctcagaaatagactaatttcctccgatgaaagaataatactgttaagaagctgatgttgaaagctaacatgtccctaccaacactgtgggctctacccatgcaggtgaagctagagcttgttcttccttcaatcccccctttccctattctgcaccactcttccacacactcccccatcatctttaagtctaaattctacctgagaggtcctctgtgacccctaggtagttacttgctaattattactaattattcaataactgttttacttttcctcttgagcacatagctaagttccatttcccagccttctctgcagatagctatggccctgtgaccaaattctggtgagtgggatgttggtggaagtgacatacgctgtcccaggcctggtccattaaaagttcctgtgtaatcattgctctctcttcaccagatttctggctggatgtcacacccacagcaatcttggaagctatgtactgaagagcctctgtcaacctgggtccctgaccagtctttacatgagcaagagagaaactcatgttgaaatactgagatttgggagtgtgcgtattatagaagctaatgttaccttaactaagaacactcctaaagcagaaatttgttctctctccgagacattatgtctcttttaccacattttccacctttaataatttatttactgatatgtaagctccttgaggatagtacatttgtttcactagtgtacccacagaactctagttagttgaatgaattcagaatagaacatagctggtttggaaagtacagaagttacagaaggtagtaaaagcagtttgatttttaaaaattctagctttgtgttttatcctataatatttaggtagaaggtagggatgatgggttggggttttgttggtgtggaaatgtattgtgacaaccacagccttttaatatattttgtgtactgcatccccaataaacatgttttccaaataaagtgtaaagtctttttctaaatgctgtatggcttgccttttttatatatttgtgtaaagaaattcgtagtagtaattctctgacactgagttaaaggaagtcctattttttttcacaattatgtgaaaacacaattatgtgctgtataatgacattttagtctacaatggaccacatatctgactgtggtcctgcaagattataagataactgaaaaattcctaatgcctagtgatgtcatagtgatcataacatcacagcacaattactttttaaaacataaatttagtgtagcctaaatgtacagtgcttataaagtctacaggagtatacagtaatgtcctaggtgttcacattcactcatcactcactcattcactcacccagagtaacttctagttctgcaagatccattcattgtaagtgccctataaaggcatacacttttgatcttttatgctgtgtttgtactgtaccttttcaatgtttagatatgtttagatacatgaaaacttaccattctgttataattacttacagtatccagtacagtaacatgctgtgcaggtttgaagcctaaaagcaataggctatatcatatagcctaggtgtgtagtaagctctatcatctaggtttgtgtaagtacactctatattgttcacacaacgatgaaattgcctaatgatgcatttctcagaatgtattccctttgttgagcaatgtgtgactacattttgaaaagttaaaataatactaaagggagggacaagtgaagagctaacttgagaaatctaagaactaggtaatttaaaagaagtgcttttagttacatagggtttttaacatcattaccacctatgaaattacaggtattaactactgtctcaaaatgatcatcgcccttttgatactttactctcagtgtcatggctgacctcttttgagtcaagtttattggacattttcagttttattttttaattctcatcactgcccctccctgaaatacttcatccctggtttccttaataatactggcctaatttccctattctctatctctagttttctctcctcttttgtttggctcctctttctcatctattctttaagtattagaatttcctagtgttctgctctgagtttttctttctctcataatttttccttgagtcatcttatctagtcttatggctttacctactacttcctcacaaataactcccgactcttgatctttagcccagacctttcttcggagcttcaaaacctgtattgcctatagtatcctgggcattttaagaaaatctaaatattttgtgccaccttaaattcaagtcccaaaccaaaagcactccttgccctttcaagtcaaaccttcttcctcctgtgttccagctcttggtagatgacatcaatttagaaacattaaactctccttttctttctttcttgtcccttatctaaattatctaattaagttctaaatcctgtagtgcttttatagtccatttgagattttagcctaagtttgaggactagataagtgaagacagattaaaaataagacttcttttaactcagtgtcagagaattactactatgaatttctttacacaaatatacaaaaaaggcaagacatacagcatttagaaaaagactttcatacccttccatcataccagagttccattatcagcctgaagagaaccaggagagctgtcctgagagggagctttctcacaatcaggactggattgaaacaaaatagaatcaatggaaagaaagatttttggggaggggagagaagttttgcttgctgctggtcctttggtaacctctgcaaaagaaaagtttaaaaaatgaccctggctggcaagatggccgaataggaacagctcccgtctgcagctcccagcaagatcaatccagaaggcaggtgatttctgcatttccaacagaggtacctggctcatctcattgggactggttagacagtgggtgcagcccacagagggcaagccaaagcagggtggggcatcgcttcacccaggaagcacacagggttggggaattccctccgttagccgagaaagccgcgagggactgtgccatgaggttcggtgtattccagcccagatactatgcttttctcaccgtcttcacaacctgcagaccaggagattcccttgggtgcctacaccacgagggccctgggtttcaagacaaaactgggcggccgtttgggcagacactgagctagctgcaggaattatttttcataccccagtggcacctgcaatgccagtgagacagaaccactcactaccctggaatgggggctgaagccagggagccaagtggtctagctcagtggatcccacccccatggagccaagcaagctaagatccactggcttgaaatccttgctgccagcacggcagtctgaagttgacctgggaccctcaagcttggtggggggaggggtgtccaccattactgaggcttaagtaggtggttttcccctcacagtgaaaacaaagccaccaggaagttcaaactgggtggagcccaccacagttcggcaaagccactgtagaaagactgcctctctagatttctcctctctgagcagggcatctctgaaagaaagttagcagccccagtcaggtgcttatagataaaactcccatctccctgggacagagcacctgggggaaggggcagctgtgggcgcagtttcagcagacttaaacgttcccacctgccagctctgaagagagcagcagatctcccatcacagagctcgagctctcctaagggacagattgcctcctcaagtgggtccctgacccccatgcctcctcactgggagacacctcccagcaggggtcaatagacagctcatacaggagagctctgggtggcatctggtgggtgcccctctgggatgaagcttccagaggaaggaaccggtagcattgtttgctgttctgtagcctctgctggtggtacccaggcaaacagggtctggagtggatgtccagcaaactccagcagacctgcagcagagatgccagactgttagaaggaaaactaacaaacagaaaggaatagcatcaacattaacaaaaaagatgtccacacaaaaaccccatccgaagatcaccagcgtcaaagaccaaaggtagataaatccacaaagatgaggaaaaaccagcttaaaaaggctgaaattccaaaaacccgaatgtcgtttctcctccaaaaaatcacaactcctcaccagcaagggaacaaaactggatggagaatgagtttgaggaattgacagaagtaggcttcagaaggtgggtaataacgaactcctctgagctaaaggagcatgttctaacccaatgcaagggagctaagaagcttgaaaaaaggttagaagaattgctaactagaataaccagtttagagaagaacataaattacctgctggaactgaaaaacatagcacgagaagttcatgaagcatacgcaagtaccaatagctgaatcaatcaagcagaagaaaggatatcagagatgaagatcaacttaatgaaataaagcatgaagacaaggttagagaaaaaagaatgaaaaggaatgaacaaacctccaagaaatatgggactatgtgaaaagaccaaacctacgtttcattggtgtacctgaaagtgatagggagaatggaaccaagttggaaaattcttcaggatattatccaggagagcttccccagcctagcaagacaggccaacattcaaattcaggaaatacagagaacaccacaaagatgttcctcaagaagagcaaccccaagacacataatcgtcagattcaccaagattgaaatgaaggaaaaaatgttaagggcagccagagagaaaggtcaggttacccacaaagggaagtccatcagactaacaacagatctctctgcagaaaccctacaggccagaagagagtgggggccaatattcaacattcttaaagaaaagaattttcaacccagaatttcatatccagccaaactaagcttcaaaagcaaaggagaattaaaatccttgatggacaagaaaatgctgagagattttgtcaccactaggcctgccttacaacagctcctgaagaaagcactaaatatggaaaggaaaaaccggtaccagccactgcaaaaacacaccaaactgtaaagaccatcgacactatgaagaaactgcatcaactaatgggcaacattaccagctagcatcataatgacaggatcagattcacacataacagtgttaatcttaaatgtaaatgggctaaatgccccaattaaaagacacagactggaaaattggatagagtcaagacccatcagtgtgctgcatttaggagacccatctcacgtacaaagacacacataggctcaaaataaaggaatggaggaatatttaccaagcaaatggaaagcaaaaaaaaatgcaggggttgcaatcctagtctctgataaaacagattttaaaccaataaagatcaaaaaagacaatgaagggcattacgtaatggtaaagggatcaatgcaacaagaagagctaactgtcctaaatatacatgcacctaatacaggagcacccagattcataaagcgagttcttagagacctacaaagagactttgactcccacacaataatagtgggagactctaacagcccactgtcaatattagacagatcaatgagacagaaaattaacaaggatattcaggacttgaactcagccctgggaacaagtggaccaaatagacatctacagaactctccaccccaaattaacagaatatactttcttctcagcaccatatcacacttactctaaaactgaccgcataattggaagcaaatcactcctcagcaaatgtaaaagaatggaaatcataacaaacagtctctcagaccacagtgcaatcaaattagaactcaagattaagaaactcactcaaaaccacacaaccacatggaaactgaacaacctgctcctgaatgactactgggtaaacaacaaaattaaggcagaaataaataagttctttgaaaccaatgagaacaaagacataatgtaccagaatctctgggacacagctaaactaatatttagagggaaatttatagcactaaatgcccacaggagaaaacaggaaagatctaaaattgacactctaacatcacaattaaaagagctagagaagcaagagcacacaaattcaaaagctagcagaagagaagaaataactaagatcagagcagaactgaaggagatagagacatgaaaaacccttcaaaaaattgatgaatctaggagctgattttttgaaaagattaacaaagcagatagaccgctagccagactaatcaagaagaaaagagagaagaatcaaatagacacaataaaaaatgataaaggggatatcaccactgatcccacagaaatacaaactaccatcagagaatactataaacacctctatgcaaataaactagaaaatctagaagaaatggataaattcctggtcacataaaccctcccaagactaaaccaggaagaagtcaaatccctgaatagaccaataacaagttctgaaattgaggcagtagttaatagcctaccaaccaaaaaaagcccaggaccagacgaattcacagctgaattctatcagagatacaaagaggagctggtaccattccttctgaaactattccagatcatagaaaaagagggactcctccctaactctttttatgaggccagaatcatcctgataccaaaacctggcagagtcacaacaaaaaaaggagaatttaaggccaatatccctgatgaacattgatgtgaaaatcctcgataaaatactggcaaaccgaatccagcagcacagcaaaaagcttatccaccacgatcaagttggcttcatccctgggactcaatgatggttcaacatacacaaatcaataaatgtaatccattatataagcagtttagagccaatgacaaaagccacatgattatctcaatagatgcagaaaaggcctttgataaaattcaacaccgctttatgctaaaatctctcaataaactaggtattgatggaacgtatctcaaaataataagggctatttatgacaaatccacagccaataccatactgaatgggcaaatgctggacgcattccctctgaaaactagcacaagacaaggatgccttctctcaccactcctatttaacacagtattggaagttttggccagggcaatcagacaagagaaataaataaagggtattcaaataggaagagaggaagtcaaattgtctgtttgcagatgacatgattgtgtattcagaaaactccatcatctcagctcaaaatctccttaagctgataagcaacttcagcaaagtctcaggatacaaaatccatgtgcaaaaatcacaagtattcctatacaccaataacagagagccaaatcatgagtgaacttccattcataattgccataaagagaataaaatacctaggaatacaacttacaggggatgtgaaggacctcttcaaagagaactacaaaccactgctcaaggaaataagagaggacacaaacaaatggaaaaacattccatgctcatggataggaagaatcaatatcgtgaaaatggccatactgcccaaagtaatttatagattcaatgctatccccatcaagctaccattgattttcttcacagaattagaaaaaaacaattttaaatttcatatggaatcaaaaaagaacccatatagccaagacaatcctaagcctaaagaacaaagctggaggcatcacgctacctgacttcaaactatgctagaaggctactgttaccaaaacggcatggtactggtaccaaaacagatatatagaccaatggaacagaaagaggcctccaaaataacaccacacatctacaaccatctgatctttgacaaacctgacaaaaacaagaaaaggggaaaagattccctatttaataaatggtgttgggaaaactggctagccctatgcagaaaaccgaaactggaccccttccttacaccttatacaaaaattaactcaagatggattaaagacctaaatgtaagacctcaaaccataaaaaccctagaagaaaacgtaggcgataccattcaggacatagtcatgggcaaagacttcatgactaaaacaccaaaagcaatggcaaaaaacccaaaactgacaaatgggatctaattaaactaaagagcttctgcacagcaaaagaaactatcatcagagtgaacaggcaacctacagaatgggagaacatttttgcaatctattcatctaacaaagggctaatatccagaatcaacaaggaatttaaacaaatttacaagaaaaaaacaaaccccatcaaaaagtgggtgaaggataagagcagacacttctcaaaagaagacatttatgtggtcaacgaacatatgaaaaaaagctcatgatcactggtcattagagaaatgcaaatcaaaatcacaatgagataccatctcacgccagttagaatggcgatcattaaaaagttaggaaacaacagatgctggagaggatgtggagaaataggaacgcttttacactgttggtgggagtgtaaattagttcaaccattctggaagacagcgtggcaattcatcaaggatctagaaccaaaaataccatttgacccagcgatcccattactgagtacatacccaaagtattagaaatcattctactataaagacacatgcacatgtatgtttattgcagcactattcacagtggtaaagacttggaaccaagccaaatgcccatcaatgatagactggataaagaaaatgtggcatatacacaacatggaatactatgcagccattaaaaaaggatgagttcatttcctttgcaggacatgaaactggaaaccatcgttctcagtaaactaacacagaaacaggaaaccaaacactgcatgttctcactcataagtgagagttgaacaataagaacacatggacatagggaggggaatgtcacacactggggcctgttggtggctggggggctaggggagggatagcattaggagaaatacctaatgtagatgacaggttgatacgtgcagcaaaccaccatggcatgtgtatacctatgtaacaaacctgcatgttctgcacatatatcccagaacttaaaagtataataataataaaaaaaagatctaatggctaaacctatagaaactctagctagacctgtggtttctattccttcctgggtataataataaaggctcacatttattttaagtgttacatttttcattgacattgaaatgagactcccttttcgactaatcggctgctttgatttcttcaccctaaaaatcactcttcaatgttttccacaattcttcaacattagtaataacttcctatatagtatctgtggtcctttttctttccccagtgtgatatatttatcatctattacacaaacttcctcttttgcttcctcccttttcaccaccagctctaacatcttaaattttcatttgacatactgcttacctaaattatttcatgtgtgttcccatccatggaaattcatttttgtgtgacataaatccctaccctactctatttcacagtaataaaactttatactgaattgccaaagagataggtaaccaaccacgcagtttaaattaagtgcaagatacacatgtttgaatattctgctctctgtctaagatgtgtagagacaggtcctgtttgtgtctgagcattctgtcatcttattcaaactgttggagttaaatcacctaagaactgttttctcactttgattcaaaagtaacttctgctatgcaaaaaaagcacagttatgaaataatatgtgtattaaaaaatctcaaaaataatgattagagtcacattcagtctgtgaaaggagtagctccatgacttgagcacatgccaatgagattagaactcatcgggggttggcattctcattgattgttgtccctctgtaccttcaatggtttccagtccttgtccaagttaacctttgctagttgttgtagccatggtaaatatcctgtttattggattttattagcgttttaaattttgacatttggaaaagcacaatcctccttctttttcatcctgtcatctttagtgtataagtgtccaggctccttccaattttaagtttctctttcctagctttagaagattataattttggaaagtcacaattattctgctagttggtggccagaacatatcaattgcatgtaacaaaattttattcagatgcatcattcatacattttaagtctcacggtttacttctttcataattatttgacatttttggtgaaataagtttagttctgaatcacccattttgttatgttgattctccactatttttggcgatacaatagtaataatgttagacatttgtatagcagtgtaaagttttcaaagtgcttccacatacacagctcttatttgcttctctaccttaggacataagcaatgtggtgttatacccattttacagataaagaaacacaggaacagagtattactttggatcacacatggtaagcctcgaggacagaatgagctcctgtgctagtgttctttccattgcatcgtatcattagtaatgtttacttacacctacatacttactgcttttcaaatatccagacgtcatctcctctactgtaccactctattatcactcgtgtcatattctgtttttatctctttgctaaggctatacccacccttccagttccccactgccctcattagactctgagctgctcgagaaaaatgattcatccatctttgtatctctagacccaagtaagatcacaccacatttttgccaagtctctcttgtgctataaatgttcatcttctcttagttgtaaattgctttcaacccaccttttttttttttttctaacttttattttaagttcaggggtgtaagtgcaggtttgttatataggtaaacttgtgtcatgggggttgtacagattattttatcaatgaagtactaagcttagtacctattagtaatttttcctgattctctccctcctcccatactccatgctccgaaaggccccagtttgtattgttcccctctatgtgtccacgtattctcatcatttagctcccacttataagtgagaacatgcggtatttggttttctgtggttttctttggttgctgtgttagtttgcaaaggataatattaccactgaccccagagaaatacaaacaaccatcagagaatattatcaacacctctgtgcacataaactagaaaatcaacccataatttttaagtttatgttataaatattagtattatctgagaggaaggcattacatccataagcagaaaggtggaaaaatcaggagagtgagtgatttatttgagagtatctggtttgttagtgaaagagatatgaaacaaacccagggctcctcatacctaggctacatctgtaacaccaaagtccaatgtactggtaccaaacagactggcacttgtgggatgctgtgtaagcagcatggacagtattcccttatccccagtgcaggctacagttgcttaaaagaactatggaaaaccggacattttgttcccttctaatttatctgtgttcctgtagccatgtctccacttctaaacgctaatcacttctctaggtgagcttaagtacctaattattaagagccctccaaatttctagtgtcatcttcaatatagttagtgccctttctgtcccatttgccccctgtgcttggcactgaatcagtatagcaaatatccctaatgaagaatcatggtacagggttaaatttacaaattaagcaattcctttagtttttatgtcaattccttttatccttgtatccccaccctgcatttgcttaaaattcatcccactgagaagctaaaaaaacaatgctactatgacgatttaaagagaaatactgaaccctaggactttttcctgagattcttgttacctgtaaactcttgaatataggatcagattacctaggcttccagggaatagtaagaccatacattagcagatttaatattaatctctagaatcccagatttacttcttgtccaggttaaatgcccttttgattattttagcaaaaaataatacaaaaaattgattacaaccattaatggaggcttaaaatgttaactcccatagctttaacccagtatctatgattaaatgcaaaaaatctaagttaatgcaatgttaaggttgagcttctaattgcacaaaagtcatgaaatttaaaattaaggtttctagtgctactctctgtcatttctacaacattcctccaatggttttctacaatatatgtttcatttaaatgtgtgtgttgtagagttcccaggaaagaacataaagcacaacagatcaggattcaacttgtggatacctagttttacataatcaatatggctggaaaagtgtgattcttttttaaactacaatgccctatttgagtgataaccatattcctgtttacaaatttgcccatttcctctaaaaatccttgaatcttcacttctgattacacactagccatcccctagagaaggaaagagcatttatgtaataaacaaaccaaacaacctgtggactgtgatagtacctacagaccttttcttcaacatatgacaaagcatattcatgtgggattaatgttgaaagagtaactcagaatatttaggtttatgggtgcatctagcagaacaagcaaaggtgaatagggactggaatcctgttaatactattaataggactagctgaggaaactgtcatcaaattattaaacctctctgaatgttattatcagagtaagaatacctgcttgtaggattattaggaagaacgagtgaagtaatatatgtaacacatgctctttaaaactctcttggagtttatagtaatagatcaactattactattaaagaatgagtaatcataatttaatgatcatctggatgtctacaggtattttggaaatatgaaacaatgataatttaaaattcattttattgaaagatacctagaattatttttttcacaatagtttcattaagttaggtatttgtttatagcctactatggaatgcccagataacatttaatacatgatgcactgagctgcatcagctaactctgaaggcaggtgagttaaatgaattcttggatattgggctgccatgcccaatattttcttcaaattttatgaaacatttgtgtctaaatagaaaatgtgcttgagaaattctagcccaacatgcaatttagagagaaagttataaatcataaatataagagcttagagctaaagtgccacctcaaccataactataataaaaactcctaagtgcattctggcaggaataaataaaaaatggcaaagcctgttgtggacggtgcagagcccaggaaggtaaccaagtgagtaaacagctaaggcaggattatcctcatttgggaggactccattccagacaggaattaaagaggaggggctggggaagggagaatggaggttgtgggagaaagtgtttttgcatttgaaagcagctaagttaccttgtgtaatgaaaaggaaatttgtttttttcctttcaacagtaatctcatttgaggtctagcagactgctacacaaaagatacatgtgttctacctacttggtttttctcctctggcagtgaggtacacaggaagggttcaggtgaatcagaaccattcagaataacatagtcaaattcctttccaaaggtttaaatacctattctttaatagctttcttcaaaagactggtaacttactgcactgttcctggcacattcacaaccaaaatttgttcctgggagtactataatacgatgcaacaaatgggtttaaacgaaagctggaaagatctatactgaaactatgaatcacaattactgaaagcaaaaaaatctcatacacatataatatccagaaaaacatacaactgtcccttggtatcctcgagggactgattccaggaccccactgcagatactaagacttgcagatgctcaagtccctcatatgaagtggcacagtatttacatataacttatgcacatccttcccttatacttctcaccatctttaggttacctataatatctaatacaataaacactaggtaagtggttgttatagggtatttttaatttgtcttttttttggtatattgttattttttattgttttttttccaaatatttttgatgtgtggttgattaaatctacaaatgtagaacccataaatactgagggctaactgtataaccaataatttctgagtccttttgtctctccctatgttaaagcaatggtgtagatgagatttctctgaatagaggggagcagctggaccaataagctgcattatcacttagagttatcaggactatatcaactgattcaagccttagcccccatctccgacttgctgtgatatgcaccaagttgcctttcttcttggtactttcctttcttaacaacaactagtaaattgactataaaacccttggctactataaactctattagaaaactggctgtttccagcatgagccaaggactctagctttccatactcaaagatttatatttctcaagtttcttaacaacattggcatatatttattacaatacagtttatacttttaaaatcaagcaaacagttaagattttaatggtcataaaaatgaagaacgcattggctattttctgagtagtgaaaaagttctcttttataatagcttaactcaagaacttttgaagtctttttcttcaaagatttttcatacaaaaattacctttgagagtaagcatgaaaaaatctcaggaagtaggtaagtattgttaatttaaatgcctcccttttcactccaggaaacataaaaccaaatgacaaagtacagatgatttattccacaactattcattgagcacctactattctctggcactgtggtaggcagtgaacaactctgctttaacagtgagaacaacattcttatctcctgtgacccttaaggaaagactagctgtagttagacttactggatttggtcataaagataaattaaatataaagcagtgaccatttaagtttaattatgttaaagaaattttgaaacaatagcttatttaaatcatttaagtatttgtttacaaatttttaccttctttctaaaatgccaagaattgccaaccatgaaattatgaaaacaaatcaataaaaatacaatgatttgaagaacaaatctatttaagataaaaaggcacataacctaacaccaataaaattacctgtagcactcttaaaaactagatttcttctttctttctttctttctttctttctttctttctttctttctttctttctttctttctttctttctttctttttctttcactttctttcttttctttctttctttttttttttttgacagggtctcactctgttgcccaggctggagtgcagtggcatcatcttgggtcactgcagcctctgcctcctgggcccaagtgatccttccacatcagcctgtcgagtaactggaactacaggcacatgccatcactcctgcctaatttttgtatttttttgtagagatggggttttgccatgttggccagggtggtctcaaactcctgagctcaagcaatccacatgccttggcctcccaaagtgctggaattacaggtgtgcaccacaacaaatggccccaaaactaggttttcaaatatgtgagagtatctctcagctatgtcaaaaatcctatgagtcattcattcagtgtttatttaataccaaaacatggaagatagtatgtctaggaactaattttactccaacaataaatctagaagaatgagtacctatttcatgtggttatcatgaagaaactctgtcagaaaactaaaatgaaatggctcatgaagttgacatatgtatgaaaatataagaattctgctcacacctcttctttcttcctgggggcattatccatgagcatcatctctgtatatgaaggacggaaaacccgctttggatatgtatgcttctgggtagtctagtcaaaaaggaatatgaactcttttatctctgaatgcttccaaataccagagaagaatgatttatggagttctgtatatgactaaaagagctgctagtacttttagagtattcattctttctttattccttcttcagggtgatctggaaattgcccttcccaggactttctgtctctcatataaactaccatttgtataccactttttaggttgcaaaatgctttcacatgtattgtgcaatttagttaaaaggcatcagggtgcgaggatcaagaacactggctttggtaccagagacatcagtgtttaccaaagctacttactagtggtacaccattgtgtgagccacttgatcactttaagcaacaattttctcatttgtaaattagggataacaatatccaccttgcaatataaggtagagattagcaatagggcagttaaaatgttattatgattaataacccatagtagggacaccaaggacttctcaatagtctgtttctcttcatcaggctggaggagggggtcttcacagttacttatgagtacatattacaagcttctagttaaagtaatggcctcttcaaatcttagatctgaaccatcttcataaaacagttctttaattcatggccaaaaacatcgtttccatatactctcagagacagagtccttttggagcaagatataaagtttaattctaagtctttttttaaccccgaaactattttccctgaagcaatccatgtgctgccatcagattttattaggtgggctaaaatagagtcagaaggagatttctttacataatagctgtccctacagaaacttgagacagtcagcttaaaaattatttttaatgaagaatttttgagatccataagtacaggaaaaattttgatggtctttctcccttactgattcattgataattctcaaacattgggctggcacaactagagtaaatcggtacatcttacacagtggaaagcggtgggtgtagatgtttttggagccagtcagtctctggcagcggatagagtcacacttgtgctttgttgcccatttacatcttcagaaagcagcctgggtgggcatgcttatcaaatgtgctcatttaaggataaacccatttgaatattataacaacatttggcaaacttcctctaccgaatggtggacctggcccactacctctgaaaactattgcctggccaggcaacataggtcctttgactttctttacatggtagaacacatctgagaccttccaatcaaacacccaggaggagtcctgagtgctttacctgttcctcaagcattctgaaggttctagtctggactagtgggttatggatatatggatatgcagtgagtccttccttttgcaacatacaccttttttttttttttttaatccagactggagaattcaaatgccttgttaatatctagtggtcacctttggcatgaagaagtcagcaaacatttactgaaaaagttgcacgtggagaattctgtatcataattaaggagatgccctccactccctgaagatgtttataattcttgctgggaatgagggaaaaacaaaacctatacaggcaaaactgcacagcacttatagaccaacacaaaagtgtgtacacacagtgtacaaagacttaagcagagcaaatagggttaaaaaaagaatttggaagaaagtaatggatatacattttccaaggtgagagagaagaataccatagagtggagaaagcataaacaaaggcatggaaatgggaactggaaagcccaccaacttggctaacatagagaaagcagagcagtaaagagtagggggtaactacaggggcatggggatgcatgaggaaccagtttgtaaagattaccaatgctaagccaaagctcttgttcattccattccagggaaacagaagttgatggagaccttggagttgggaaagaaaaggaggccaagaaggataactggtagtagagtggccttacagctagatgaggaattcggattctagtcttcaggtagaaaagcagcagtataaaatccaaggccaagaaatgagacatagaaaattatgtgtgggagcaggtatcctagatgcttaaaaaaattgttttgtgaagatagtttgaaggaagggtggcctattcaagcggttcagaaaggagataaggggccacttggtctagtgtcagcccttgaaaataaataaaagaaagaggctgaatgaagagatattactgggtgagaactggcagaatttagtgactgactgaatggtaatgaagggcaaaagaagaaaagatttaaaaatgatcgtagtgctggggcctcaggaaagggtcctatggacagtaattgaaaaagaaaactggtggctagagcagaagatgctctggtcagtggtagagcatcccaatgattaaggggtgtatgcatgtgaatgcatgtgtgttactataggcacacagatttaggagtaatacctcctttgccctaatgttacataacagcttacaattttctttcaattgaaatctttatttcaagtatttattaagtgcatactaggtgtaaagtttacaataagacttgtgcaaggtttacaataagaaaacataaaaaagttctattactgaacagaaactagtttaaactttactgcaacattttttaaagagtgtattttcatttttatattaattttctattatttgtaattcttaggccactgacataacagtgctttcattagtgctagatatgccaccttgacacaatttaaaaatcaataatttttcttagtgtacttggatatcttccttttcctaaatagtggttatgcatttggatgaagccagtgaataagatggcttttggtttaaatttgcacccagatcagtcctgatagaaggccatgtgtttctctgtaagagacacatgtgcatgtgcatattctctgcctcactcagattagccttatggccatggtatcagaactgcaaatagttatattgtggattctttcttgtttgtgggtgacaggagaaaggaaaactcacactttttttgaacaaagcaccatgtagatatccaactgaagtgggctctgttcatcctcaattcaggtgtgatgaaaacctacagggagttgaccttcagtactgaccttttacattatctcatttctctcatgcaacttctgtctaaggatgggaagagacctaagagatctattagtctcagaattacattcatctacaggtgtgccaaaaggatatcaagttttaaaaacacaactgcactatttcttttgtttttctttttattttctttttttttttttctttttgagacagagtctcactgtgttgctcaggctggaatgcagtcgcatgatctcagctcactgcaacctctgcctcttgggttcaagtgattcttctgcctcagcctcccaagtagctgtgattacaggtgtgcatcaccatgcccaggtaatttttgtatttttagtagagacggggtttcgccatattggccaggctggtctcaaatgcctggcctcaagtgatccacctgcctcagcctcctaaagtgctgggattacatgcgtgagccaccacacttggcctatgactggactgtttcttaacattaatataaagcaaaggttgcataaacaatggatgtaggaagctcattccttcataattattaagaactgaaaaggtacattgaagaaaactagccatgaataagaaaataacttcttcacagtggttaaagagaaaaggtactgaaaaaagtaaacaaacatatgaaagcctcttaatatactaaggtattactatatatatttctgacctttggctactgagaaaatgtgaaagatgacaattctatagctattctatataacggcagatgctcctcttattccaggaaacaaaatccttttatgacatttcactaaatatctaatcaaagagtattttatgtgctcatttcagatagtctcattcacttgcccttataactttaaatgagttcttttcttaagcaggccagcttgtatattatttatgataaaatactttctttaagatggattcagtgttaattttgtactatatgacttagtacagtgggacaattacatataacacttcttctatcagccctatgtttctatgttctttattaagatattatcaaagtaatagcaaaattctgttaaatgttcaatgtatatctttactgctaattttttttcaacatggtaatattactggtaccacagtgactcctcatatcttgaatatatgcagtacaattcattctctactagcatcaatttctttttgtaaacagaaatttggctttaacacagcaatttccaccaaactatataagtgctaatgatgaccaatttaggacataaacagtttactactgtcctttgagcctctctcttttttcatttctctaatcatcacactaaggattttttttctagaaagctatgggcagagttgatttcacagagttacaagttgacctttttcttttttttttttttttgactgatgctgttaatagagttttggtgactctatcagttaagaggtataccttgtacctgacattttacttgcttgagcaactggccccaactaactgatttttaatattttgcttttctgtttcctcaattttccttccataaaatattttttctacttctatataacttcttttttatttttttgagatggagccttgctctgtggcccaggttggagtgcagtggcgcgatctcagctcactgcaagctccacctcctgggttcatgccattctcctgcctcagcctcctgagcagctgggactacaggtgcccgccaccatgcctagctaatttttttgtatttttagtagagatggggtttcaccgtgttagccaggatggtctcaatctcctgatcttgcgatccgcctgccttggcctcccaaagtgctggaattacaggcatgagccactgtgcccaccctataacttctttatttattttttcttcccttatcaaattccatctcatttttcttacgcaattaaaatatttcctcactacagtttgggtcagcggtcagtcatatttacatcactttttccatagtttggttgatgatgtgcatagagtatatgcactagccaaactgatccacattcactgtggataggctgaagtccaaattgtaagctgatttgtcaacagctttgagtaagcctgatgccagacaatattttaattcttcagtgatatttcctcttcacttatgaaggaagccttgaagatggcaagttaataagtgcattgttttaactctgtaaataatgctttttggggggttgtctttaaagattctcatttactttttataaagaaagttataatttcttattttctggttccattcttgatctctttattttccttcagtttgtggatttgctctacttttaaaaactcataacttatgagtaattttacagatcccaagatatagtttgtttgttttttgagacagggtctcactctgtcacccacgctggagtgcagtggcgtgatctctgctcactgcaacctctgcctcctgggttcaagcgattctcgtgcctcagcgtcccgagtagctgtgattacaggtatgtgccaccatgtccatctaatttttgtatttttagcagagacggggttttgccatgttggccaggcttgtgttgaactcctggccacaaaggatcggcccagctcagcctcccaaagtgctggaattatacacataagccaccacaactggccaaaataaatttttttaaagaggatactgagcatctgaaacaaggggggtttgtagactcacaaggattaaaaattatttcgattgtctttaaatcgattgttttttaatcgattaaaaatatattcgattgaatatagtgatgcatttatcagtctatcattctgtaaatagtatggaaaattctggaaaaaaattcctgttcacaataaaagagattcaatttgcgtaacgatatttactgtgtgcctactgtgtcctgtcctaagacacagtattaaagttctttcacttaaagagttcatacctagcagagggattagacaaatttatagacaattatgcaaattaagtaataagctttacaaaagaagtgcacaaaaatttattgtgggcgggtggtatatacaagtcaatgactttcgttgcatgggagagctaaagagaagtaagcaataagggcctcagaaagttagaggcatttgggatgagcctttgaggataggtaatatttgatatatggaaatgaagatagagatatacataagcaacaaagtgaagaatgatagattggaagtgggctattcaggaaaaaatgcttttctttggaaaccatggataatatttcagcttctattcttataaattagtctcagcaaagttgccacttatcatatgttcaatatgaagtattttccttgcctataagaaacactacaaggatgtgagtagaggtgaaacatagagtagacgtgtcccaattgtaccccagatgtgtttgtaaacttctaggtatggtttccaaagaaataaagctcacagaacttttattaagaacacttttatttctataaataaatggaaactcatcttcagctaaaaatatagtggcggctcacatctataatcccagcactctgggaagcccatgtggggggatcacttgaggccaggagtgtgagaccagcctggacagcatagtaagactccttctctacaaaatattattttaaaacattatttgggcatggttgctcatgtctataatctcagctactcagggggtgaggtgggaggatcatttagcccagaaggtggaggctgcagtgagtcatgatttgtcattgcactccagcctgggtgacggagcgagaccttgtctctaaacaaaacaaaacaaaacttggaaattctagatatccaggtatttattcactaccacatagcttaactgtatttccttattattttgtctctagctgaagttctctggaatggtcatgaagagagaaaacatcaaagattaggaaatctatcccaaaaagatcacaaaatcaaggacagtgacacctttttgagctttttacttgactcttcctgtttttttttttttccacttcccttagtcattcactaatcagttctgctttagaaccattaaaataatagaaaagttacagaaacttggtaaaatgtttctctggcctatttccaaaccgcccaaaattaatgggaaatggttaaagtcaaaaaagctttttctctgacatggatttctaaacaatataattatggttcactccatggttatgagctttgggagctcccacaaaaaagtctttgctgcagatgtggccactggctgctataccaggcaatttgattcatgtttgttgttgttaaaaaaatatataaaactctcttatgttggattaagaggcttttaagaggaagctagacagaaaggccaggtctctctctatttgctcattcatgacaaaggtggaagcttcaaatttgtgatacatgtgaagaaggtgtctgttacttcgtgttacatttttgccttcagaattattgttttcaatcattctattttatataaatgcacaaaaaataagtccaagctaaactagtgatgctgggtcactccaagaagtgtcctcaatatagcttcacaaatttacccttttctctccaaatccacgtttatttcttgagacagttatatgatgttttgccaagaaagcaactgggagcaatgccttatgtttaactgggcttttagatttgagaagcaatccaatccaagacttcatgataagacttccacagcaattggatattagtgacatataaggaccttaagaactccaccattttatactctatataaatgtatgatgtggtacacaaagtattaatcaatacttcatgagcatagtagctctgtttataccaatttctagcaatgtacattaggcaattttgtagaaaaaatataataattgaaagtataatttaacttccactccatgaacacttagcctcttcataccatcctcttccaagcatttctttggtccttggaaaatcagtgaaaaatctgaaaaattgggattttgtgtttgattatatgtacatttactacaagtatactgggctttccttttctgatgctatagagatgaactatagctttcctaactcagtcttattattagccaggtccagtttatattagttaaaatgaacatcataaatttacagtataacttatctggtacattccttctattgtagtttgaaaatgtgccattcaggactgaaatgacttaaacataatcagattttatttctagagaagtaaagtctatacttctataattctgtgaacccatcagcaattaactttgtcccagtagaattaatatagtgttcaagttcaggattgagtagatgagaagaggaaggaacaataaaactcattcactcccatgctaggttctgcaaaatagcttccatattcccataatgtgatatttatcttccttataatagcacatttaaagtcagtaaccctaaaaatctcctacataaaggtttgcatctttccccttaaaaatgtacagatgagcttgtgataaagagatgatgtctcctgccaaattgtaatatcatatagaccagttccaggcaaagtattgaagaagcagtcaaaacttcatatacctatctatccttgtcagcctcacgtattcatggatggggtcacagcttatccctttattctttttggttagaaagtctttccagatgaggtcatcattttcattactctgtttcttcctctctcactagagtgtctttctaaaggaaaccaaggaccacttcagtgaaatattgaaggcaggggaggccctaaatgattaaaagaaacaaagctttcccatagcacgtgtccttttctttgtaaggagatgaggtaatatataatcttcccacgttactaccacaagggcattttgtggcagggagagatggatttctgggagtgaaatccaactgcaaagcaagggctattttcagaagggcttatcttcaatatcctcatttcagaattggtctctttgctcagagcaataccttgggcaacactgagaactcccatctctaaggtaagaataaaagttatttcctcattgatggaatatctgatgaagaaaaaggaagacaaaaaacaataaattattctcataaaaggtgatgcatatgaataaatgtcaaatccttctagtatttctcatgtggcttgtacacaagacttctatttgatctttggctctgcagtttctaccactagatgacccacatgtgtaatctggataggcagctagtttgcttacatataaattaaatagcctcaagtgtcagcagatctctgtatctttttaatatcccccaaactgcttcaagtaggaacagctacaaagaaccttaccaaaggacatggaattcacacttgccaaagaaatcactgcacgtgtaaattagaaactaatcatcacttcctctctggttacagtggcagctttgcctcatagtttatgttgaaatatacatttttatgaaatatttctcactgtagtcagcatcaatttaggagtatcaaacactaattcccagctccagcataccagaaaactagagacagagaagtgcagacaaagggaattgacaaaggcctggacttttcttatacttgaagaagctaattgtatttgtaaatttctggttaaaaacctgacaattatcagatctgccactgcaaggctattcctcaatttcttcatcatatatttttccctaaagtctctcagagaagtaaagggcttctagagatgaaaatgaacttgacaatcacgttgcaactcaaactgatcttgattcttttcgtcactttttaatttattgcagatggtgtaaatgggatgtttactggttggcaggtaatgagtcttgttgtagataatagtgatggacagaatctcacgcctgtcgacatcccagcatctcagcagctatatatggttatcatccattgctttgaagcacatataatattgtgacaggatgcacaatatttcccccatagaaacgatgattggtacacctgaatctcactagttcacatgtcatttgtcctgattccatcctcactgtccacatgagtagacattctaagatgtgatctaatggaaaatgtaatctgtttaaacatccaaacactcctcttccaaggtatcaccatttatcacaactgtcagtgcccctgtggaagagtaatgaccctcaggcatgggataatgctccatagaggccttatgaatgccactgtgaaacacagaaattgaccagttttcagttgggctggtatgtgcatcatgaaagatctgcacttactcactaaattacaagtggctgtttaccctttatacaataaagtctaggttgggaagccacagaccctgctgacttcaattgtcccaaacatgtgagtactagatttggacctgcctttgaaatggacttaagcagcttgaaactggaagttggatcacagtcattcaaaaatacattgggagataacataggtgtcattgccttccacttttttgcctttttaaaaaatcctctctatcaatggaggataacaacatctcactatccactattagcaattaaaaactaaacagggtaagcatgccagtgaaaagttaactatttgtttccttcttgtaagcttcccttcatccagaagaaaatctggatctggatctgttcatatattgtttctacaaagcagaacaaaggtgaacagttatgtggtatgaactcatgattttcaggtccctcccaatgggtccatttcctcattgacgatttccttgaagtcccctgtaccttcccaatcttatctacattttctatgaagtcaccttagataataggatcacttgcactctaagactgtttacatctcagtaaatgctctatcactatgaaagtttcatctaaaacatatctattcctcagtgctcagacaccctgaagatacccttcaggatgtagcatccatatgaagtcacaaaataccagttgatcttcccgtggaaattgttttccaatctgtatgaattgaatggctcaactaaataaatgaagaaaatgaaatattttactcacagtgattcattccatattaagaaaatacactaagtaatgaatggcccctatgaaatcattacagttatgagcatcttttctacttgacagatctctgttcccctcgcagatgagttatgccaacctaactatacttttggtattcacaatattctgattattagtatctccaaagatgggacttaagacactttcctgagaagagaaatttacaattagatacatcttaacaattaataaaattaatgagataatgaaataagaagctctcagtatactgctgaggatgcagaaatctttttgagaattaggaatgttctagaagacaataaaaaagatcagattgtgaactgagcaaaacaacctttgatgtgaagtgtcagccagaaatgtcaatccaattcaagactgcatacaaaggggcactgtgtctttgagctgagaggtattatgttacctgattatcttctctggaagaatgcattatggtttagacacttttattacctgaaagatgtagacaaattagggaagattaacaaccagttttattaggaagtagcagatgagctggtgtgaatggtactggttgttatgagttctgtattctcttttcagctttgatatgctctcatgtgggaatagtcatccttgaaatttagataggataatttatattcttttccccagagaaaagacagtttgggaatgaaagggaggggaagtgtttaaaacagcacaagaacctgggataacagaagggtcagaaattctattatagaatttttcaactcccatttacaaaaatacaaccaacaataaccagttcttaagcctttatttgaataagctcagtacatttagtatttgcagtatgtttttcatatatagtacctaattgtttttggtccacagaataaggctattctatgatactatgttattatgttcatgttttcctggaaatataatttgcaaggtcattctaggaactctgattatgaaattcaacatcactttaagtcagttaccctgaactctaatgcagtttcttgtctcttcatacttaccctggagctataacctatagtcttatagaagtgcccttttcaaaaaggctcccactccttgccttctgaatgactgtctagatatattttcacctgtaattgcatactacaccaaatttgcattatatatgaatgtgattgagaaatgattaagataattgtttagtttattagtgaaaataagtggtatataagctaaaataaattattatttttacacatggcattattcctagttgtatttattatgatttaccatttactaaagtatttcagttggttgacaaggaataatagcactaaacttccttcaagcaatactggtgactcactacagccctaatgttaatacattccctcagacttaatcttttaattctattgggaaacacctataaacacaacagaattttttccttttctgatgttcattcaaattacattacctatttccaccattcagtgtagtaatttctgggaactaccttgaggggtggatggtggtaaagaatcaggacatttaaacttctattaaaaagggacagaagaagactttaggtcacctgtgatcttaggcagctttcaggaaacagaggaagcacacttgtgatgaaccttcataaaattggcccatattcccaataattcccttacctattgagattcctggttgctaaggactttatcagttacttcaacaatcctccctccccgctaataacagtacctcatttgcgaacaatactggactgtactcacaattccttttccccttcctttcagaaagaacacttttacgcccctaaatagtcctataaatggccaaagacataggacatgctacatgattcatctcatgaatcagtttctgttctcttggctgttcaacaaaagacatttcaaattctccacgaggcaatgtattacactgccatgagattaatttctgtcttcaactttggacatttcttaactattaactgggattacttcctttttgctcctctacaacccattctctacacagaaactgtagtgatttctttcaatgtgacattagattctactacaaaaatcaccaatggctgcttactgtaactagaataaaattcaaacttctcactctacagcctatatagtctggttcctgattccttctctgaacacatcaccagtatacttttccttattcactgacctgtcataattcacatgcctagctcacttgagcctcaaggcctttgaagttgctattccaatttgcctgaaatgattttccttcacatcttcatatggctagtttctaacatcattcaggtctcaaccaaatgccatctccttacatgccatccgtgtgagattttactcttactttcttcatttcattcttcattgtgtgttagtgagtttacatgtttattaactatctcccttaactagaatgttccagaaggaaggaggactttgtgagttctgatcactattgtatttccagtgtctggaatagtaggtgctcaacaaatacttgctgagtgaatgaataaattaatgaccaaacagtaaataaatagtaaacaaggccaatatcaatgctctttattacagtagttatttaaatgtacctcaaaatgctctaaaaataaatatgtgctttccctgcacattaggattaaaagtactcattttactaattaaaagccaggacctcaatttacattaatgactggtccaagatcatatggtaaatacgtattgcacaattctggtctgaaatcttgttagcccagtcagtcctacagtgatttacttagaacacaattgtgaaccaggtataattaatctgaggtccaccaataggcttgagggggtttgtgaatcctttgaaaaggtattgcaccctcttttgggaagagggtccatagctttcatcatattatcaatggaagccataaactaaaagaggctgggaatctctttaagcaataccattctgaaacaaattattcttaacctccctaggtagattggaaggctgctggcttcaacattttctgtagagaaggaacacctatgaaaatcctatcactggctgagtagacatattttcctttccagcaccaactctggggaatggtgggcctcacaggctggctaacccttcttggagttcacgggaaaaagatgtctagttcaaagacgatgagaagggaggtatcattctaatcatgtggaaagcccactgtgcttttagtttgtgtttgtagcattcttagcttaatttcagggatgttattgtagctgtgaagattagataataataagaaaaactaattcttaggcaccagacagacaatatgaaaaaaatatataattctaaatgtaggtcaaattttatatttatcagcattgatgcagtgttgttttggtctgttcttaaatttttgttttatgaaaaacaatgaatgcaataatcttctaatacagtgattaagaaacagtgtatatttttccacatactatcaaagcagagtaaagagtgaattttgccatgggaaatagtgtattgctacagtaagtaagaatattaagtttaccaagtttttctagactgaagacttaacaataaataaggcacatcttccctgtaaggtttctcttgagtctgttacttttcagtagatgatgatgatgacagcaacagcagctaacatttgttgcttattatgtaccaggtcctgctctaagtgctttacatttattacttcacttaatcctcccagcaactatgtccatgaattaggtattattattatctattcttagagatcaggaaagtcagatgaggggttatttaacttggtaatgaggggtaaaaccaagattcatatcccacctgtctgatgccatgtccaagcctttcaccactacactttcctgtctccctctgtggtagtgcagggatactttggagatgtaacacatcttaattaaaaatactttattgctgaaaagtgctcaccaccctctgagctttcaagattaccatctgagtggtaatctttttgctggtggagggtcttgctttgatgttgatggttgctgactgatcagggtggtggtttctgaagcttggggtggctgtggtaatttcttaaaataagacaacaatgaagtttgccacatgattgactcttcttttcacaaaggatttctctgcagcaggtgatgctgtttgatagcattttacccacagtagaacttctttcaaaattggagccaatcctctcaaactctgccatcgcattatcaaatgagtttataaaacattctaaatattttggttgtcatttcaaaaaatgttcacagaatctttaccaggagtagattccatctcaagaaactcactgctttgctcacccataagaaactactctttacctgttcaagtttgataatgaaagtatgaaagtacaacaattcagttacatcttcaggcttcacttctaattctagttctcttgttattttcatcacattatgtacagttacttcttctactaaagtcttaagtgcctgaaagtcatccatgagggttggaatcaacttcttccaaatgcctgttaatatttatattttgaccttgtcccatgaatcacaaatgttctttatgacatcgagaatggtggatactttccagaaggttttcaatttactttgcctatgtcgatgatagaaatcactatctacggtagctatagccttatgaaatttattttttaaatataagacttgtaaatcaaaattaccccttgatccatgggctgctaatagatgtcgtgttagcaggcatgaaaacaacattagcctctttgtacatctccatcagagtttttcggtgaccaggtattgtcaatgagcagtagtatgttgaaagaaatctcttttttctgagtggtaggtctcaagagtgggcttaaaatattcagtaaatcatgctataaacagatatgctcttgtcctggctttattattccatttatagagctcaggcagggtagatttaacataattcctaagagccctaggattttctaaatggtaaataaacattggctcccagttaaagttacctgctgcaccagctcctaacaagacagtaagcctatcctttgatgctttgaaaccaggcattgacttctcctcaatagctataaaaaccctaaatggcatttccttccaagtagaagactatttcatctatattgagaatctgttgtttaggtcagccaccctcatcaattatcttagctagatcatccagataacttgcttctctatcagcacttgatacttcactttgcacttttatattatagagatggcttctttaattcatcttcatgaatcaatctccactggcttcaaacttttcttctaaagcttcctcacctctcttggtcttcatagaattgaggagtcagtgccttgctctggattaggctttgtcttaagggaatgttgtggctggtttgattttttttttttttttgagacggtgtcactaggctggagtgcagtggtgccatctcggctcactgcaacctccgcctcccaggttcaagcgattctcctgcctcagcctcctgagtagctggaactacagacacgtgccaccacactcagctaatttttgtatttttagtagagacggggtttcaccatgttggccaggatggtctcgatctcttgacctcatgatccacctgccttggcctccaaaagtgctgggattacaggagtgagccaccgctcctgtttgatcttttatctgcaccactaaaactttctccatatcaacaataaggttgctttgccttcttttcattagtgttttcactagagtagcacttttaatttccttaaagaacattttctttgcatttacaacttcattactgtttagtgcaaggggcttagctttcagcctttctgggccttcctcactaagcttaatcatttttagctttttatttaaagtgagagataacgtgactgttcctttcacttgaacacttagaggtcattgccgggttattaactggccttatttcaaaattatgtctcagggaacagggaagtcccaggagagggagagagatgaaggaacagctagttggtaaggcagtcagaacatataaaacatttattgattaaatttgtcatcttatatgggtgtggtttgtggcacctcaaaacaatcagaatagaaacatcaaagatcactaatcacaaatcactcaaacaaatataataatgattaaaaagtttaaaatattgccaagaaccaccaaaatgtgacacagagacatgaagtgagcacatgctgttggaaaaaatggtgccaacagactcaatacagggttgccacaaactttcaatttgcaaaaaatgtaatgtctggaaagtgcaataaagtaaagtgcaatagaaagaggtatgcttctatatcctattttcaatacaaagatgctgggtagccaatttctaccactgtctttgtctatttgacaaaactttcccatgacttttatactgttaacttttttgaatagcagatgagacacatacttgcatcctcaaatctgcaaagacaccttgggccagtttgaaccgaatcccatttttaactgaaaatgatgaaaataaggtacattattagcctgaactttgcataactctaaaatgtattaatcttcggtaaaaattttaatcttagttttagaatcctcatgaagtacttagaatgtttaaatgagataacactgggtatattaaacattatgaaattgccatttctgtagcttaaaaatggtcaattgttgccacagtcaagtgattaaacctaaggtaagtaatcaacttaccttattaagttaactgctattgttgtaagataaattattctcactctacaatcctccctccctgaaaacttttctagtctggaatgtactgctgataactagtgctagggacatagggttgaacttgcccatgattttaatttgtaatacataggcttttaaaattcatatcatagcaggtatacctccaaatgatgccacaaagacagcctagaaaatgggccttagaagattaagttaataaaggcttattatttttcctatagctggatgtactcttaactagataactttcaatagaaatcaagttcatgaagcaggttcatgggaactgtattagtttcctatcgctgctgtaacaaattagcacaaacttatagttctggaggtcagaaagtcctaaaatcatggtatcagcagagttatgtttttttctggagtctttaagagaaaatccctttccttgagttttccagttattagaggccacctgtattcattggctcatgatctattcctccctcttcaaaaccagcaacgcagcatctttcaatctctctctctctctgacctctgcttccatcaccacatctcctctgtgatcctcctgcctgcctctttcctttaaacggcccttataatcatattaggcctaaccagataatctggcataatcttcccatctcaaaaatccttaatttagtcacatctgtaaagtctctttgccatctaaggcaacatactcacaggttctgaggattaggatgtgaacatcttcggtggggtggggaggggggcattaatctgtctgtcacagagaccgaaatattctaggtacccaaatttcaaatagcaagcaagatggtatcttatttctttaaacctcatagcatggtaagctgcacagacatttttacatataccctcataatttttaaggagattgtgatgtacaactctccagtttctcttctggcacaagtgtgtggaaatcatggtcttagctttggtttgtagaaccagattttactcctttacccagttttagtcaatcccatttatatttaaatttgtcctttttgagcattcatactgctatccttagccaaagaattattagtacagtaagtgctttctgcacttccttctcctaactctaggaataaaaggcacacgtgtttagctgagaaccaaccaggacagaattctagcacttctcattacatctttcttgtgctcttccttcaggcactacattgacatctcaataagcaaataacaccagcgttgcaggtgttaacaccaatgactataccatgagaaattcccttatgtcacgccttgcatgggtaaagttaactcaaatgtcttccttctcttacctaaaatatctgcttgcctgacctacatctcccttgtccattgtttccaatgaacactaacccttaaacatttaagcctcatcagcacatgcccatcataacagcataacatccttgtcctgctggaaactattcagcatccagaggaccatctttatgctgataacactaaaatataaaataatgccaacagctggtgctacaaatggcttttaaaaacgatgttcattcactaaaattcctcttgctacttttgacatgaaacacgcagtctctaattattctgatcaagacggtgaaatacaaaaacaaactttaattgtgtttaacagatatttaatcaggactcactgaactacagattaaagctgaaattcataaaccataattacccgattgtcgcaatcttttggtccacattctccttccgtctgggcgtctggcaccttgccccgaatttcttttactgtcttctcagcttcattactgttcatgttttccagcagagatttagcacagattacaaaatatctgttcttggcaactttcttcattagctttttctccccccttgcaaaaagtttattttcttttttctaccagagtagctggaacaggcatacgtttagggtgctttgatgacacaaactaattatatagttatcaggagataatacggtagcgataactaaagttactacagttatcatgtaggtatcatgcaatttctccagtataccatgcggtgtgtcccagtcaccacgtaattacctaatgtcactactgcattgtttcatggaaaatgcttatctcaccccaacaaaaccttttctgccacatttagagaaaaaaaaagaagtgaaattcttagttctcatatccagtactgctcattcccagtaagatgttgtcatgcaaatgtaagggaaacacctgccctctcctgaaaatttgctcttacagggagcaaatggagcaattattattattattttttcctgcttcactctttccaggtaaaagaagtaattaccaacaatacatacattttttctttttttttctttttttaaaagaaaccaatccccctaccgacccccgaaagaaacaccctatttacttaggattcgtttagtctggcacttcccccctatactctttcctttcaaatttcagtcactcacatttgtttttcctagaattatggtgtaaatcattcttaacaagctaacttgaaacttctctcactcagtagaaacacaaaatgccactgtaattgaaacacggaagcttgaaactctttctaaccagttcttttgggccactcttcagaagggcatgccgagtttccctcacagtgcggtaacccctgggtcacacagcgaggataacatcacagaccaaggcaagaggataaagagaaggcactggctaaagaagaggtgggtggttcctttattccccccagttgggcagtcaaccctatgaagcaaggactgtagttgctacttatttatctcaagttgatggcttgaagtctgacctcactaagacctttagatgtgacataccacctgagagttccagtttaaaacaggatgtagcagcttcctttgcagcacaagttgaaagctatttccaattctgcttttattagtcacctcccaatctaagagctgcccattcaattgtacacttaactcatgtcggggtaaaaagcacctccagatttagaagggccagaaaaattgctatcctatcctagcacattgttcttcaatcacacagttcctctaaatacagttgacagcctttgagatgcaaaatgtatcactttaatgtagtagaggtccccttcactgcattgccaaatctatttagcagaatcttcttggaataatctgtccctagacctgaggatgcacagtgatttcaagcattttaagctaatgataatggttagtgctgagaacagatgtacctggctgtgatgtgatctattccagtaggcttttatgagctgttcattcctattgacttagcattttatgtctgtgcttttgcctggtgtgatggttgcataggggtgtcatgtgtgtattttcctgatgtgtgatggctgcacagggggctgtgtgtattttctcagtgcaatggccacacagggtgttatgtgtgtgtttgcctggagttatagctgcacatgttattgtgtgacttttctctctatttgatgcttgctcgcagggtcctatgtgtatctttttcttagtgtgatggttgcactcaatgctgtgctaatgatggacatttctagcaattatctatctacagggtcctcgggaaaaaaattgcagtgaaatcaataaacagtgctagacaggcccttgtaaatatgaaatgacaccatgcataaatgccgtttcctactatagcatgttaaaatccaaattctgttatgttattggcattgggataaaatttctatggtccctccatctccttcatatattgcaatcttttgggggaagttgagattactgctggttggagggcttttacacatgcatctatgtaatactactttttgctacattgtcctacacatcatctcttatactccattctgacttatcctggcataatagctgatattctaaaagtgaatatgcctttcatttattccttcagtctcaccaagccctcccccatataacccctacatcacacatacaaaaccccctcgcttgcctccctctctctagtttctccgtatccctcctgtgttcaccaaacggaactgacaaaggaaacaaccaatgaggttaaaatcttttgaaacccctggaatacagatgagctgggaggcatctggaaacaaaaccagacacttgaaatcaaagagacaagtaaattactatcctaatctaggaagaataactaaaggtgtcagtggggttccattgatagcacttggctctgggccagaatgccaagggttcaaactccacaccagctttgggctcaggcccaagacttgctactgcagggtgcagcagcatgtgcagcagtgttaaaggtgtcagccttctgcagagaggttaagtccaagtccttctgcctgtttgtcattacaccccagagagacggagagataaccctagctttctcttcgctgcctttctcaatagaacaggctgaggaggaactagtgctcagcagcagtacttgctagtatgagtactatacaactaattagtaaaattcccctctactgataaggctgcttgaagtatgcgcaagaaaatccactgtccctctccccccacgaaaaacctgatgtttgtcctaaagattcttccatcaatgcaaagagctaagtttggaaacctaaaaccatgtgtctaaaagaaagaaaatgttttcattggaacagcttacatgtctggtacacttgcataaaaactatcgcatagcattttagagctaaaattgctataaaatgcttaatacagtaagagtaattatgagattttgcatgcacagctggtatacaactagagtctcagccacatattcaatggagcatgggaaaaccatttataaaaattcctggtatgccagtttaactcaccatcaacagcctatcaacacttcattctttaagtggatagggaagatatttacctaccaaatgctttatttcttctctcatggatgttatcaatacttgattcaaggaatttgagttattacttagagagtataaatataagctgttaacaggacatgaatgacctgaatgcaagccttctccactgagtgaagaagttacaatgatagtagtaagtaatgaaccagaagaccaaatcattaaatctacttgtatcttccctttttaacctccgctttttgctatatcttcacatattcttatctctcttcatttctctaagattcaaatcctcgggtgagttcctgggtactctggactcccctgccatagcccacctggccttgccttcccctgagtaacaccctgaagacagagctcttcgtttacattttcccccaatcaagttataacaggtatttgttctccattccctttagttccagctacatcacttgaaaagaaactgatttgggtgagttgttaatggttaataataatttaataaagtttatttcttgatgaaaacattgattttaagagtcaaatgaagaacctctttattgtggtcttttaggctctatggaaaatgccataataggtgagatgattctaatcagaagcattgatggatgctccattgcacattttttagccataggagccagtggatagatgggaattcccaggtggacaggaagtttggggtcacaaaggcagcatgacacaatacaaaatgaatttgaacagaatcaggaaactcaagttttaggaccaacaaactttgccacgaagtgtttggcagacattcagtttcttaacctgagaaatgaggcaggccctgggatcagaaactctccatgatcctctctggctcttacattctatgactctctgaccgcagatcagtcaggtctcctggattagctaccacctccagttaagaactaatagttctgaataaagatggcggtcattccacactgagccaacctaactaaagaggtgttgatgtccataggtgagttttacctgtctgcctacaacctgcatacactacttttgagttggctcctttatgctatacagatatttcttagcattttgttttccctcatttacttaattcagcaaacatttaatgagcactttctatacatgaaacacagagtcgatcactaaggacaggactgaacagggcaccatctctgttgcacagatgattttattattcttgtccattctctctctctctccccaccttcacttttatgcataaacacatacttctagaactataaaagtagtatagaaaaaataagaggaattagacttatctgagccagtctgaaatactgtttattttaaacaaaagaatatgataataatttgtgttggcaaaatatatgcattcaattacgcacttcaatagtataaagggtatttctcaacatgtattttgaggtcagtaatttgcaataaggataacaatttgggggaaagaagattataaaggtaaaacattcccttctgtagaatcctgataaagtcctaggataaaatctgtgacttgtgtaaataacctctgggaaagtgagatcatagaattttttttttaagtttttgtttttcctctaaggattttgggttcatatccctccaaattttatttcctgacttaaaaataataactgccacttattgagtaaatattaaattccatgcacttcaaatacattatttttataaatacagtatgaaatacaatatattaatatattgtataatacaatatgatatattataatacattgtaaatattaaattcaatatattattaaagcaactctgctagatagatattattactctaacagacatgaaaactgtgggtcagagagctgaagtaacttgtcaaagataattcagacagtgtgcagagttagaatttaaactcaggtctgtatttgtctatgcaatatggctccataaccatttcttggttctgctgaatctaactttattttaaaaatgaataatcttgcttgaatgctttgttagcaaataaggaaagcaccctttttactcttccttcacattcattcattgcattacatatagtacaatgaaaacaggagatggttaagattttttcaatgcagatctggttgccttttcatattgatttggactgagataattaaatttgggctctcaatcaaagtgaaagaataagctatttgctatctgaataagtatttcttattaattgatcagacatggataaggtgtgttattacaactatatttgtaaggtatgatttatgttgttctactgcatattactctgtgctgtttttcattttcttgcactttggactttttgttttgtttttatgaatttagtcacagttggttgtgtgttgaactttgtaaaaatgtaatactaaggaaattaaaaaaagaaagaaaatattttcaaaatgatgtcaaaatcaaatctacccctcactaatttgatttgtaggaaatggagaacaaagtattagaagcagaatgcttttaaataatcctaattacttcaatgtgcaaatgcattgactaaatcgaagcatgcgtttaacactttgcacttcaattgtgcttattcatctaagttctatagatagcaattctataaaaaacaagagatatagccagccattccatagttattgggggaaaactattgttctaaaattcaagcttacctctcaagtcagcccacttttggactaacgcagatcattaggtcaaagaactcaaaataacataatttactgtaactactcaggttttcccaattgactctgccttccctattctttttttctgccttcagcggggtggggtgaggacgtggaggaaggaaagcttctgttaacaaagccacagagtggaagcagcaaggcttttggtagtcaagccacacagcattaagcagggccaatcttaaggaataatgccatggggttagagtggtttgtgatcaaggctgagatggagtcatgatggcagggtaacttagtacctggtctaggaccagctgcatcagaaccacctgctgagcatgttaaaaagacacatttcagggtctcactccagagcaaaccaacagaattagtatctcttgaggtggaactcagatctccattttaaacaggctccccaagtaattcttatgctacttaagcctgaaagcactggcatatgcacttaagctctctaattctatatccagcgacagccctgctgctacacctgtatactctgtcccagtcttcaagacatatgtgcaagtccaactacttgtcctgggaggcattaatgctaataataatggcccaagggcttagctaggcatgatgttatttgacatgcagtatctcatccaatccccacagcaaactacgagacaaagatgattactattctcatctttcagatgagaaaactgaaattcagagagacttagtaacttgttctgggtgccacaataataactgaaagagctctgaagaactatactactgtactttaactcagccctgcagaaaaatatcttgaaagatgtttacttctaaaggtgttcataacttggtgatatcattattccaaagaaacttgcctagatgctagtaagatagattatggaataacacacaaagtgtaagcatttctacccaaggaacttttccttagattatttcatagagacttaaactctcaaaaactaggctaagaatccttcattagttcgttcaacaattatgcactttgccagaacctgaggtatacaaagataaacaggacatagtctctgccttcactagacttacagttctgaaaaagagacaagcttgtgtacaaatggttctgggttaacttatacagtcagtggaggcctgagggagagagagtagttcattctcctggcagaaggaaaagagggtgaggtctgtaaagttttagttactccagcactatgccattggctaatgtaaggaacttagattttaaagattatatttttacttgtacagttttgttactaaaggggcagactaagttacttgtatatttcgagccaataaaactttatctggttcattctctctggcatcaaactggttttcttttttgggtaaatttctgggtacagagccaagtaagttgttatgtttattcattcttacacagagcaaccgagattctattcttgaaatgagtgcctaataaattttatcagtagtactttattccacccaataaaagtggttcttccttgacatactgtgtcctttattttcacttgtttcaattactcagaatgctattattagatttgcatattttcataagagaaatttagaaattacaaatgattgaaaacaaagaacaatctagattctttcctttgtgataagagaggatgatcccatatacatgtaaatgtgctttgagtatgttaatcttagaaatgactgaagaaaatgacattctaaagaaaatgagggccaggcatagtggctcacgcctgtaattccagcactttgggaggttgaggcaggtggatcccctgagctcaggagttcgagaccaccctaggcaacatggtgaaaccctgtctctactaaaatacaaaaaagtagctgggcttggtggcacgcccctgtagtcccagctactcgggaggctgtggcacaagaattgcttgagcctgggaggtgtaggttgcagtgagccaagatctgacacttcattccagcttgggctacagagtgagactccaacaaaaaagaaaaaaaaaaaaagaaagaaagacagaaagaaagatgaaagaaagaaaagaaagaaacagagagagagaaagagagaaagggaaaagaaagaggaaaaaaagaaaaaagagaaaaaggaaaaagaaaaaagaaaagaaaagaaaagaaaaaaatgaggttctggaacatcgaagttcaggctaatcacttaaggcaaaggtacaaggatccaaaaaagaaaaagaaattatgaaatatgatatgattcagtttggggaaactgaaaatctatgtatcccatattttagtaactgaataaattggaatcatacatgtattcttttctaagttgaattattaccaaatttgagattcagtgtttagattatttactgcttgcttaaaacttttatttttcaaattatcagagtatttttcaagcattaagaaagttcaataaaaaggcaatagaaatatcaagtaattccaccatacagagataactcctctttacatttgaatgtattctcttacatcattatcgaatactttcatttttatatttgggattgttttaggtatatatatttatttgtatcttttggaccaggaatttttagttgtgttattttataaacttttcctaataaaatattgtttaaaataactttaagaactatctaatttgcatatatgatatgtggtgatacatatggatattcaataatttaataatttctcgaattttgtaatttaagattttaaaatcttttttctcttttataaatgacattgtgataaacacctctgtacctaaatctttgtctgagattctatttcctctagacagatgcctagaagtaaaattaatgggtcagaggacatatttttaaagcaaggttctggataacataatgctacattactttgcagaattttgtgtcaatatatagatatccactatcactatgagtgtctatttcactgtaccattaccagcactgaaaattactatttttcataaatcatgactttgaatcctagtgaattatactttttcatgtttattagatatttgtatttcctttcataatttttctctttatattctttttagccattctatttgactgaacatatatctcaatatcttcatatctgttgcttcaacttcatttctgattgtaacaccatagtctgagctctccttaccttgctctgaatgatggcatcatgtctgcctggtctgtattccaggtttctttgattctgatttattctgcacactgatgccgaacagttattttgaaaatatgctttcatcatgtcagtcctgatcaagaacctatgacagctcctggttatttatctatcagctacattcaactgcctcattcaggggaaaattcatcccattcttggatattcccttatgagttctgttgaataatttaggttattgctatatggaccctatatgcacttacgtttttataagtgggtatttctatataaagacagggagacacaatgtggagtactagaatacaagaactggaaagggctttaaagtacatcaaaaccaactgtctacatttataaataaaaaaaagtggcctacagagtttaatgaactacccatggtcatggagccaattaaatgacagaactaggactagaaactaagttgcattattctcttttagtgacttttagatagagaataataaaagtcatttttacaatttaaaaaatagaaacagctaggaaggcagtttaatttcaatctgttgttatgtataaaagattgttaaaatcatgccacatagaaggcttgagtgttcttttaacatgaataatatgtacttcttataaatcaatcaaatgtatcattagaatttccataaaatttgcacatctgcaaatgacctagtttatttatactttgctttttcccttgctaatctatattgttttatttaatctgctttgccacaataaaagcacagtattttttatcctagcatattgcagattttcactaagtttcttaatcatatcaataaaaaatccaattttcccagcaaattcatataaaagatttcttttgactatagttagggatttgaagaactacctttaaaaaataaaaaaaaaaaaaataggaactacttcaaaatgcctctatttaaatagtaaacaacacgaactattgtggaagaatgtgggctgtcatccatttaatatgatatgatgattgctatatatattcaagaatcccactgtatttgccaaatgaaaacttaacggtagtcactggtttagaaacgagagttaccaaatatatttattatttgtggaagaggggtagggcataagaggtaaatgtggaaatagccatgaatggacctaactttgatagaagctcactgatttcaaagggctgattaacaaagcatgtgtttgcctaacaaaataattgacagaaaaggtatttattaaatcataaggtgattcaactgtttataaaatacaaggtttaaacaaaatggtagttcatcagcagcaatgagagctcagctatgttttctttctccgtgtgtgcatgtgtgtaaccaaacaggtccaccattcacttaacactcaaccaatatttattaagcacctactttgtgctagaaaccctctactatccaaaataagtaaccctgttattttgttacagaatactcgactactctggactgctgtaaaataaaaattaataataatttagccgggcgtggtggctcacgcctgtaatcccagcactttgggaggccaaggcgggcagatcatgaggtcaggagatcgagaccatcctggctaacacagtgaaaccccgtctctactaaaaatacaaaaagaaattagccaggcgtggtggcgggcgcctgtagtcccagctactcgggaggctgaggcaggagaacggcgtgaacccgggaggcggagcttgcagtgagtcgagatcgcgccgctgcactccagcctgggtgacagagcaagactccgtctcaaaaaaaaaaaaaaaaaaaaaaaaaaaaaaaaaaaaaaaaaaaaaaatgtatacctgatataaggtgttataacaaaaataataaattgagtgataagaggagacagatgaaacagcatcctaaatttctcatttcatgtaggatactacttcattaatgacaataattaaacaggcttgaatgtttttcagaaaaacaacagtgattattaccgaaagaataaactgtactttaaaacttcaaattgctagattgataaaagctaaaaaggtaatcacacatcaaaaaagacagagagtgagagtgagaaagtgagtgagaatagaccaagcaagcataaaaacatagaaaatataaaaaagatttatgagatagtactagatatattttttataaaacgaatattagttaatttaattaacattaaaaataataaccataataatgttaaaagataacaaaacataatttaaccataggatagcagtttaaggacactagctttggtagcaaaaacaggattcaaatattatttctgctatttacttgttataatctctttcctactggtgtatttatttagactatttacctcaactttctgctctaaaaaatggaaataagaataactgaacgtagaaaggattgggaaaaaataatatgtaatgcttagtgaccagcacaactaaacattcaataactgtaatttgtaatattatgtgttttaaatgatgtatctaactatgtacccatataaatttaaaaaaaaagaaaaaaatagaaaaatggtgctgatagattttctcaatgcagagttgccacaagccttcagtttgtgaaaaactcaatatctgcgaagtgcaataaagcaaagcacaataaaaataatataaaaaacataataaagagagataagaatcaaaggagtattgtccaagatgtattgttaccttaaaaattccgtgaaatataaaatgtgaaaatcacagaaacacagtcagacttaaaaagaagatgattagttacagaaagctactaaaagcagcccatggtgctgaagccataggcctgctgaaatctggatctagaatcacatcgagatacctagaattccagctctttagagtaatgaggtcaaagaggctccatttgaaatggtggacctgaacctggcttactactttatcacgaggctacaaaaatttggccaactactgcctggggaaacagcttatatagggctgcaggacctgagagctggaagaataaagatacagcattatgataaaatattcatataagaatgaagctgaaagctaccattgtaagatctggattgggactgagaagatccagataaaggcaactgtaaaacccctagttagggacatgtgaacaaaacgaaacaaacaaaacaaaacctgtaaaacaaaattctaaagcataaccaagtaatggtaagaaaatcaataattgtaacattcactccagataaatttgattttatgaaattatctgacaatgacctcagcatgaatatgcttgagatgcttagtgataaagtactcatacctaaaaaagaacaagaaatgattaaagatagaaataaaataagaataggtgaataagagtaaaacttaatcagaaatcttaaaaaattaaaaatgttcattaatataaaagtacaataaatgaaataaaggaatttcaaggaaagaattgagtgtattggaaggtaatgttaaggaattcactcagaaaaaaattgtagcaagaagaattaattttttgaaaatgaaatagcaattgagatactaatcagtaagctgattagaaaataccaatgtttatcttataagaattccagaaaaagaaaatggaagtaatgacaaaggaacaataaagaaaaggataatagctgagaattttccaaaactggagtcctgagattaataagtatatcctgagttcatgactaataattcaaaataaatccacgtccagacacatttcagagaaactacaagatatttaggatatagaataacttttaaaagctaccaggagaaaaagcagattatttataaagagataaaaacagattgatagatttctcttaattaagaatagttgacagaacaatagtctaagatataattgagtaatgtctttaaaatactcaacaaaaaatacccagataaattgctatttaagataaaaaacaaaataagtacatttttagttatatgaaatatatgtattacccaaggtcctcattaaataattactaaaaaaaagtaacaagaaaagtgcacccagaaaggaagccacaggatctaagaataatggtaggcatagtaatatctaaaaatattagtaaatataattaagcattgattatagacaacagtgatcaccacttttgaatatggttaaaaacaaataggtaaaactaaaacttcatacacaattatagtaacaagattgatacttaataggtaattaaaagatgctatgttaaccaccttttttatactaagaagaaggtcagaaatactaaaaggtcgattttatattttcttagaaaaatacacagttcagtatacacaaaagaattttagaattagtgctaaagaaacagataaaccacctacagatttcaagccagaagtaaaatccatgtaccagataaaatcacaaaataagctaaaaaaagtttttcaattaaaaccacataaaacacatcattttattttaatgcgtttaaattcagaaataaataataaaaatagagcaaatatgtttacaaagtaaaagcatacccttctaaatacctcaagggctaaaaataaaacagatattatgaaatatttaaaattgaacaaaactacgtatcaaaacatggtatgcacctaatgagaaaccaggagaaaaatttagagtctgaaattcatttttaaagataataaaaattattgaaagtaaaagggtaataattcaattcaagaatctagaaaaagaaaaatggcctaaaaatataaaaaaaaagaaggaatgaaataacgctaatgctgataaaagcagaaagtaatgatttagactacaaataaataataaagtagataagcagaatcaaaagccagtttttgtaaagaagtaaatgaaacagaaaaatgtctagtgtctaataaaaaaaagcagaagggtcaaataaatattaggaataagaggggaacataaggacaaaaaattaaaaatcataagaatatataaataactttgtacaaataaattgaagtataaactgtgaactgtatttaaaaaaaataacttcccaaaattgactagagaagaatcagaaatttcctctgtggttattggtttattctgatattcaagtctgcctacctacaacctactgatgaaaattaccaagttcagatgacaaatactcagaataaaaaatcccaataatgtgaaaactgtttaagatatagaaaaaaatgaaatgttactcagcttattttgtgaggccagtattgtcacagcaaaactctatagtaacagttaagaaaataaaatttaaagattgatctccccatgtaaacatactacatgtcagtaaattaaactcaatagtagattaaaaaatacaccaagagcaagaatattttttccaagaatataagaactgtttaatatcaggaaatgtattaatatcttataaaatattaacatagtagtggaaaattttatcatattattgatgcagaaaatgcattagataaaatttaactagtatttctgattaaaaacacttagtaaactataaatagtttaggaacatattaagaacttccttaatacaataatttcgatttctcaaaatcccaagcaaatgttatgtttctaaaacatttccattaaaataagaaacagaatagatattcttaatgtgactatcctattcacactatactgaggtttagtaatgcaatatgacaggaaaaaattgaacatttaagaattagaatttaagagaatgactgtcattatttactgctgacatacatgttgctgtagaaaacttaagagaatttaccagtttagttattcaaagtagtaagagagctcagcaaagttgctgaatatataacaataataaccaataaacaatgaaatggaaaacagatatgaatataataatgtaagaatctaagttatatgaggaacaattttacaaaataggttcaagaaatttatgatggaaattttaaaacatgattataggatatgaagatgatcacaaatagagggatatagtatgtcactgggcagcaagacacattataaaaatgtcaattctccccagattattttctaatgttaatgtaattacaaataaaattcagcaagacttttgccaaacttgaccaactagccctaaaactcatattgaatagcaaaagaccaagggagctaaaagaatcttaaaaaggaacaaggtagagagacttatcttaccaagtaaaaagaatattataaagctatggtaattaagggttatggtgttagtacaaggatagaaaaacagtccatcggatcaaataaagatcatataaacagatttgatataggcaaaagatggcattataaattagttaataaagaatgactaattttttaaataatgctgggataactgggttatccatatggaaaaagaataaaatagggtgcatgtagggtaccagaaccaaaaataattccagaaggattagagatctaaatgtaaatgggaaatctttaaaactgttagaagaaaatacagaaaggtaaatgaccttggcatgtgaaaggatttcttaaatgacataaaagcacaaattatgaaggaaaatatcaataagcctagttgagttaatattaaaagctttataaaaacaaatactactaaagccacagttaaaagggcacctacaaattgggaaaaaatctttgtaatctctatggcccaaaatatgaaaatccagaatattacaacaacagcaacaactaataccaaaaaccaaatcaagccaaacaaaactcttccaaaataacaacagcacaacaaataacccaacagaaagatggacaaaagatgcaaattaggcaacacagaagagaaaatcccaatggcttacaactaaaaaaaaaaaaaaagttaatgagatattattcaattccgatcagactgacaaaaattttaaaaagtctgaccatcacaaatgttgtgaagcatgtggagaagctctcatagattgttactgagaatataaattggtacaaatacattggagggaggttttacaatacctagtaaagttcaaaatgcatatttcttaaagtttagcatttctacttctatgtatatatgtctataaaaatgttaactgtggtcttgtttgtgattgggaaacaattaaaataatgtccaacaatgagagaattgataaataaattttagtaatacatacagaagaatacatttcatataaaccaaaatatatagcttatgtaaaactaattcatgatgatagaggttacagtggttttgcttgttctttaccttttgttaaaactttggaaaatttcaccttcaaggggcacatacaaaggattcttcttaggtattataaatattctgcaccttgggttgggtgttgtcacatgtatactcatcaaggtatacacttaatttgtctaattcactgtatgtaacctataataaaataataaaaaataggttcagaaacaaatgttccaaattattaaacttcgtttaacctgggttctggattcttgtatttcatattatcctttatacttccatgtgttttaatttttttttttttttaaagacagagtctcactctgtccaccaggctggagtgcaatggtgccatctcagcccactacaacctccgcctcctgggtacaagcaattctcctgcctcagcctcccgagtagcttacaggcacgtgccatcatgcctggctaatttttgtatttttagtagagacagggttctgccatgttggccaggctggtctcgaactcctaacctcaagtgatctgcccactttggcctcctaaagtgccgggattataggcgtgagccaccatgcccagcctgtgttttaaatattttacattagaaaatgtataaggcaaacaccatagattttcctaactagaattaatcgaggtaaaggaaagcactagtgtcatcttctcttcactatctctgataatagagcccaatattagtaagcacttcacagccaaacatgcctacaaagtgattattttgttgaatcaaaagcaaaagttttcattcacttcttgactgactatagaatctcaggcttccttaagtgagtgaccagagggatatattgttgatatagacagatgctgccaatgcacaaagatcatccatttaggtttttcagttgatgaagtgaggcatgcattgccagactttacttacatgaattaacagaatcaacaggtgatttggtatcagtactgctattggctggcgggtttcacctctggtttcagaaaagaaagagatgataccttttcaatgctgcatttcaagtcaaccatatgaaaagcaaagttttattccagtcacttttctttctctcacattgtggaagaaaagtgccagccactgctactctaaccactaaccatggtacagatgtttgaaaaatgtgaaacagagaaatgaaacaaaaaggaaaccctcaaaaattaagtttcgcataagtgaaaaatacagtatttatgtatcataactgcaaaaagatcaatggacttttttctcatgtattaaacaaaaataaacacaaacattgattttttgacttagtgttttgttgaaaccaacaattacaaggaccaactcaaacatggctaaaagtgggaataaaaataagatttcttttatcctgataaaagattttttatcaccaagaacgttacagtatgacctacttaagtgaatacttattaaagaaacagattcatttaaaaaacatgtttttaggtaaataggaacggtgcaagtgtttctttgaaatcttacaaaagataaaaattaattgaactaactaaggttccttaccctatgcaaataagaaacggcttagaaagaaatgtcttcaaactgttgaaatgtatattccttagttggtgtaaccaatgtgaggtctcagttactataatagcaaatgttctattagatttaagcacatcagtgcaaattattaaaatgagactgtctttgtttaaaataaagctttaaaaaatgtaatgtaatctctgagggagtattgcctgaaatgaaagttttaggccgagctctgccacaatcctattgcgcatcttggttcatctgattaaacatctttgggtctcaaaattcacatacattcacatttctaaagtgagtgtgatataaagtcatagcttgatcatcaaactcctttctagccctaaaattctacgtatctaatgagattaatttatcatgaggtgtttttcttctttcctttgttaatttccttacaataaatagacaaataaatgatcaaataagcaaataaataaatattaaaaagacatacacacactgatagctatccatctgaataggaagaaagacttttttttgtttgccattatctatcccctaatgtgtatttaaaaagagagctcccacagaaaagatttttatttttttctaaatcaaaaatagtgtatcatttatttgccatttaagttctactaagaaggaaaacacaaaatcattatggaaatcctattaggaactttagaaagaaaaagctgatgaaattccatttacaattcaaattgttcattcacgtatttccttttgcagaaactttaaatgctgcctcaaactatcttcacctctttttccagggacaatatccctaactctgttaaaaaaaaaaaaaggctctcttctcacacccttcccacctgtcctctgaggtagttgttccacaaagctaaggtatagattacatcaagagatatttgggatgggagtaaaacatttcaccctggagacagtaatgtgtgcaatttgccaagtctaaaagaaagttaagcctcatcaccactttggcaagaaatgtggttctcatggatggacaatgattatcatttttacacagaacttttgaaaatgaaagtacctggggcaccagccagaaaataagtacgagaatgcaagttttttgcgtcaatatttaaatcagacaaaacactatcagtgtacccttaacagacctgaagcgtctagaaagaatacaaggcagctgacaccttggtgaataagagcagctcagttttatgaaaaggccaaagtcttagggcaaactctctgttgttccaagtgctgatatacctatggcatcaacaaaggcaaaacaccatagggggcaataggcaaggcttctcttacaggcaaggctcctgttaaaggctgggaccctctggactacacactcgaggaaccccaagtgtgggtccctgaggggaggaagtttcctcaaacagaacggcgagaggctgaagttacacagtgtaggagtactccctgctggcagctgaggttggaaatgaactggtgatgtcctagagagggctgcttaaattttctatgaggaggctaatggagataacagtgctcttgaggggacaagagcatgggtctgattaggtttagataactccagatattatgctgagtgaggaggaggttaagggaagctactgatgacaggaactccaacaattgacaaaaactatgtgtagagctggtatatacaattttcatttaagtttcccatctcatatcattctataaagcatacacagccgtatgtgcacatgtgtgtggggttcagaggatgcaggaagaaatctatttctgtgcagttcattttacccctgcaagaacaatctttgaaaccgtctaatgtattcacatttatgttttacaaggaatcccttccatacttctaatggacctgcctggtatgccccctgtaccactatacctaatccctaggcaggtggtctttgtatgggcctggggcaaccacactggtttctccccagtgctctgctctgttagggttcttctgcataataaaatgaaggtcaaaatggcagcctgctaaaagcagcagtatttcagttgcaggaataacttgcttgtcatcaacttgttaatgcaatagtcaaacatttctctgacatgtacagtatcagctaacttcagcagataaagggtctagaacaggaagatgctgcagatgctttagctcggaggaaggcttagcagagccaaaacgtcagcagggcctgtttgttccatactttccatcgggctctgtgaaagaaatgttagattactgcaatgacaagtttgtgacaagcaagtcatttgtgcaactggtgcgctcctgtttttatctgtttaccattcagacttgtgaatgccatttcaagcacttagaggatttctggctcccattaaggggaaatggttcctccatgtttagaattttctacctcaaagagaattactaagcaattatttgttcctgtggtcagtgtcacacaaaagcactcttgagttgtttagctggactctgaatcatgaaatgaagtcctgaagactggatagcttggagcatcaaaaatttcccatctagtttattggaatgactacaaagcaagcctgtgagagacaataaaattatggccagcttgaaataccttgcccttttgctctgggatcatatatcaaggccatatgcttcaagccacataaactcacttgtaacaagtagatcctgagaagctaaggcctggcgatgtcacactgacatgtgatttagcatatgactgttttggtgacaaggaccactttagctgttgagaagagaatttccactgacttctctctataccttgtgggtaactatagggtcaatactaatccagagaacattttaactgtggtaaaataaagtaatataatatcaaattaataactagggccatcctcactaggctgactttttaatagtgaatggagaccctggcagatttgagatcaagaattcaagatcctctcattaggtccttcacctgaagttgctgagtttcttcaagtcattttaacctcctgggacgaaggtagaaaataacagcacatgttcctttccatctgacataaatggtctcagggtcaatattacaaaagatgaagagtgccttcagactcaagaacaagaatgatactctctaaacatcatttattctttctacaattttacatttttgcccattgttggtactgaatttatacataactctaggtataactcccttttttttttttttttttttttttgagatgaagtctcactcttgtcacccaggctggagtgcaatggtgtgatcttggctcacggcaacctccatctcccgggttcaagcgattctcctgcctcagcctcctgagcagctgggactacaggcacccaccaccacacccggctaatttttgtatttttagtagagacggggtttcaccatgttggacaggctggtctcgaactcctgactacaggtgatctgcccacctcggcctctcaaagtgctgggattacaggtgtgagccaccgtgcctggcccaattctaggtataactcttaaagaacataacagaatgaggctttgaagcagacacagatgtacactatctggggaagcaagtcaaagccggaacaggtggaatgtcaaggactagacaaaagtaatgatgtaaagtgaagcagagcttagaaagggctactagagaatgttacagaaagcgataatagtactcattgaataaaaattttattgtgaatgatcctgtgccagacactatgtgtattatacaatttacatgtgtaatttaatcattacaataattctatggcatatgcatgctcaatattttttcagatgtgagaactaaaatgtagggagttaagtacttcacaccataaatatgtaagctgcagagatttgaaaccagttttccattgttccaaagcccatgtactcttaaccatagaagaacgaaagtcatttccactgcctccagaagccttttctctcttgcttactggaaaacatttcagtctggaaatacaggaattcactaatttgatacaaaagggccagtgagaagattctagctctatctgtattgccatccttgttaggcctctgagaaagctgagtttcatcaagatgtcattcctttctccaggcctgacctattcctactttaatgcactggggaagaggtaagtgattctaacctaatcacatatctccgtgctatgaatggagggtgtttggcggcatctccttgtgtccatgacaattcctttctctctcttcatgtgtatagcctttagttcatcctactctttgctcccatattacttccagggggccttcttttgtcacttgtctgctattctgttttaggtgggggaaggggcggacagctttcttaccatgacaaggatcactgaaacagtctcaacttcaaactttgcacagaatgtatcctttgttcggtcttctgctttgtttctctttaatgatagctttgccatgagtcccattcgtatgtaactcagagctatgcaaatcaagctggtaagcaagcatttgcagttactcagtcttaaaatgaatatgtgtccaaccagtggaaacctgagtgaggaatgtctcctgaacattatgtgtggaatggctcctttccttgatgggtggcaaataataaactcagtgagatctgcattatattccctggtctcttttagtgtatgctcagagtgggtcacaagagtggttttagcttatgtaaaattttttcttatagtatttccaattttttttaacttcttgatgtctcccaaacacagaattcttaatagctactgaaaaatccccatgcctgaagaatcctaagatcccagggcaaaaatatggtaaagaacattaaacaacccatggtctgggtcttaatctggtgctcacagtgatcattcagtctctgctgcataccaccagggcacggaactctccactgtaggatacttctttctgttctgttcttccttatgctgaatcttaatccatattagtctgttctcatgctgctatgaagaaatacccaagactgggtaatttataaagaaaagaagtttatatgactcagtttcgcatggctggggaagcctcaggaaacttacaatcatagcagaaggcacctcttcaccgggcaacaggagagagaatgagtgctgagcaaagggggaaaagccccttataaaaccatcagatctcatgagaactcactcaccatcacgagaaaatcatgggagtaactgcttccatgattcaattacttctcaccaggtccctcccacgacacatgaagattatgggaactacaattcaagatgagatttgggtgaggacacagccaaaccatatcataatctatctttctaaaatccccccagtgcgtctagttctttctcaccctaaatttcagttcagagcttcagaaaattattagtttaatgactcatttaatgacaacccttgtgtgtattacataccaacaactgggtttagattgtcctgccttgtccctttctcctcacccaacatgatttaaattcccactctatccctctgacaagccggggagaaataaaagccagtcacacccatttctcatttccatttggatgcaggtagtactggtggcaaagcattcttaatctctttgattttctgtcctattctgtggaaaatctttcctgacaacctcaggcatctttgattgatatggctatttatagattgaccatttaatttattgtccaagcagggacacttttgacagtgaaagggccttataaataattataccaagactacagacttaaacaagaactttcccaggcaaacttacataacaccttgcatatacttttacttcaatacccatctttttgcataaaaactttcatgtctatttttcccaccaacctgtgaacactctttagcaacagaaacatatttttacctatgcagcttcagttcctagaaaagtgcttgtaagtataaagacctgggggtaaatatgtactgacgcacatgcatatgcctatatgcatgtgtatgtgtttgaattgatggtatatttttccataattacattctgtggacctctccccttatttcatagcaaataccaccaacacatgttaacttcatatttttggagatgaatcaaaaatatttcacttaatgccataggaaggaaatggtctgagtatattggtaatgggtttgcttttaatattgacagcaacaaacagaaagtgaaatgtgataaattttccactaaaagtctactgcatatttttttaacaaagcactgaacaataagctttaatcgctttcttcacaagtattataaattgtttcaggccgtgtgcgaaggctcacgcttgtaatcccagcattttgggagggcgaggcgggcggatcacctgaggtcaggagtttgagaccaagaacggccaacatggtgaaaccccgtctctactaaaaatacaaaaattagccagtcatgatggtgggcacctgttatcccagcaggaggctgaggcaagtgaatcgcttgaacttgggaggcggaggttgcagtgaagctgagatggtgccactgcactccagcctgcagcctgggcgaaagactgagactccgtctcaaaaaataaaaataaataaataaatttatttattaatttatttaataaaaaataaaaataaataaaaaataaacaaaaataaaaataaataaataaataaaaatttcagcagctgtatccacaatttcaagtttgtagtaaatgagttattataggaaatgatggtaatttaagagtgatcctttaatctccattaaaatgttggtggcatttctattgctttcaccctcgtcaagcacatttggaagtcctggtaacttttggcagtttttttgcttctgagtaactgtggctttaagaaaaagaaaggtaaggagaaagtgcctggaaaatgtgaaccacttagagaagtcatttcttcccttctcgctgacacatgcagaccattccagaaagatatgactctatactggttaaagagcttcatagaggataatctcacaacttccctttcagtgtttagcactcactattaataacctatctcattatcaaaccttaagattttctgttgcagcatattttgtcattatcagacctcagtgaagaaaagagagaaagccttgtttcccacttctcatcacttgcttaacagctactattagcgctctaccttaacattcctttttccaagataaaaaaagtcaatgtttttgactcttccttgagaatttttttccaaaatgttaaatttaaatttgtttggaggggtttgataattctgtctctctaagatgtttgtattcagtattatctgaaatcagaacaagcatgaataagtatgtaatctatgctcataagaaatcagagaaatatctatatttggcatgcttcttatacattccactattatagctattttaaaatttcagtttgacatttcacactcttgataaactttctataatctacttctagatgctatttttcccacagaggaagtcattctttattttcagtccatcaatgacatttaccaaaccatcacggataatgaaaaatataagacttataagattcaaaagaaacaaagttacatgtctattatttcagagtcttaaatatgtggaaaaaagaagacaatcccacacaaaagaagaaacatggataagcatgctcaggtgtttggtgctagctcaccagctattagtataggtgaactaatacagctatatggaattctctatacaagtgatgaagaagtagtggatgaaatgccacttttgaggtctgctttctctcctgaagaaaactaacaataacttttatttaacaacgttttgtttattcccagttttactgagtgttcatttcagtcctccctctgaagtggttagttatacttatctctcaaattgttgttatttggacactgtacgtaaaagcattgcactttgaaagcatgcatttcttgtcctcaacatctaaaataatgatttgcaaccatttagaagttctggtatcctgttgttaatgtgatttttgcatcactcttccttgcctattccttaaaatataattttaaatgaaaattaatttcattttgaggttttgaaatgcctctaacaataatttagaatacactgaatttgccaatattggaaaacatgtatgtagtctagattatcaagccagaatccaggaccgacctcaatagcatgtcacttctatatctctcaatactgagtctcatctcctactaatcatttcctgagaattctgaagtgctggccacaaaataaataggttagaattttttattttttggtcatttgagacagaattaaaggctctgctggttacgtggagttatatcataatactagctttgccttagttcagcaaaacttacattgggctaagaaagaagataatatattatcaaggcgttgtgtcctggtatcatcaaacgatgggcaaatcgatttcattaggtctctcctaggatatttcgtggaataaaagttagagttctatgtctataacttgcaggatagaattattaaaaatggttgtatttaagtgcattttcccaaatagtgagtttccttttggcagaaaagagacaatgaaggtaaatgtgaaagtatcatcaaccacaaactagtaagctgaactcaagtataatggcaatcttcctgggtgatcagccatagagcaccatttgtgcaagagtctgaatttctatactaacttacttttaaatttcgttgaatacaaacataacaatgtttttaataagtggcttatctattaagtttatagagaaccttccactaaagagattacttattctaatctattcttttgtccaatcttttccccatttttgcccagtgttttgtttatataatattttattctataaaaatctatattatacattttctacctgccttgtctattcttatacattcacaatctattctactcttagtatataatttgaacagattcacatacataaatcaacattcattacttctgggcatataaatggttgctgggtccatgacggctgtttaaataggtagcttccaggccactatgacatagggaaaaactgaaaagtgtatgttttataattattgagtaaaagaggattttcattatggagacatgtacagctatctcaaaggcttatttttccaaaaggaacaacgacactgtcccctgggatatgtgaattgaaaattcagtgtcaacctcttctaaaaaagtagatattttgaggtattaaaaagcgttcttttattagtgataacacctcttacttggggtcgttttgagatgaaagttggcaagtagatttttcaataaggcggggtgggaatcactataaattcataaactaaaaagaagaatgacaatttattggcccaaaaataggggagagggagagatttttttgttcttttttcttttctttttttttttttttttgagacggagtgtcgctcttgtggcccaggctggagtgcaatggcgtgatctcggctcaccgcaatctctgcctctggggtttaagcgattctcttgcctcagcctcctgagtagctgggattacaggcatgcgccaccacacatggctaattttgtatttttagtagagacagggtttgtccacgttggtcaggctggtctcgatctctcgacctctggtgatccacccaccttggcctcccaaagtgctgggattacaggtgtgagccactgcgcctggcctaggagattttggaataaaggtgtctctgtgactaaaaacatataactggtcatagatagtctgtttacctctagtgtcttttggagcaagggtgtgggtctctctgttgagtggtgcctatcattaggcatcacagcaacatcaacaaaactcatctccgtaatatagtagattttacattgtgttaaggtagaccttttaaacaactccttcaagttttctgttgatttcctgccagacagtcagacagctacttcttttttagtaggagtagtcaaggctaaagtcaatacatgtgccttccttgctgagttagaatcaggcatattccatcaacacatatgtcccactgttctcatttctctcactttactatgtgattagtagacaaagtatatactaaagaaagctgaggaagttgctaggatttctaaagaagaagaatccaaatcttgcctactttaggcaaaaaacattttagtattaattgaaaagagatggttaaattgcaacccataaattaaaatgtagttccaaagtgtgtctatagtgatctacaagcaaacataatttctcatattctttttttttttttttttttgagatagagtcttgctctgtcaccaggctggagtgcagtggtgcgatctcagctcactgcaacctccgccgcccgggttcaagtgattcccctgcctcagcctcccatgtagctgggattacaggcacatgtcactacaccgggctaattttttgtattttagtagagacggggtttcactatgttggccaagatggtctcgatctcctgaccttgtgatccgcccacctcggcctcccaatatattattaaaatatattctgcaggctaattctatgttcttatctcattcctgtttcttcctctgctccagaaaggattagtgtctagcataaaacaaacagtatataataaagaacagataatgtatagtcataaaattctgaatccacagcaaaaagagggtaaggtcttagtctagcaggtaagtcttattgacaataataaaggcatgtttctaagccacccatggaaaataccaaaaatgttctctattatatcttgaggtgaagttttggccgtgtaaaaaattatggttaatgctgtgtatgttatgttttatttgccttcattctgggaccacaaaaacggatctaactatagataggggcaggagagcatttgtgtttcttcattagaagctgtgcatgttagtctaatgtataagaattaggaaaacaatactaaatctcttgatgcaggccatgtcataaatccatttatacttatataatattttcctttttcttattctttcaaccttcatgcttcttttttcatttaaaaaactttggggtcagcccttatattaccagatgatttctagtagttgaagcccttgggaaattcatttgtccatccatgctgcctagtttagtacaacactccaaagggaacttccttctaccaaaggcaatgactgattggacttaaaaaataacttctataaatatgacataatatctggaggccacatttatagctggtcaaatgcactgttagccctacaaaaggctggctcataattatgaggcaataacatgtaaatttccctttctgatgagaaactaaaggtcacataggtcctgagttgtattaagactgcattaatactgttcgttagacatttcttttctcagtctcaacaagtcaccttaaaatctatggtatatagcagatcctgagcacctacatgaaaagcaagtactcaaatgttagagacctgaattgaaatcaagattgagatccatccaacttaggagttactgctggttcaatgagtccagggaagaggccatttaatgattcctccaaggaccattaagagttccagggtattcccttggatatctggaaacctgggttacttgatctgagcatgactaaaaactgggcaaagtcttgcatgcttatcctaggttggacacagatctctaagataagactggtatttggtaagctctcatctttcccattccttcctttagagttcatattcctgatgtattcttgtcacaagatacggtcaaggttacacatgggttaagagctcacagcagtccaataacaaacatgttgctgtaatactggtctcccttgtagaccttgaaagtccaatatgctatcatctagggcagttcatgggaaagttgacataataatgcttcaattattcaatttataaatgggacatttaactgatagagtagggaggacaactgagaaacgtttgaagatgtaaatagtttttgtttcagagaacaaccttatctctccaacacagtaatattttttctttgtgtagccaaatttctctaacacgaggctcacacagaagctatagagacttcacctagaaggtctcaatggccttagagccatatatatatttctactataaaacagcaacaacaattttggcccaaatatcataacctaagcaaaaatacaaacaaaatcaaacaaacgaaaactacctagaatataatcttaaaaagtactgcctatatgccatcaccatgtatactataaaacccaccaaacttagaatgcacaatgatgtcatttacttcaatttttataatactgctttttgaagattcctatttttatacgtaatgggaaacatgacatcatataaatgaggcaggcaaacagaaaggtgtagaaggcaaatgcaagatgcctatatattgtctaccaagtgttgccagttgtgaaaggatttgacatgctaatatccattcattcactaagagcatgatggctggcaggctctgcatttaagtgcggttatcgaggcccccaaatattgacagagtgccagattctaagaaactattgatgtacacagccggccacagctccagacacctctcagacagagtctttaaatgtcacagataaatgaattttcatgaaactgagagagaggaagagcaagaggagagaaagaacacagaatgagaggcaggaaagaaacaagaaagaagaaaatcacttccataacactgacatgaaagcatgtggcatctcatctctaaagctcaatcataactccttacacaggatgtgagatcaagccttctgaatgcattgcattaccaaagcactcaaacacttttaatcatttcattgcatggtattttaaaagttaagggagatacatgttacagaatagcttcaacaaactatttctgagcaaaatacagttcaaatataaatacttcccgactcaatcctaaagcaaattaaaaaaatatatatatatataaaggcccacaggcacagataagcattggagccttctaagcagttctccatatgcataaaaggtgaaaagtcaaggtgtcatgaaatctattttatgccaagacacaaatgtgtcctctgacattttcttctccacagtcctactgaaagtagtgacccctagtgggtttattgcacgatattaagggatgccttcttccttcacctctcttttcctgcctttccacagaaaacatctgccaggaaaatatacgagtcagttacttgacacatgataacaaaagtgagccatggttataactagaacgaccaagtattccttagaaatcatgtgtaactcaatatattttaaacgtaaaggaagcttttttactttgaaagttttccatctgctgagggcagcttctcttgaccttgatacactgtgccattgaaagcagtcacactttcaaggttagaatatggcttgtttgtgcatttactgttctatactagagttgtacaatctccacgttttacataaagcgatcatgccaaggcacacaaacaaaattcttcttccaattcaaaagcacatgggtaagttttctgttttggtttttaacctgcagcaacatggtttcacaaagccctagctgcctttttactagcatcacaaaaagccttggtgtaagttatttttctacatctggctctctctgttttggatacatgggactttagcaggtatatacttggagaataaagttccatagctcaaatattcaatagaggttttgtttttgcatcaacttttcagtaatttcttagtacttttcttttttatgttaggagataaaatgaaaggatttagatttcctgccatgggaaaaataattattttccctgtctttaaaggcttttattttgaagacaaaatcagttttaactcaaatggaaattgcagtaaaatctcagacactgtaatcagtgactgcattaaaactctcaagaaggaagccaacttccatgtgaggccacaattcagccaggatcacaaagagacattatccactttgcctgtggccattctgtcattttagactgtaaaatttttatactgtaaaattaaggttcaaggaaatcttctctaactttcacatacatacacataaatatactgatttttgcctgtaaccatataataagcagagaggttttggcttactttagacataggtatagaagacacttaataaagattattaaaatttccttcattatataagtaatagtgttcaccaaatattcagtgattggttaacacaaactgtgttatacaccctacagaaaatactgtaaagttgctaaaaaaaaaaatagacttaaatgtgctatatgacaggatatgacattatatatgctcaatccctcttgtataaagaaaattagtatacatatatacacatatttatgatagataggcatatacacaaacattttcttctggaagtatatgtaagatacttttgatgtatttggggaaaataagatggagaattttacttctaattacatatttttctattctgtttgaattcttcaaacatgtttaaaatataatgccaatagggatatccgagtggtaaggttatgaggaatttttttctcttcatttttttatatactggaaaatttaatatatcatatttcaaaacggaagcatcttcaaaataattatgtaatagtaattcatgttagttacaagaaacttgaaaacactaaaaaagcatgaagtatatcaacaaacagccttgtaattctctgacccaacaataaccactgtcgaatttttgctgcgttgtgtccagtttgcaaagtctcttctgctttgtacagtgtaagtaagaaagatcctttacattcccttaacggggggggacccaaaacagctttatgtgtcatttgttctgctatataccttcttagacaccttcaccaccacaccgtttttagttgccaggacattgttgaaatagcatgctatatgtgacacctccctaaattacacaggttctttattcatctgctattgccccctgaaaaacatgatctctgtgctatttcataatagtacatggcatttcatgatggaagccatggagttgaaggcaacagtggcctcatgctccacaattattatagtatacatactgaaatagtttcgtgaggactcagaaatgttcttctcttctgaatgcacagagatgcttccctgtaaggagctctgtcttagaacttcttcaaagcctaataaagttgaaggaaaaacacagaaaggtgatatacttggtgtgatattttaagcaactgacctattaattataataccttttgatattttctttgctgaggatcattttctgaagaagggtatgaaccttctctttcatgcaaaataccttggtataactgttcatcttttaagtatcttatttgccttttggcaaattaaagaattttcctacctttgttgttgctgttattgaaaagaagataataatgacaataataatttttatagctaactcttattggttgctttctataggttgggcagtttacttacattatttgcatttaattccaaaaatacctctattattattgttgctgttattcccattttatagatgagaaaacccaggcatagaaatgttgaaaaacttgcccaatgtcacaaatctactaagaagtagacgaagaaatctacatcagactcattccaaatcttccttaagattattatctagattagggttacatgactgtactaagaggtccaaaccatgtccagagctttcttatttttctaatactatggggggtgaaggggagtgggaagagaaagagagcgagcgagcacataagattccaaataaaatgttataaaatttatctaagacttcattttcctcacctctaaaatggacagcacccatcacagaggtttatcttgaggaccagttgagataatataagtgaaagcatctagtacaactaaaataaaacaccattattgctctacaagtttccttcctttgcataatggatatgttctggataaggtgattatgaaaaggtataggcttaacttctgttgtcaaatcaaagagcaattacactataaaatctcagagaaggattcccaacagattgagatgaagacctgatgtaaggcaggggttcaggtggaggctgggtctacagatttactgggagcactctgtgggttggtaacacattctagatcctcttacctctctctcctcaggctccttggtctgaaaattcctgagtgtactacagcagtttccagagatgattgctttctttttcttttatctggttacaaagtctagtggaatttatttgcaatgatgatacttcacttgaaggccttatcccacacattatgatataaaatagttagaaattcctttaatgtgagattctcaatcagataaattcactgtgctctatttactctggatgtttggttacaggtttccatcatattattaataatacttgcattaacttcctcatattcattacattgaaaggctctgagttagaaaatatgtattctactttcttggaaaccctacactcactagtgaggcctataaataaaatgaaactttaaatagtacgaacttcaccttcaactcataactaaacccaactctgggcttaaagtgctattttctccctccagtctcatcagatataagtatatcatgttactaactgaggccaagctatatatttacacaattcacttcatactaacaacctgctgcattttgttgcttgccttttcttgaggtactgggacttactcttaaattaatgccttagtttttttttttttctctagggacatccttttacttatggaaaatattcagaaagaatggaatttttaaaataagccatctgctgcgcagacctcaagaaaaacagttatgtttgaaaataccagattcaactaatgaggggcacaaaagccttattaactgtgttagctttcttatctttagagctcaggtaggaagtaagagccgacctcagcatgccaacaggtatcaagtgagagaggtcagcacagtctacacccttatgatatagcttgaacacatcagctcagaagtactcttcataaattctaaaaagagaccttcttccagattatctcgcacatggcagcagcctgggagtccttaagacaaaactctctagttctagaacaattcaaacaaggtgcatttacattatatttaatattttgctgtaagcagacgatagaatctactcaaaactatctctatttcactgtttgcccatattcccatatccgtcctttatttctcagcttatatctttcttgaatttctaaagataagaaatctaatttattcatgtattcattatacaataaatattaagtatctcagaaaagggcaaataaatagatgatagatgattaatagatagctaaatatatagacagataatagataaatagctagataaaacagagatgagttatggcctaaagaaatggctaaggaagaagattgcatattgaggatgttttaaactaggtattgaaggatacttgggatttcaaagtatagagagcaaggagaaatcatttcgagcagaataaactgcatgaacaaaaaggtcatcacacgttgggaaaagcagattatttggtttgtgaaagagagtagtaaaaataaaactgagaaggtaaattagggttagatcacatgagagttcgagtgccaaccaaggaatattactctgtcaataatctaggtttgaggaaagcacagtcaacaactctctagctttcataatttaagtaatgagtattataatccaccaaacctctggtctttaggctccacaggggatacgttagatcagtggtagagaaaaggtcctcatatttaatgagtcctcctccagctgagattatcatgctgcatctattgaagttaatcatctcacatgatttgaacaagaatctcactagttcctaatcacactagcattggcccttcattctcaataacaagttctatagagttacctaaaggctgacactgaggctggctgagatgagagcggtgagtatcccaagcacatgtgagatgtctgtagaaagtttgacataagctgtcatttgattttgaataaagccaaattgttcataagtgattggttacttatatatgtctagttcaggttctccctatgatacagaaagtcattatagtatacgtggaactctgagatctccttacacatcttttaaggctcactcctaactgtttaggattctttgatagaaggtgtttcccagcaccttctgttatgctccctctttattgttctctagtggacttactgacttctgatatgctttgtttttatgtatgtatttgtttactttctgcctctcctctccaaatgttaggtctttgaaaacaaggattatttgaatgtgcctgttttgctcactgttgtatctccagcatgtagaagagatacctattgaaagactgcttttgaaactgaagacaaaatatagaggaaggtaagcacatattaactggtatatgggggaaaaaaggcttctgtataaaactccccccaaaaactcatatgctatataatttgaaaatatcatcagctaattatgtcacggacgaattttctataaaactcaaagcacttttaaattaaaagtatgtattttttcttcctgttactgaagtaacaatctcattctctctattttatacaaagggaaatcatggcagagagagagatactctggagtacagcagatgaattcagagcttctgactctaagggccatctatattctatgcactatttaatgttagtttatattttactaccagtgagatttaagtgctgaattgaatagagtcctagaatttgtaccaataaataatgttattaacttatgctctttctgctagcacatggccttctcacagatataagcaaacaaataaataaagagcaacacagaaagaggaaaggtgaataacttaaaggggtgaacatggttgttcttatttttaaaatccagattgttcattttcgttgtaattgtattgtattctactggcagaaagagatgagatttagtgtactatgcaaattatagtaggtccaccacagcttatcaagttctgagaacagtatggtttctttttcctcagatcctcttttacccttaaaatatcttctggattaaaattctcattcaatgaaccacatctttcaatataaaaaatgaaattataaaagtactaaaagaaaacattagtaaatttctttataatcttggcataagaaaggactttttacctataactcattatctagaagctacatagaaaagattagtaaatctgattatatttacaaacaaacttcagtatggccaaaaaatccataagtaatttttaaaagtgggaaaaacttatgcagctcacatagataaaaggattatcatcttaatgtataaatagcaagaaatacataagagaaagactaacaacccaatagaaagaaaaggctaaggagatgaacagacaccttatggaaaaataaacgctaatgacattaaacatattaaaaaagatggttgacatcacttataattttaaaaatgcaaactaaaactataccgagataccgtcttttaccaatacaattggcaaaaatccaaaagcttaaccaagcactattttatagttgaggcttgggtaaaaaggtacttttatatatgccaatggagctgctaattgatccaactcctgtcgagatcaatttggcaaaacttttcaaaattcaagatgcatataaccctttgatcaataattttatttctgagaatttatcctgcagataaacttgcacatctatgaaatgatttatatataaggttgttcactgtaatattgtttgaaatgaaaaaaattgtttatcaatcgggactgaataaaccatgatgcatttatataatggaatactgcaaaactataaaagagattaaggcagttctctatgtatcaatagcaaaagacctctaagagatactggagaatacaagattgagaacagtgtataaagtggtttaacttttgtgtaagaaggtggaaggagggaatatatattcactttttttgcataaaaagaccactggaaagttacacaaaaaaaataatgaataaaagtggttactaatgggaatagaaagagaaaaaggtggatggggagaagtgaagacgtttttacatagttttgatttttgaaccctggaaatatatagcctgcctcttcaaatatatttaaaatatatgtaaaatatatttaaacaaatatatttaaaaactaaatgaaagataatctcatattaaagtaaaaatgagaacagcatagcaatgataaaaatggttcctgagctccataaatttctcccaacttttagctaccggtgcagccaatatctgggtaaacgtggtaaaaaaaacttggcagtttggtccaaatggcgtctttggagcaaaaaatgattcaggttcttccctttgactttgtagcattcttcagatgttattaaacagttattcctttctaagctcaatcgagttaccagtaaaatataaaatgacattagtgttgcagctgtgaactagttgggatgaatccctttaaaagcctaggatgatttccatgtgttgagtggagaagacctggatgtttgcttgttgctacgtaataagaacaaaacacatttcttgaggaattttaatgtgtaaaattgtttttaaaaataagtaaaatctatttattaattatataatatttatcaatcttctataatacttaggcgatgtactcagtatgcataacattcttaacaggaggcagaatacatcattaggcagatgatgtatgttgagtacttagaagttcctaaaggagaagcctataaagacagtgcattataattaataataaatgtaatagtataatttttttgtaaaataagcaacacatttatccactagtcagaaattatagcttcaattcaataagctgctttctcatgtttgtattgagaatgccatctagaacaatctagaagccacagacaagagcaggggtgaaagctcctaaatttcctatttccgttgtcccatgactttttggtaaaaagataatcagtgaattacccattttgtgtaagaatttcttcctctgggttctgttcttattttaggcaatgattttaaaacatggaggtaggtaagtagggagtattcattcaatcattcatttgtattaattaaacaccaagtatgttctgtgtatttcgctaacattagaaatgcagagacaaaagacataatttttgcccccaaatatttcaatctagtggggagaaaggaaagtaaataaccaactaattataacacagggtgaataacctgctgtaattgacttaagcataaatagctgtgagagaacagaggcgtgggactctgacttttaatgaggaggctcaataacaagttttgaggagtgggtgccttagctgaaacttaaaggatggaagaagttaacaaggcaaagatttgagaggatagaaagggattctaggtataggtaacagaaaaaaaaaagtacagagcaagacagaatatgatccattcatgaactgcaggtggttccagacagaggatagagtgatggttgggaatgccaagaaatgagttttcaggcccatccagattgtgatggaagcactactttagataaggtgataagggaaggcggagatctgaatgaacagaaagagacagccatgaagagcttggtgagaacaacgttcccagcagagaactgtacttattgcacatatatgcctattttaaggaatggttaaagagctaggggaactgattcctggttgtcagagatgagcagcactattccaaatactcttcccctgacaattatctaatctcttttgttgtctctggaagcatggttctttcccatcaatgaattcattcagtccctgtaatcaactctgattagtgttgtttaacatcaatcttttctactttttttcaaagaaagataccaatcagttgctgcacacccctgcttgttaaaagcagcacctctcctgctgacttaccgttcttttaatcaaaagggcaggaggaagcagttgggattcacttttctttttttttctttcaaagtacacaaatgtcaacttccttaaggatgtctggcatagctgagttcagtcatgtaacatacaaagtcagcttgatcaaaaggttgcaggctgcccactgctaaaatggaagagaaaaggaaaccatgggcttccctgaagtgtgaatgagtgcataggccactgccacgtgtgtatttatactgaagacatgctgggctgacaagggagattaggaaacataaatccccaccactacactgctctatcttcacctttgaacctctggagcagcactttctctctttcctatttcttctgttgtgcccagtgaaggagttactatatagctttatagcaactgcaagccatggctatttttgaatatttaaaaaaaacatttttgcggccaggcactgtgcctcactcttgtaatcccagcattttaggaggttgaggcgggtggatcacttgaggtcaggagttcgaggccagccttgctaacatggtgaaactccgtctttactaaaaaaatacaaaaattaactgggcgtggtggtgggcacctgtagtcccagctacttgggaggctgaggcaggagaatagcttgaacccaggaggcacaggttgcagtgagccgagatcacgccactgcactccagcctcagtgacacagtgagactcaatctcaaataaataaataaataaataaatgaataaattcttttgccccaacatttagttgaagtttataattctcaatttgcaatatgaggttataattcacaatatgcaatatgaggttataataatctcaatatgcaatatgaggttataatcatttctatggatttaaaagtgttaataactagaaaaagcataaaactgttcattcattttttttttttttttgagacagagttttgctcttgttgcccaggttggagtgcaatggcatgatctcggctcactgcaacctccgcctcctgggttcaagcgattctcctgcctcaggctcccaaatagctgggattacaggcatgcacccccaacgccgggctaattttgtatttttagtagagacagcgtttctccatgtttgtcaggctggtctcgaactcccgacctcaggtgatccacccgcctcggcctcccaaagtgctgggattacaggtgtgagccatcacgcccagcctcattctcttactcttttaataaatcagtatgtatcatgtgacaaacctgtatctgccaatatgacaaacccttgtcaataattctcctggaagatgcttctggcaacccagaaccagaaaataatttttccaaagagttgattatcttagactaaactaatgactcaagttggttttacaaatagggaacactctgtaaatactcatggacatatctaaacctgaacatacattctcatgaagcacaaaaatcatcatatatggttacagtccccaaacaaggctgcagaagaatttaacattcgtaacaatgtacagctagtataattacattttgtgcaacctcgtaattctttaacagtacaactgaagtgatgagaaggtacatactgatataaggtaacatagctctgtgttctagccaaaactagaactcaggatccattatttttaatctaggaacttttatgtgatgaccatttactaggaagggttgggagtaaaaagcataaggcaattgatatagagaaacaaggatgctttaaaaaaacaaaaacaccagtctaaaagaagactattctttactcacttgaaatggctctgaattcctgggaagagcataggaagaaatgtaactataggatcacttttatatgagtaaattaataaatcatttcccctatgttctctaagaaatcttttagaacaatatttcccaaacttccctaatcataccaattgactagtttcttgtttcagatccaaatgccaaggccccttcgtgaaaatttcttattctctaggtttatggtagactcaggaatgtgcatatttcaagggtgaccctgatgattcttagttcagggatgtttgggaaacactgttctggagaaaactttgtacaatagctaaacatttcttcattcctaatgaatcatcccattttaatgtttctgtggtgtgtcttaagcaggtgcagactctcatagcaaaccataaactcctatgttcctttaaaatagcttaagatacatttactcagttttcaggattagcaaaaagtcaaatagggctgttaactagcccattcccacagaagcaccaacctgtaattcccaagtatcaattctaatgtgttcaaaaataaaagcatatgcttagtcatgtaacagagggtttctttttttacttttatttcattgtctgtcaatctggttgatcagattactaatttctactctactggaagtgatctttagaaaaacaggtctgccatgtttgcattacagagatattaacaataataatgatttttaaaaagtaaaccaaacataaataaacaggaaaagaaaccaccatatttgagtccagtctttgtcctgcctagtgaaacatctgtcttatacctttttgacaggcagaaataagacctttcacatcgcctcatctctctgataaatcagtctatttccttacaaatttggtctgagacaaaactcttctgctcttccacttaccatttagaaaggcacagtcagaaacaccatctaagatgagctcacttctgggtgtctttcagttagacttctattaaatggataacaagaaaactaaccaagaaacaaaaatattcctgtcacttcttttgcaacaattccacaatcttgaggaaaattgaattttgaagaaaagaatggtctatgccatcttacaagcatgagatggaggagcaatgactataaagaatattcgttaattttggttgtactgtagttatattacaaattgcacaattaattcccactatcaaattacactggtaaacaggcctagattaaaaacacaagcctgctctgcttgttttgctctgttatacacaaagtaatcttaaattcagtttattatcattagtatggtttcactttgggggaaaaaaactctttttcctcataaggcatattgcatattgagatgatgaagaccaaagtcaatgctgtagagagttgtagggatataactgctgctaaaataagcacttggtttagtagactatttcccttagacgcttggagcacaataattttttcctgctgggagacaatgtatatcctgaatggggtagggcctgaaagacagtgaaatacagccggaaatacacctgatggcagaatccaccaggatcagacagcatcaggacagcattaaacacagtgtttgaagatagcagaggtatgtggactctcaaggaacactgaaagattacagattgtaggtgagcatggttttgagagtctatctctgctagccacaagaaaattagcagtcaacatttgcaaggtctgtttaattatgtcagtgaccagagctagcctcccaggttaagtgagaacgagaactaacaagctgcccctagcctccttcaggacttaaatgataaagccatggcaatcacagcagcagcagcagcagcaaaagcagcaacagcagcagctgaagcagcaacagcagcagcaagaacatggttttgacccgcagttcttgcccatcaaagagctgtgccctgtctgctcccactgacaggcagataaatacagagatctgttggcaagtacatatttatgtgtatctacagttccctcacacagacttacagagaatgcataacagcttctagtggtataacaaatgcacccactaatggggtgagacccattactcacaaatgggtgaaaagaagcatcaatatgcaggtcttaaccccagtttgtgggcagaaacctgtcattccattgcaggccgataggtctcctattcacacagtccttgtttaattttccaaacaccctttctctaaatggtgctactctgagctgtgtagtgcagacagacaggtttgacaagcagagctgtcaatttcacatttttcatcccaactgcagggcaaaattaggccttgtacgtaactggggttgactggttaggaaggcaggagaggttggcatttaagaggtattttccacattagaaactcagaactcaagatagaaaactcaaaaagggttgtccctattcaacatccatgaaatcaggagagtccaaagatgtgtactggtggtctactgtggggcatatacattttgctgaaacgagaagatgaagggaaaagtaaagcttggtcctatctagaaggagctatgggtaagtaagtagtgaaagacactcactcaaataccataatataaaaatggggcacttgccgtaagagaggaacatagcaacgtgtacacacaattcttggttaaccaagaagttgaatatataagtaatatattagtcaaatttttatccttcaaaaaattttggaattgtccaaagaaaggccaacaggatacatgctaggcaatgatgggtggattaggcatacaacgaaagcaagttaaccagcgctgtttctaacaaccaagtcccagaatatccttgggatctctgggactatctcaagcatataacatgagtctgggatggttttgaaatctctgctagcatatgctctgccctgaggtttctttttggtgctgatttggttgaactgaagaaggaagggagaacacatagaagaagagttctctctattttcaggcggcagtcctatctataccggtggtacagttaagaacctagaatgaatgctcctccagaatcccctgtgcagatcgacactctatggtatatgagatctcacagagtcttgcatatcagaaactcacaaacgggaacacagaagagtctgtgtgtccctgagtttatgctcaagctgtcaaacatcaagagtaatttatgttgttcaggaacatactataacaaagctctcacaggttggaggcttcagtgagcctgagggctcacttcccaacctggacttaccccataaggagcaacggactttgctaacatgaaatcaaaaggcaaaggaaatcaggcatttaggaggtattttacagttacaattacccaatcctaggttggactaggattggggttggtggggaaggagacatggaaagtgctgttaaatgttgtttgaaatgtccctttttgatccccacagtcatgagtgtatttgagtcttgattgctctttacttaaattattgtcattgcccctcagttggcatctctgactaatcccaaccctctcaatctactctgcacactatagccaggttaacttctaaaacatgcctttcattatttttgcttgtctctgtaagtgtttcagttattcagcaaatccttattgcattctaactgtctgatagctattgttctcatcacccacaaaaaataaatctggactctgcctgccttttggaattcacatcctagtcttcaataacatggctctcatttctagtttcactacttcctgtatacaccaactttatttccattggttgatatttttcttcatcctccctacttctctgttttcccatattaaaccattggctaccatctttgcttctttccaaaagaccttttattccattatctttcaacgtccagcttttacatctacagctaaagttctccgtctactattaatcaagccttctatactcctttctaggccaccataatgcagattcttgtagtactcactacctttcgttattgctcatgttggtgcataatggcagattggtaatttccagttagttttaggatctaattactagtctctgcaataagagtataaaaaccataagctctctgtgagcaggtattgtgtttctgatagtaacattattaactgttgtgataactgtgaattaagtttagcatcatacttatttctaaatttaaattgtaccacttctaacaaaattttctccatcgttttattaaaaaaaagtccaaaagaggatgacaataacaggaacacaataaatatatatccacatgtaatggtcagtggtcttttccagtgacaataatgctgcattttgctattagctcctttcttttttacgtgatattcactattagacatactactacactaatgccaacattttccagtaaaaattgacattaattaagctttggatgttgtcagcactagcctagggatagggtaggtttagggccactgagaccaagttcagggtataagatctctgatattcatcaagcagctaagataagaagcataatgaaaggcaaaacaaatggtacaccatatagtatgccgaatatttttaatgctgatttttgtagatagaacttgatatcagcttttactcatttgttattgatatatgtgtattttcttaaaatataataaatatagaaaagggtttgtgaataacataatatgaagatcagaatcaagattagagccaagggcatcagattaaaatgcagatgaataatgaatcacctgtaagattaaagctctaattccaaatggaaagaaagcattggcaaaggcatacaaacatggttctagtgtggtgttcacagttccatgaaggaaaagatgaagcagataggagggtgggcctactgtatggactaggtactggtattaagggttttgtattaggcaagaagacaaaaataattaaaagagtttggactggaagactgggaatgataactggggatagtgaataggatggcctaggtgtacaatgaggtcagcatttagcacatcaggtggccaggactaggacctaaccaagaagctggaaatagaaggaaactccttcattcattatttgaccttacatttttttattgaataatagtagtagactgatctatagacctaaaccagtggatcaacagacctagactagaccatgcttaacagaatttacagtttggagggaaaatagacatgaaagacttaagtaataagatgagagcagccagagacaatgagtaggtaataggagtgaggcccaccaaagaagtgatcatatatcagctacttgaaaccagtggtaaaagtaaactcagtaccaagctcacttcatccaaagcatggattccttatatgttctctgcttgggataatattaagatcaatctgtatgtaaagcttacacagctaggacaagcaaggattcctaggtcgggggagtgtgttcacatatgatggtgtctgtgcatgtaggtttttttcctaacaagtattaaccatgatcctatagcataagagtgagtgatgatgaggaggatgataatggtaatgatgataacagcagctgtttattgagtgcttattatatactaggtattggtttaaatattttacatttattagattacttactccccacagtaattttataataaaaacaaatttatggtcccccacctccttctcctcatccttaatttacagataaagaaactgagtcatgagaattagttttcttaaggttacagtgttgtagaatctacgtagtcttcactcttaaccacactgctctactgcctaaattcaggtaaccaacaaaagagttgccctgcctcatcttggagcttatagatgtctacagaatatattgagaaatatatatgagaaatgatttaaggatattcttaccagagcagtagccattctaaaaattatcacaatggtatattatattgtttagacataaaatgagagtattggggtaacatatatcagagatttggctcttacagattttaatttttaattgtactatttaagggaaaaattgagtattgtgaggagcactggaacaatggaaaaggtaatatggaaagtaaaaagtttagtctcagcctggtaagtgtggctgtctatctcttcaagcttcctttcctcaacggggtgacataagggttaataggatgactgtaaaatgcagttaccttatgaagaatgaaaaatcccattattactgagatttttcaaaccctgataattctgctgggattttctgaaccatgataattctgctgggatctggtattaaacagcatgtagacagattaatcccaagcccagaaaagagcaaacaaataaaacataagtagcataatgactgaagaaagttagattgtagtgtccaatctcatagtggccactttttttgtttgtttgtttgtttgtttgtttgttttgagacggagtcttgctcggtcgcccaggctggagtgtgcagtggtgtgatctcagctcactgcaacctccacctccctcccagtttcaagcgattctcctgccttagcctcccgagtagctgggattataggtgtgtgccaccacatccagctaatttttgtatttttagtagagacgaggtttcatcatgttggctaggctggtcttgaactcctgacctcaggtgatctgcctgcctcgcctcccaaagtgcccaaagtgcttgggattacaggcatgagccaccgcgcccagcctgtagtgcccacttttgacaaagttgattgttcatgtgggagcatgaacatgaaaatttaattacaaactaaggagaaacatacttaactttgaatctttcctattggtttcctggagtcaattttaaagtatcacttaataaatactatttgacaatttgcaaatttatataaatgtattttccttagagtataagcattcaactccaatatgatggtttcctattttcagtttgagtaaatatcaaaatagaatgtccctgttagatatctagggaatcacttttaggggacactatataatgccttactaaataccaagactacagtactattattttcacaagtgagcatgggtcaaggcaaagaagggcaagttggggtaaggatgtataggctgttaaccttgctgcacaggtaaatgtaaaagttccttttttctagcctcaacatgctggaagatcctgactttaaactgagtagagaatgtcttaaagcaaagaaacaagaactcctgtactctgaactttgttggggagttctggccccttttatcatttgatcgtcaatgaataatataactgcgtttagcccttaagcctgtatcagctgcaaacgtgacagatacctgtcatattttagaacagcttatcgcctcagcctctggagtgattgagtatttatagacacaaagatagaaacataaagcacatatgtataggcaggagtcccctggaggtggcgattaggactaggcagtaattttagcttgaagttcctatgacttaaatagccacttgagctctgctcttgcagtttacgatgtcaatagaacccctaaatgaaattacagccttctgatacgcagcaggatatcctttctttgccatgcaatgtacacggccaggagaaattgctctgtatatggagtttcactaaagcagaatttatcataaggctgctctgctaaaatatcattatgctgttattcactggataacacatctaatgactcgaggtgcacttgatagccatgtttcagtgaacacagacgcatgccctgatgtgaactgggcactccagtacttcaaagcactatcgatttcaattctaccataatttacacctggcttgttttgccaatagcttgaacccatgctaacactggaacatacacatacaagctttagaaagatcagaaatgaggtgtatagcaaaaatgaatgcagcaaactctccaggattttgcctttataatcatctcccttgatgccgattaaatattttgcacgattttcctagttaagtttgggcattccctctgttagcattatcctttggttggtgatgatggtaataagaacctcttatatttggacaagctatggacacttctgcagcaggatctgggtgccagtcatcttggttctcccactatctagcacaatgactggcacataatagttgctcatgataatctctgcaggctcctcttcctctctccattccagaaatgcactgtatataaaggaccttctcccttttgtcatctttcaatatatttttcctgagaaatgtccactccataattttaactattaccatgatttggatgattcagatgactgccaaagtctgtccctgacatctccagcattcctgactaaatccaactgccagtctggatgctcccctaacacccccaaattaaacaccttcaaaagtaaatttgtaatcttcccccatcctccaaaatctactcttcctcctcatagcttttcttgcttagttgtataaggcagaaacctgggagcaatccaaaattccttctctccatgcccagcccaaaggttattaaattgtgtcaattttgcctatctcttgaacatatctcctcctctctgtctattcccacagttattgtcctagttcagggcttcattgtttcctgtctgaacaatttcagttgcctcctaactcattttcttgcctctattctcccactcctataatctatcctctaccctgctgacagggtgatcttgtatcacacaatttcatcattaaccttctctacttaaaacctttcaatagctccctgaatgccacaagatgaagttaaaacttctttgcatggcaatcagggtccaacatgattgttccctgcctgcatctacagcatcgtttctctgtactcccctactacacataagtgatagtgttccccagctctgccatgctatttctagttaactgcctttgcccctgctggctcccttactgaatgttcttcctccctctgaccatctgggaaaatccttccattcccagcacggatttatcagctcttctgtgaaacttcctctgatcccccactccaagatatgttcagctgaacactcactgtgcctccatggttccttgaacatccttcagttacggcacttagcataatggtattaccccaacttgtttccctatctgcctctcctctagtgagcaacttgagaccatgttgtattcatctttgtattgtaaatgacaaagccaatgccttcacaacagcatattagggcccatgtgatcagacacccttgtctcccttacttcatctcctactagtctcatgcttacccactcagattctgccacacagacttccttgttgtcactcaaactttccagatacattcatgtccaaggcctttgcacttgatggttccactgttgaaaatgcttttgcttagatatccacaaaacttgcttcttcactttcattgaggtcttttctcaaatgctgtcccccaatgaagacttccctctctacctctccaccctatttaaaattgcaaacttatccctgacacaaacacacatgtatacactctttctcctctttaaattttctccatagcacttatcataaaatgccacatattttacatatatatatatattttatcttctgtctctcctatctagaaagtaactacaaggagaacaaagatttctgtttttttttttctaaatctactgcagtatccccaacccctggaatagtgttgggtacataatatgaattcctcaataaatatttattaataaatgaatcaatctttagcttcttgaataataactgacacagagtagggattcaaaaatgtttctttcctttttttttttttttttggtttgttttttgagacacagtcttgctctgttgcccaggttggagtatagtggtgcaatcatagctcaatgcaagctcaaactcctgggctcaagggataagggatcctcccatctcagcctcctcggtagctgggactacaggcatgtgccatcatgcctggctactttttaaaaattttagtagagatgagatcttgctatgttacccagactggtctcaaactcctgggctcaagggatcctcctgccttggcctttcaaactgctgggattataggtgtgagccactgcatctggcccaaaaatatttcttaaactaaaaaatacatgggtgaatgaatgaattaatgttaaatccatctttaatgaatataatgaagaaacagtctgtgtacagtacagtctgtgtacagtaagttgaatgggttactattatcctcattagacaaatgaaatagatgagtcccagaaaggttaggagccaaaattaaagctactatacatagcttaaacaggtttgctactctttttcaattcactattgaaaggaacagacaattctttgcactttgttcatgatgtacctctgacatttgttatacaattttgcttcctcttgactaggaatgcaattagcaggaggtgcaaggtgctaacactttttattacaatttatgtctttccatattaggtgtttttcataaaaaagatcccctttctttaattttcacaagtggattaggcactcatataattttgcccttcggagtggtttgtacatgactacccaggaggacattgtgttacaaatcctgccagaatgaactggaaggtgagtgcagcattcatagcttaaggatgaacaggttgtttggtgccaggtttgtactaatggagatgttctccattagtgttaactcccaaaggagaataaattcaataacaaaacatttcagtttttggcatttctatggagagttaactttccattgttcaagggttaattatccattatgtgaatcacttttctttctgtggctgcttacatctaggaattcagtttactagagagtgagcagggaaaataaagagacgaaaaggaatattctatatatataaactccaggaaaaaaattggtttaggggacagaatgagatatagtttggggattgctaagttgattgacaattgaaaatgggtaagattaaagcatgttttattatacacaatattttgggttttttttttaaattgtttattagggtcagtttgtagtacatgcagttactctctggatgtgattcttgtcagcacaataccatctagggtgctagaatgggcatttagcaaatggtactttagaggctagctcgacttggtgcccctctcctctgaagaaggcttagtgtgctgcagcttaatgaatgaaacagcactaagtgattccacctatttctctactcattgatgagaaacaactgcagtaggctattttcagctattatttacctcaaacagggcatttaattagtgcttgttaagacagtgcaaatgatttggctgccagtcttcttgcccctgctctttattgtgctgtatgtctgccccgcctctctcctgtctagttcacagggcatccatagccagtcttcatgcctttccataactgacatcagcctgacctccacggatgtggaagtttgaggaaaggaagaacaagtattgacaagctggagggactgttggttaatatgatgcattataggtaagtctggtactttctgactacatgagctgaccaagctggatattcggtcaccctcataagtccaggaaaatgaatggaactactgcaaactgaagatcccatgttccatcagaaattacccaagcattgtggggaaccttagcaatcttagtaaatggttggaaatgctgtcagatagttggaagatctaatgtgggagttaaggaggctcagatatagaagactctgccaatttgtgttctagacatggacatgtttttttcttttcttttctttttttttgagatggagttttgctcttgttgcacaggctggagtgcaatggcacgactttggctcactgcaatctccacctcctaggttctagcgattctcctgcctcagcctcccgagcagctaggattacacgcatgcgccaccatgcccggctaatgttgtatttttagtagagagggggtttcttcatgtttatcaggctggtctcgaactcctgacctcaggtgatccgcccgcctcggcctcccaaagtgctgggattacaggcatgagccactgtgtccggctgtttctttcactatgataagcaagatgtattcactgtcaatgcactgacatgtagatatccattcattcatcacctattcattgatcctccactcagactgagccaatctgacactggttgggagagaaattaacaaacctaaaacacaaaacctgccctctaaccacttgcagtttcatatatagaaaaaacttcaacttaaaagcatatataaatgctaaatgaaggtagatttgtaaaatgctaccagtgtcagatcacttttaatttgggttttatggaaaacttcagagaaaaagtgtgacttgtcaaggatatgatttggctgatcttgaaaagttatcagaaaaattatggttgctgatgctaatatgtaaatacagcatcaaaatatttaacatatagtaaaatagctgagaaactaaaatgggatcatctgtatatgtactcagccttataaaataaaatgaattcattaaacatatgctcaattttaagatatcaattaatttctttctacttaattttaaacttttatatatatagcaattaatattttgaagctgtacataatagaatttaggttgataagctaatatgtatatttgctgaaggataattaccaaacttatcagctaactacatctttctttttgcaaatactgttcataaatatttgtgtaaactttcggtgttgtcagtgtgataaaaagtcagctacatttcatttatggtcattatgaccaaaacatttgactgaaatcaaaggcaagtaagcctggctagaatttggtcatatttttaatagctgaatatagatatatggttgtgcgtatatgtaggcatttataagctaacatacatatacaatcatatgatacaagcaatcaactcctttttaagtttttaaaatatatgtctttcttaggggaatcacataaatactaaaaaccacttctatataaataagaaagaacaatttcttattggggtaacaacaattctgttatttagcaatttgatttgtgtatatctgcgactgcctaattaaatgaatatagcatataggaagtacttacagctaaaatatgcacgcaagaaaatacacatttcacaacatgcatcctcattaatttaatgaaattagaatttccaggtgagcactaggaaattgagttattgacagtgcattgtgaaggcttatgatcaaggtattgaaaaaataagtaatattaatatagccattgaagcacaaaaaatacatcgtcttgcctttgtatcagaggtacactaatcaaattctgacttcttatatatttcaatttagtcatgaaattcttccacgaccacttggaactccaagccttagcaactataagaaaaatctctctggcagattatatttttttaaatgtcatgtcttgggaatactcttaaatatttgttttcacctattctcttcttaaagttgcttatataatttcatatgtagtcattaataacatgttttcaaagtgttagagatctagcttgccttcaacgcagttctaatagacatccctaccagaaactatgagacagttttcctgggagtctgggcagtttgaatattaactgaggaatgttaacctcctatgtaggtcttggtggtaatggcctaagagctagttacattttttataacgtattgtaaacaccatttccctttcaactttttttctttagaaaacaagataactaatgaaaattacccaagaaatattatacatataaatagtatagtcctaacacgagctaactacaataggcaaactttactattaatataacattaaacttttaccatactagccctaataaaactctgagactattttctatcacaatgacagctgatgaatttaatgtgcctcacaaactataggaattgtgataggaagctgactctgtcctagaggccactgacaaacctgataaggctgtagcaggggtcagtctctataggaaacttgggctatatgagcatgtatgagttctgtggttaagaatctgaagcactcagtatagcaaacaaaattccaaagctgagtaccaatgtaatacgctggatcgctgtacctacttggacaagagtacatgcaacaggcacatacaatatacatctggttaaatgtaaaatcatccattgctaaagcattttaaacttctaggagaaatctactggcaatgtgttaacagcaaggacaaccaaaacaataaaataacatctctttcctaaaatttaagaacatcaagtaagtgccccttaggctgggttgtgattcctggaagtttcagcctatgagaaccatattggcgacatcaaagactccccctctttccaaaaagcaattcacttcagatgctgccacacaatcgaatgcttttatggccaccatgtttttttggtttttgtttcgtcttttgttttttccatgcttaatgaacatgccagattcttgaaatagaaagaagatgagaaaacccagtaagatggaatacctctagaaaagaaactaggcagggacctgatggtaaaggataaaaacacattccaacaggaattctacttttagggagagtatgagttattaagaaggatgtggaaggcacattttggctatgaaagctggtccgtggactcctctgccagtctcacatcagacaggatgcaaccatccccactccattccttcgacaacttcccagagcacattcaatcagtgtcccttaaattgaggacaatactatatttgggtttaatactgtgaggacagtcatttagttttcctgtggcaggatgataaatttcctgggaaccaaataaggattctcattgcattcttctgcttgatactatgaatgcagaagaataaagaagagggtgtgacaaatcatattttccaaaggtcgggtgtggggaggttccctaacgtttaaaagcaaccagttgttagcaaagtgatctttagaacagtattagcaagaatgtttgctctacatccactatagatattctctcctgcttagctaggcatgtaagtactgtgagcataatgtaaatactcagaacagaaatgcatggaaagctggtggagtgaaactccaaatgaacaattaattccactttcacttcccccatctacctccctgaatactacctccctgcccccactcacctatcttcctccccccaacaagcatgtttgctaggcatgtcaaggctgacatccatcggtggcagtatgaaacctatgcctacaggctgctcctgagcatagcctcaaggctctgccattgtccgtagagtgctctaagttgtgcccgctaaaaatcttcatcattccatttgactgtttggtagtatttctttaattgtattttttgtttgtttgttttaaaaacaccctttatttcctgcttgccttagagacaccaagaataaaatccttgacacatcaaattctggaacctcaccactcaccaggactatggttcctgatccaaggagtgacgactgagaatcagcacacagtctcttgagggtgtccaggcctggctgttaagctccctgc
